(12) United States Patent
Paas et al.

(10) Patent No.: US 9,073,990 B2
(45) Date of Patent: Jul. 7, 2015

(54) PROTEASE-ACTIVATABLE PORE-FORMING POLYPEPTIDES

(75) Inventors: Yoav Paas, Nes Ziona (IL); Ilya Pittel, Brookline, MA (US); Uri Nir, Moshav Gimzo (IL); Barak Ben-David, Karney Shomron (IL)

(73) Assignee: Bar-Ilan University, Ramat-Gan (IL)

( * ) Notice: Subject to any disclaimer, the term of this patent is extended or adjusted under 35 U.S.C. 154(b) by 0 days.

(21) Appl. No.: 13/261,466

(22) PCT Filed: Apr. 4, 2011

(86) PCT No.: PCT/IB2011/051433
§ 371 (c)(1),
(2), (4) Date: Oct. 4, 2012

(87) PCT Pub. No.: WO2011/125015
PCT Pub. Date: Oct. 13, 2011

(65) Prior Publication Data
US 2013/0121915 A1    May 16, 2013

Related U.S. Application Data

(60) Provisional application No. 61/282,809, filed on Apr. 5, 2010.

(51) Int. Cl.
| | | |
|---|---|---|
| *C07K 14/21* | (2006.01) | |
| *A61K 47/42* | (2006.01) | |
| *C07K 14/245* | (2006.01) | |
| *A61K 47/48* | (2006.01) | |
| *B82Y 5/00* | (2011.01) | |
| *C07K 14/195* | (2006.01) | |
| *A61K 38/00* | (2006.01) | |

(52) U.S. Cl.
CPC ............... *C07K 14/245* (2013.01); *A61K 38/00* (2013.01); *A61K 47/48338* (2013.01); *B82Y 5/00* (2013.01); *C07K 14/195* (2013.01); *A61K 47/42* (2013.01); *C07K 14/21* (2013.01)

(58) Field of Classification Search
CPC ............... C07K 14/21; C07K 2319/35; C07K 2319/00; C07K 2319/035; A61K 38/00; A61K 47/42; G01N 33/5432; G01N 33/574
See application file for complete search history.

(56) References Cited

U.S. PATENT DOCUMENTS

| | | | |
|---|---|---|---|
| 5,939,096 | A | 8/1999 | Clerc et al. |
| 2004/0180094 | A1 | 9/2004 | Joyce |
| 2005/0272677 | A1 | 12/2005 | Friesen et al. |
| 2006/0210549 | A1 | 9/2006 | Srivastava et al. |
| 2007/0140972 | A1* | 6/2007 | Zhu et al. ............... 424/9.34 |
| 2009/0016988 | A1 | 1/2009 | Buckley |

FOREIGN PATENT DOCUMENTS

| | | |
|---|---|---|
| WO | WO 2005/069750 | 8/2005 |
| WO | WO 2011/125015 | 10/2011 |

OTHER PUBLICATIONS

Biswas et al. Structural insight into OprD substrate specificity. Nat Struct Mol Biol. Nov. 2007;14(11):1108-9.*
Black et al. Primary sequence of the *Escherichia coli* fadL gene encoding an outer membrane protein required for long-chain fatty acid transport. J. Bacteriol. 1991, 173(2):435.*
Kwon et al. Highly efficient protein expression and purification using bacterial hemoglobin fusion vector. Plasmid 53 (2005) 274-282.*
Zeng et al. Matrix Metalloproteinase-7 Expression in Colorectal Cancer Liver Metastases: Evidence for Involvement of MMP-7 Activation in Human Cancer Metastases. Clin Cancer Res 2002;8:144-148.*
Israelachvili et al. Molecular layering of water at surfaces and origin of repulsive hydration forces. Nature 1983. 306, 249-250.*
Biswas et al. Structural insight into OprD substrate specificity. Nat Struct Mol Biol. Nov. 2007;14(11):1108-9 and supplementary data.*
Ochs et al. Negative Regulation of the *Pseudomonas aeruginosa* Outer Membrane Porin OprD Selective for Imipenem and Basic Amino Acids. Antimicrob Agents Chemother. May 1999;43(5):1085-90.*
Vargo-Gogola et al. "Identification of Novel Matrix Metalloproteinase-7 (Matrilysin) Cleavage Sites in Murine and Human Fas Ligand", Archives of Biochemistry and Biophysics, 408: 155-161, 2002.
Communication Relating to the Results of the Partial International Search Dated Aug. 22, 2011 From the International Searching Authority Re: Application No. PCT/IB2011/051433.
International Preliminary Report on Patentability Dated Oct. 18, 2012 From the International Bureau of WIPO Re. Application No. PCT/ID2011/051433.
International Search Report and the Written Opinion Dated Dec. 19, 2011 From the International Searching Authority Re: Application No. PCT/IB2011/051433.
Banerjee et al. "Release of Liposomal Contents by Cell-Secreted Matrix Metalloproteinase-9", Bioconjugate Chemistry, 20: 1332-1339, 2009.
Bayley "Pore-Forming Proteins With Built-In Triggers and Switches", Bioorganic Chemistry, XP002655296, 23(4): 340-354, 1995.
Bayley "Pore-Forming Proteins With Built-in Triggers and Switches", Bioorganic Chemistry, XP002655296, 23(4): 340-354, Dec. 1995. p. 348, Para 1.

(Continued)

*Primary Examiner* — Karlheinz R Skowronek
*Assistant Examiner* — Jia-Hai Lee

(57) ABSTRACT

An isolated pore-forming polypeptide is disclosed which comprises a naturally-occurring plugging module and a naturally-occurring pore domain, wherein at least one amino acid of the pore-forming polypeptide is mutated to generate a protease cleavage site, serving to at least partially remove the plugging module from the pore domain. The pore forming polypeptides may be inserted into an encapsulating particle and positioned such that it is capable of forming a pore through the lipid layer of the particle in a presence of the protease.

14 Claims, 11 Drawing Sheets
(8 of 11 Drawing Sheet(s) Filed in Color)

(56) References Cited

OTHER PUBLICATIONS

Elegbede et al. "Mechanistic Studies of the Triggered Release of Liposomal Contents by Matrix Metalloproteinase-9", Journal of the American Chemical Society, JACS, 130: 10633-10642, 2008.
Huang et al. "Membrane Topology and Site-Specific Mutagenesis of *Pseudomonas aeruginosa* Porin OprD", Molecular Microbiology, XP002655294, 16(5): 931-941, Jun. 1995.
Koebnik et al. "Insertion Derivatives Containing Segments of Up to 16 Amino Acids Identify Surface- and Periplasm-Exposed Regions of the FhuA Outer Membrane Receptor of *Escherichia coli* K-12", Journal of Bacteriology, XP002655295, 175(3): 826-839, Feb. 1993.
Lahlil et al. "The Potential Anti-Tumorigenic and Anti-Metastatic Side of the Proprotein Convertases Inhibitors", Recent Patents in Anti-Cancer Drug Discovery, XP055012601, 4(1): 83-91, Jan. 1, 2009. Abstract, p. 83, 1-h Col., Para 1.
Meers "Enzyme-Activated Targeting of Liposomes", Advanced Drug Delivery Reviews, 53: 265-272, 2001.
Panchal et al. "Tumor Protease-Activated, Pore-Forming Toxins From a Combinatorial Library", Nature Biotechnology, 14: 852-856, Jul. 1996.
Russo et al. "Reversible Permeabilization of Plasma Membranes With an Engineered Switchable Pore", Nature Biotechnology, 15: 278-282, Mar. 1997.
Soreide et al. "Trypsin in Colorectal Cancer: Molecular Biological Mechanisms of Proliferation, Invasion, and Metastasis", Journal of Pathology, XP055012602, 209(2): 147-156, Jun. 1, 2006. Abstract.
Turk et al. "Determination of Protease Cleavage Site Motifs Using Mixture-Based Oriented Peptide Libraries", Nature Biotechnology, 19: 661-667, Jul. 2001.
Yoshihara et al. "Calcium Ion-Mediated Opening of the Channel Gate in the *Pseudomonas aeruginosa* Porin", Biochemical and Biophysical Research Communications, XP002655297, 194(3): 1460-1465, Aug. 16, 1993.
Yoshihara et al. "Separation of Gate- and Channel-Forming Domains in the Pore-Forming Protein of the Outer Membrane of *Pseudomonas aeruginosa*", FEBS Letters, XP002655298, 306(1): 5-8, Jul. 13, 1992. Figs. 1b, 2a.

\* cited by examiner

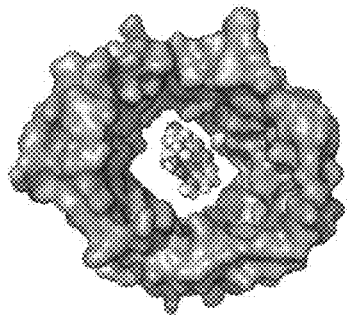

```
OprD_Model    FVSDQAEAKGFIEDSSLDLLLRNYYFNRDGKSGSGDRVDWTQGFITTYESGFTQGTVGFG  60
OprD_Cut      FVSDQAEAKGFIEDSSLDLLLRNYYFNRDGKSGSGDRVDWTQGFITTYESGFTQGTVGFG  60
              ************************************************************

OprD_Model    VDAFGYLGLKLDGTSDKTGTGNLPVMNDGKPRDDYSRAGGAVKVRISKTMLKWGEMQPTA  120
OprD_Cut      VDAFGYLGLKLDGTSDKTGTGNLPVMNDGKPRDDYSRAGGAVKVRISKTMLKWGEM----  117
              ******************************************************

OprD_Model    PVFAAGGSRLFPQTATGFQLQSSEFEGLDLEAGHFTEGKEPTTVKSRGELYATYAGETAK  180
OprD_Cut      ----TATGFQLQSSEFEGLDLEAGHFTEGKEPTTVKSRG---------------------  151
                  ***********************************

OprD_Model    SADFIGGRYAITDNLSASLYGAELEDIYRQYYLNSNYTIPLASDQSLGFDFNIYRTNDEG  240
OprD_Cut      SADFIGGRYAITDNLSASLYGAELEDIYRQYYLNSNYTIPLASDQSLGFDFNIYRTNDEG  211
              ************************************************************

OprD_Model    KAKAGDISNTTWSLAAAYTLDAHTFTLAYQKVHGDQPFDYIGFGRNGSGAGGDSIFLANS  300
OprD_Cut      KAKAGDISNTTWSLAAAYTLDAHTFTLAYQKVHGDQP-----------------------  248
              ************************************

OprD_Model    VQYSDFNGPGEKSWQARYDLNLASYGVPGLTFMVRYINGKDIDGTKMSDNNVGYKNYGYG  360
OprD_Cut      ----FNGPGEKSWQARYDLNLASYGVPGLTFMVRYINGKDIDGTK---------------  289
                  ****************************************

OprD_Model    EDGKHHETNLEAKYVQSGPAKDLSFRIRQAWHRANADQGEGDQNEFRLIVDYPLSIL  418
OprD_Cut      EDGKHHETNLEAKYVQSGPAKDLSFRIRQAWHRANADQGEGDQNEFRLIVDYPLSIL  347
              ********************************************************
```

PROTEASE-ACTIVATABLE PORE-FORMING POLYPEPTIDES

RELATED APPLICATIONS

This application is a National Phase of PCT Patent Application No. PCT/IB2011/051433 having International filing date of Apr. 4, 2011, which claims the benefit of priority under 35 USC §119(e) of U.S. Provisional Patent Application No. 61/282,809 filed on Apr. 5, 2010. The contents of the above applications are all incorporated by reference as if fully set forth herein in their entirety.

FIELD AND BACKGROUND OF THE INVENTION

The present invention, in some embodiments thereof, relates to pore-forming polypeptides that are naturally plugged and are engineered to open by the action of proteases. The plugged pore-forming polypeptides may be incorporated at the surface of encapsulating particles such that they generate pores in the particles only upon exposure to specific proteases. Opening of the pores releases the content of the encapsulating particle.

Cancer is currently the second leading cause of death in the United States. 85% of cancer patients have solid tumors and 50% of those patients die as a result of malignant disease. Local control of the tumor is particularly difficult in the cervix, colon, ovarian, pancreas, and brain. There is hence an urgent and currently unmet need to improve eradication of primary solid tumors and solid metastases.

Most chemotherapeutic drugs act on both normal as well as cancerous tissues. As such, one of the challenges in treating cancerous tumors with chemotherapy is maximizing the killing of cancer cells while minimizing the harming of healthy tissue. Depending on the administration route (e.g., intravenous) and nature of the drug (e.g., its physical and pharmacokinetic properties), oftentimes only a small fraction of the dose reaches the target cells; the remaining amount of drug acts on other tissues or is rapidly eliminated.

Standard chemotherapeutic drugs (e.g., Doxorubicin, Camptothecin, Paclitaxel, and Palatinate) are usually injected systemically to the patient and act by preventing the proliferation of the cancer cells. These drugs must be administered at low doses since they are very aggressive and have many harsh side effects. Doxorubicin, for example, has limited specificity, killing all fast replicating cells, by: intercalating into the DNA to prevent its unwinding by Topoisomerase II and inhibiting macromolecule synthesis. As such, many healthy cells including white blood cells, gastrointestinal cells, and hair follicles are also susceptible to the effects of the drug, leading to pathophysiological conditions such as neutropenia, stomatitis, and alopecia. Some new drug treatments utilize chemoprotective agents to help prevent side effects by protecting healthy cells against the drug's toxicity. Other treatments reduce side effects by improving the chemistry of the drug, while some improve the drug-delivery to the cancer cells.

To improve delivery efficiency and reduce toxicity to non-target cells, various strategies have been used to deliver drugs to specific sites in the human body. Tumor cells are often characterized by a specific expression pattern of membrane associated proteins such as receptors, membrane transport systems or adhesion molecules. Provided that these structures are accessible from the extracellular milieu, such properties can be exploited for an active targeting of diseased cells and tissues using specific effector molecules. The concept of active targeting has the potential to combine the advantage of an increased therapeutic efficacy with a reduced risk for adverse side-effects in non-diseased tissues. With the arrival of genetic engineering technologies, which made it possible to design chimeric mouse-human monoclonal antibodies or recombinant peptidic receptor ligands, the clinical use of these active tumor targeting strategies has become reality.

Various carriers have been explored including liposomal vectors, micelles, carbon nanotubes, polymeric nanoparticles, polymer conjugates, hyalronan-shelled bodies, and lipidic cubic phases for increasing the delivery of a chemotherapeutic drug to a target site.

The use of liposomes is particularly advantageous since its pharmacokinetic properties can be modulated by specific modifications of the liposome surface. Besides direct chemical modifications of the phospholipid headgroups (such as the introduction of surface charges or hydrophilic groups, conjugation of proteins, peptides or other macromolecules to the liposome surface can be achieved. Chemical conjugation techniques provide thereby a stable link between the liposomal phospholipids and a specific targeting vector. The availability of pegylated liposomes made the development of vector-conjugated liposomes possible since the unique properties of these long-circulating liposomes can be combined with those of a targeting vector of choice within one preparation.

Triggered release of drugs and labeled molecules from liposomes has been recognized to be an attractive therapeutic approach. In this approach of drug delivery, the drug delivery vehicles do not release contents until the vehicle's membranes are destabilized by the external agents (trigger). The trigger can be a change in mechanical stress, metal ions, or enzymes such as elastase, alkaline phosphatase, trypsin and phospholipase $A_2$. Conformational changes of peptides, induced by the change in pH, have also been used to facilitate the content release from liposomes.

U.S. Patent Application 20060210549 teaches triple helix trigger peptides which destabilize a liposome preparation on contact with a protease enzyme. These helical peptides do not create pores per se and further are devoid of plugging modules.

U.S. Patent Application 20090016988 teaches protease activated pore forming toxins as pharmaceutical agents for the treatment of cancer. The toxins are multisubunit proteins and do not comprise a naturally occurring plugging module.

U.S. Patent Application 20040180094 teaches protease-activated pore forming toxins as triggers for the release of agents inside an encapsulating vehicle. The toxins are multi-subunit proteins and do not comprise a naturally occurring plugging module.

Richard Lipkin [Science News, Cell Membrane Research Sep. 24, 1994] summarizes the review of Hagan Bayley [Bioorganic Chem 23, 340-354 (1995)] who teaches selective release of a drug from an encapsulating vehicle using a trigger which comprises a protease-activated multisubunit pore-forming toxin (alpha hemolysin). Bayley does not teach the use of pore-forming proteins which are not toxins and comprise naturally occurring plugging modules.

SUMMARY OF THE INVENTION

According to an aspect of some embodiments of the present invention there is provided an isolated pore-forming polypeptide comprising a naturally-occurring plugging module and a naturally-occurring pore domain, wherein at least one amino acid of the pore-forming polypeptide is mutated to generate a protease cleavage site, serving to at least partially remove the plugging module from the pore domain.

According to an aspect of some embodiments of the present invention there is provided an isolated polynucleotide encoding the isolated pore-forming polypeptide of the present invention.

According to an aspect of some embodiments of the present invention there is provided a nucleic acid construct comprising the polynucleotide of the present invention.

According to an aspect of some embodiments of the present invention there is provided a cell comprising the nucleic acid construct of the present invention.

According to an aspect of some embodiments of the present invention there is provided a composition of matter, comprising an encapsulating particle and the isolated polypeptide of the present invention, wherein the encapsulating particle comprises at least one lipid layer, and a compartment surrounded by the lipid layer, and further wherein the isolated polypeptide is positioned such that it is capable of forming a pore through the lipid layer in a presence of the protease.

According to an aspect of some embodiments of the present invention there is provided a pharmaceutical composition comprising the composition of matter of the present invention.

According to an aspect of some embodiments of the present invention there is provided a method of treating a disease associated with an up-regulation of a protease in a subject in need thereof, the method comprising administering to the subject a therapeutically effective amount of the composition of matter of the present invention to the subject, thereby treating the disease associated with the up-regulation of the protease.

According to some embodiments of the invention, the pore domain comprises a β barrel structure.

According to some embodiments of the invention, the isolated pore-forming polypeptide is a monomer.

According to some embodiments of the invention, the isolated pore-forming polypeptide comprises a Ton-B dependent receptor.

According to some embodiments of the invention, the Ton-B dependent receptor is selected from the group consisting of BtuB CirA, FatA, FcuT, FecA, FhuA FhuE, FepA, FptA, HemR, IrgA, IutA, PfeA, PupA and Tbp1.

According to some embodiments of the invention, the isolated pore-forming polypeptide comprises an amino acid sequence selected from the group consisting of SEQ ID NOs: 24-22778, 22780, 22782, 22784, 22786, 22788, 22790, 22792, 22794, 22796, 22798, 22800, 22802, 22804, 22806, 22808, 22810, 22812, 22814, 22816, 22820, 22822, 22824, 22826, 22828, 22830, 22832, 22834, 22836, 22838, 22840, 22842, 22844, 22846, 22848, 22850, 22852, 22854, 22858, 22860, 22862, 22864, 22866, 22868, 22870, 22872, 22874, 22876, 22878, 22880, 22882, 22884, 22886, 22888, 22892, 22894, 22898, 22900, 22902, 22904, 22906, 22908, 22910, 22912, 22914, 22916, 22918, 22920, 22922, 22924, 22926, 22928, 22930, 22932, 22934, 22936, 22938, 22940, 22942, 22944, 22946, 22948, 22950, 22952, 22954, 22956, 22958, 22960, 22962, 22986, 22964-22981.

According to some embodiments of the invention, the isolated pore-forming polypeptide is OprD.

According to some embodiments of the invention, when the pore-forming polypeptide is OprD the at least one mutated amino acid is positioned on Loop 3 (SEQ ID NO: 22990).

According to some embodiments of the invention, when the pore-forming polypeptide is OprD the at least one mutated amino acid is positioned in Loop 7 (SEQ ID NO: 22994).

According to some embodiments of the invention, when the pore-forming polypeptide is OprD the at least one mutated amino acid is positioned in Loop 3 and Loop 7 (SEQ ID NOs: 22990 and 22994).

According to some embodiments of the invention, when the pore-forming polypeptide is OprD the at least one mutated amino acid is positioned in Loop 8 (SEQ ID NO: 22995).

According to some embodiments of the invention, the protease cleavage site is cleaved by a protease associated with disease onset, or progression.

According to some embodiments of the invention, the protease cleavage site is cleaved by a protease associated with cancer onset, progression or metastasis.

According to some embodiments of the invention, the protease is selected from the group consisting of MMP-2, MMP-7, MMP-9 and MMP-14.

According to some embodiments of the invention, the protease is MMP-9.

According to some embodiments of the invention, the protease is MMP-2.

According to some embodiments of the invention, the protease is MMP-14.

According to some embodiments of the invention, the at least one mutated amino acid is situated on at least one loop of the pore-forming polypeptide.

According to some embodiments of the invention, the at least one mutated amino acid is situated on the plugging module of the pore-forming polypeptide.

According to some embodiments of the invention, a pore of the polypeptide is about 1.4-10 nm in diameter when fully unplugged.

According to some embodiments of the invention, a plugging of the pore with the plugging module of the pore-forming polypeptide prevents a passage of water.

According to some embodiments of the invention, the protease cleavage site is cleaved by a protease associated with cancer onset, progression and metastasis.

According to some embodiments of the invention, the protease is a member of a family selected from the group consisting of a matrix metalloproteinase (MMP) family, an elastase family, a plasminogen activator family and a fibroblast activation protein family.

According to some embodiments of the invention, the protease is a member of a matrix metalloproteinase (MMP) family.

According to some embodiments of the invention, the protease is selected from the group consisting of MMP-2, MMP-7, MMP-9 and MMP-14.

According to some embodiments of the invention, the protease is MMP-7.

According to some embodiments of the invention, the pore-forming polypeptide is FhuA or OprD.

According to some embodiments of the invention, the isolated pore-forming polypeptide comprises an amino acid sequence as set forth in SEQ ID NOs: 5 and 7.

According to some embodiments of the invention, the isolated pore-forming polypeptide further comprises an amino acid sequence which encodes an affinity tag.

According to some embodiments of the invention, the affinity tag is attached to an extracellular loop of the polypeptide.

According to some embodiments of the invention, the nucleic acid construct further comprises a cis-regulatory element.

According to some embodiments of the invention, the cis-regulatory element is a promoter.

According to some embodiments of the invention, the composition of matter further comprises a therapeutic agent in the compartment surrounded by the lipid layer.

According to some embodiments of the invention, the therapeutic agent is capable of passing through the pore in a presence of the protease.

According to some embodiments of the invention, the therapeutic agent is a small molecule having a molecular mass of less than 1000 Da.

According to some embodiments of the invention, the therapeutic agent is a polypeptide or a polynucleotide agent.

According to some embodiments of the invention, the composition of matter further comprises a diagnostic agent in the compartment surrounded by the lipid layer.

According to some embodiments of the invention, the lipid layer further comprises a targeting moiety.

According to some embodiments of the invention, the targeting moiety is selected from the group consisting of an antibody, an antibody fragment, a receptor ligand and an aptamer.

According to some embodiments of the invention, a size of the pore is configured to allow a passage of water into the encapsulating particle.

According to some embodiments of the invention, a size of the pore is configured to allow a passage of the therapeutic agent out of the encapsulating particle.

According to some embodiments of the invention, the encapsulating particle is a nanoparticle.

According to some embodiments of the invention, the encapsulating particle is a liposome.

According to some embodiments of the invention, the therapeutic agent is a chemotherapeutic agent.

According to some embodiments of the invention, the lipid layer comprises a hydrophilic polymer.

According to some embodiments of the invention, the hydrophilic polymer comprises at least one component selected from the group consisting of polyethylene glycol (PEG), polyelectrolyte poly(allylamine hydrochloride), polyacrylic acid, naturally-occurring glycosaminoglycans and naturally-occurring repeating disaccharides β1,3N-acetylglucosaminyl-β1,4 glucuronide, or naturally occurring hyaluronic acid.

According to some embodiments of the invention, the lipid layer comprises cholesterol.

According to some embodiments of the invention, the lipid layer comprises phospholipids.

According to some embodiments of the invention, the phospholipids are selected from the group consisting of glycerophospholipids, phosphatidylserine, phosphatidylethanolamine, phosphatidylcholine, phosphatidyl inositol and phosphatidyl glycerol.

According to some embodiments of the invention, the disease associated with an up-regulation of a protease is cancer.

According to some embodiments of the invention, the cancer is a solid tumor.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings and images. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1A:
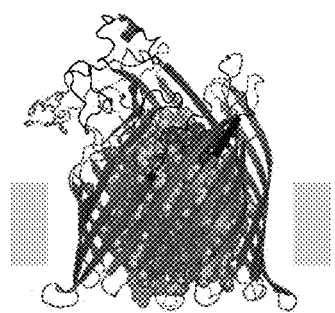
Figure 1F:
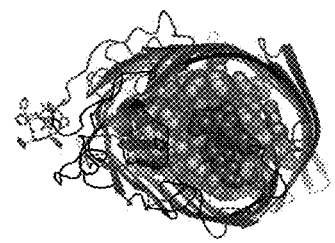
Figure 1B:
Figure 1G:
Figure 1C:
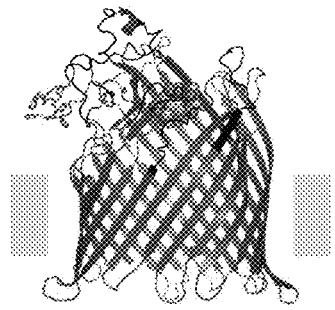
Figure 1H:
Figure 1D:
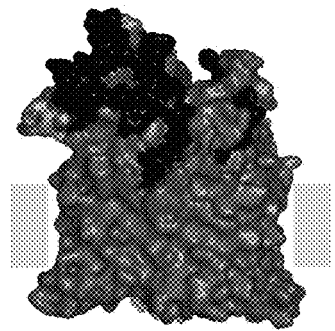
Figure 1I:
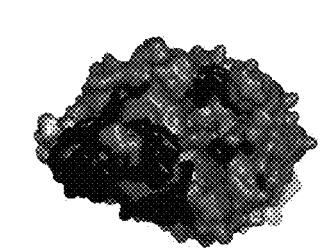
Figure 1E:
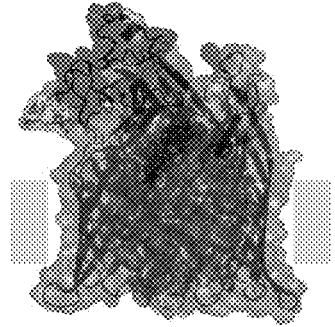
Figure 1J:
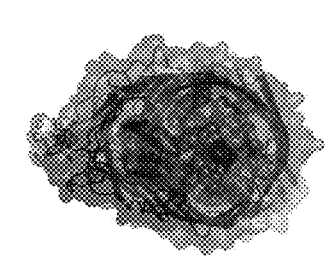

FIGS. 1A-J are cartoon representations of the (β-barrel FhuA$_{7/10}$-1 mutated protein. β strands are indicated as wide flat arrows; helices are indicated as wide flat coils; loop structures are thin spaghetti-like coils. The FhuA residues (161 to 725) are colored blue. Part of these residues form the transmembrane walls of the pore. MMP-7 cleavage sites are colored black in the barrel and dark gray in the orange colored cork. CPK colored sticks represent the hexa-histidine tag, where carbon and nitrogen atoms are shown in grey and blue colors, respectively. FIGS. 1A-E are side views where the FhuA$_{7/10}$-1 is situated perpendicular to the lipid membrane that is represented by gray rectangles. FIGS. 1F-J are top views looking down into the cytoplasm of the expressing mammalian cells (or the periplasmic space in gram-negative bacteria). FIGS. 1A and F, the cork domain (residues 19 to 160) is represented as spheres and is colored gold. FIGS. 1B and G: Space filling model of Doxorubicin inside the barrel of FhuA$_{7/10}$-1. The cork was removed to show the size of Doxorubicin relatively to the pore. FIGS. 1C and H: Space filling model of Ferrichrome from the crystal structure without the cork. FIGS. 1D and I: Connolly Surface shows the FhuA$_{7/10}$-1 where water or lipids contact it in all possible positions. FIGS. 1E and J: a transparent Connolly Surface of the β-barrel overlaid on FIGS. 1A and F. In all panels, atoms colored in grey, blue or red correspond to carbon, nitrogen and oxygen respectively. Note, Hydrogen atoms are not shown.

Figures 2A, 2B, 2C:
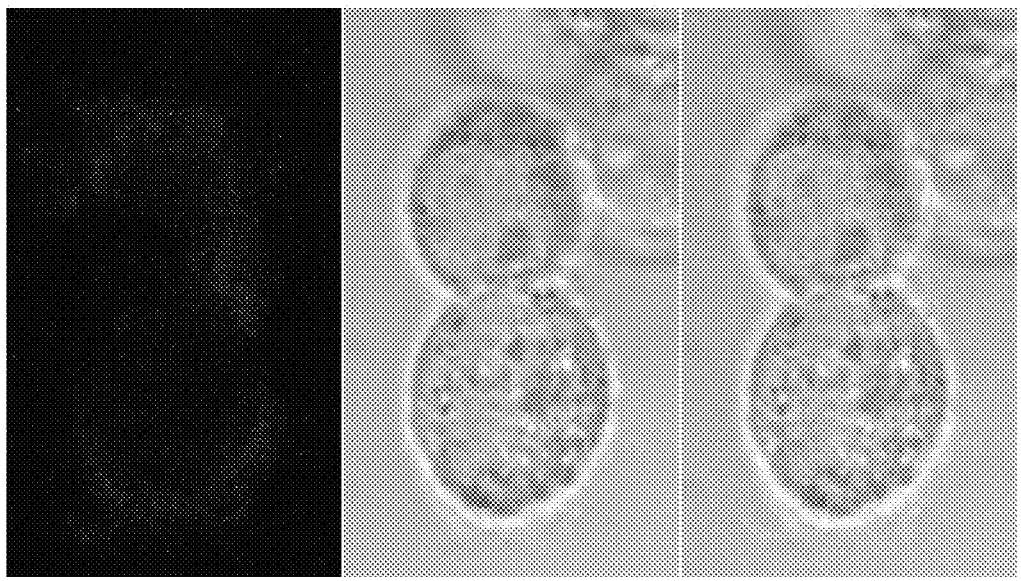
Figures 2D, 2E, 2F:
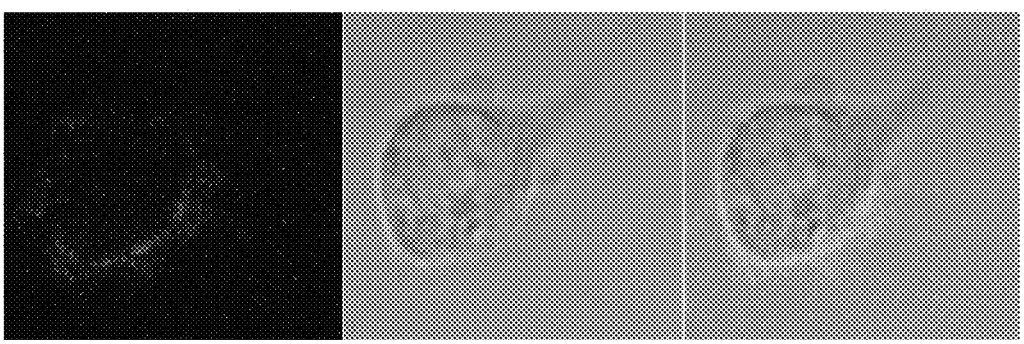

FIGS. 2A-F are Fluorescent confocal images of live human embryonic kidney (HEK293T) cells transiently transfected with plasmid DNA encoding the engineered FhuA$_{7/10}$-1. The rhodaminylated secondary antibody, which binds to the anti-His tag antibody can be seen in red. FIGS. 2A and 2D: Fluorescence; FIGS. 2B and 2E: Light bright field; FIGS. 2C and 2E: Merge of respective 2A and 2B and FIGS. 2D and 2E.

Figure 3:
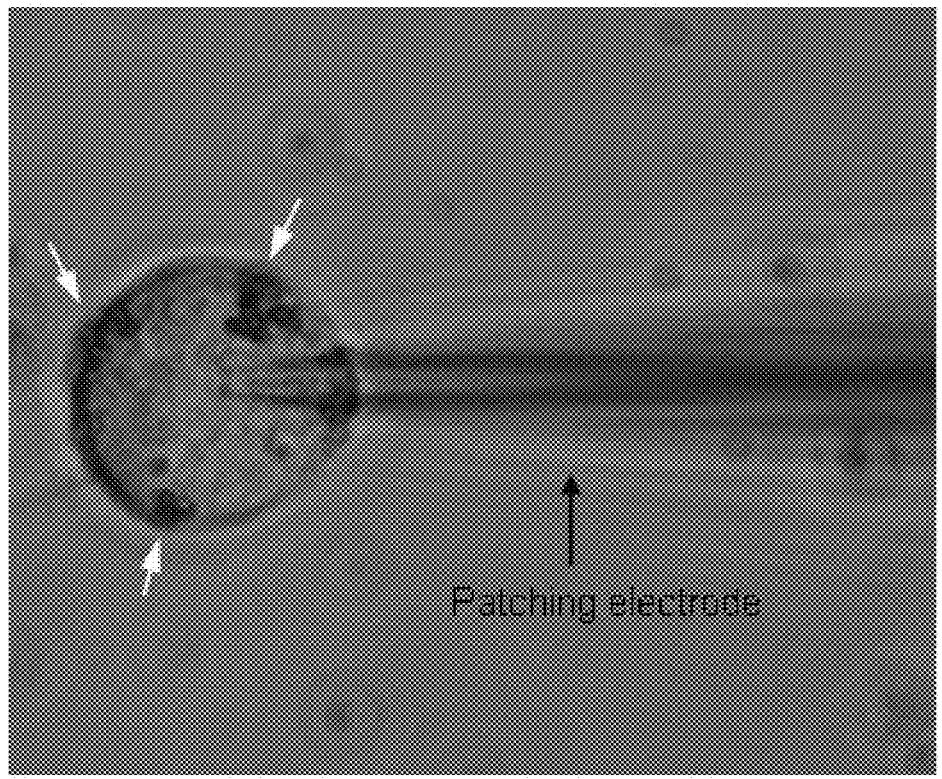

FIG. 3 is an image of a live HEK293T cell transiently transfected with DNA encoding the engineered FhuA$_{7/10}$-1. White arrows point to superparamagnetic polystyrene beads, which are coated with cobalt ions and therefore strongly bind the His tag. The His tag is inserted inside one of the extracellular loops of the engineered pore-forming polypeptide. The diameter of the beads is 1 μm and they have a dark red color. The patching electrode (~6 MΩ resistance) descends towards the cell and only its tip touches the cell membrane. Note that 48 hours after transfection the cells tend to lose their natural morphology and become round.

Figure 4:
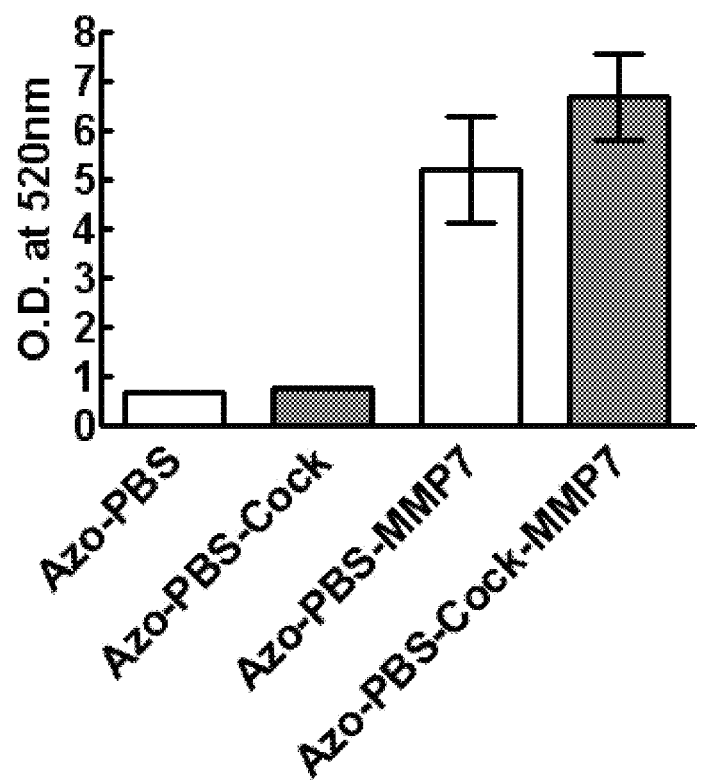

FIG. 4 is a bar graph illustrating that protease-inhibitor cocktail does not affect MMP-7 proteolytic activity. Azocoll, a general proteolytic substrate made from collagen with an embedded azo dye, yields a red color and absorbs at 520 nm upon its cleavage. Experiments were carried out in duplicates. Note that diluted amounts of sample were used for spectroscopic analysis so as not to oversaturate the spectrophotometer. Error bars represent the standard deviations of two independent experiments.

Figure 5A:
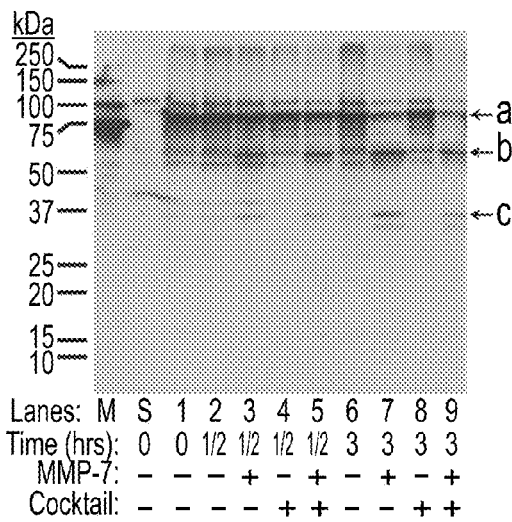
Figure 5B:
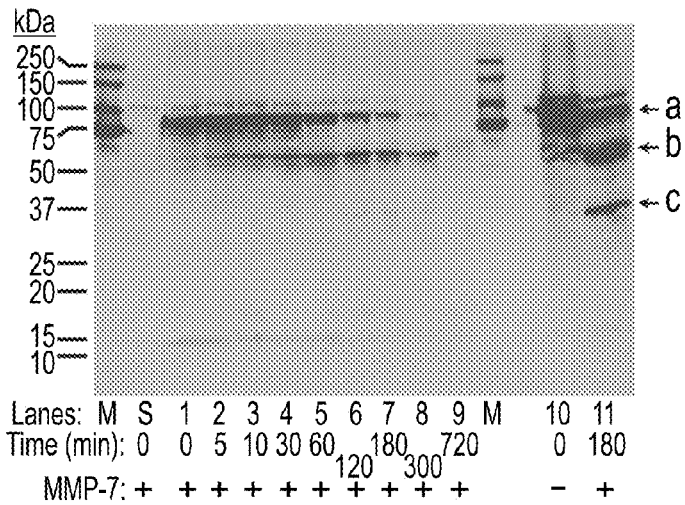
Figure 5C:
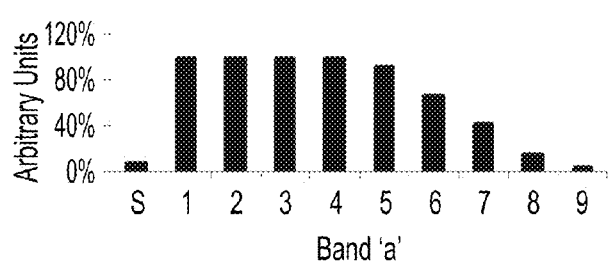
Figure 5D:
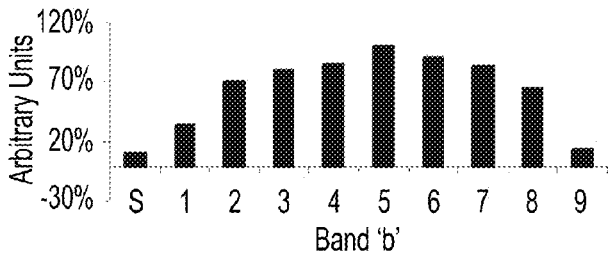
Figure 5E:
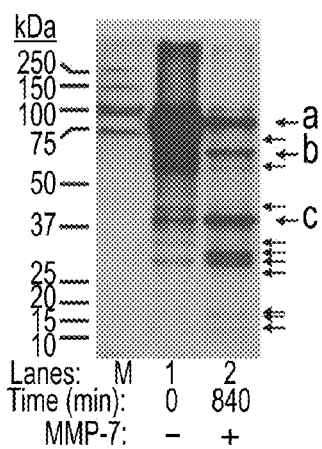

FIGS. 5A-E are graphs and images illustrating the cleavage of the engineered pore-forming polypeptide by MMP-7. FIG. 5A is a Western blot of membranes containing the pore-forming polypeptide (40 μg) incubated at 37° C. without or with MMP-7 (0.2 U/μl) for the indicated time. Cocktail is a protease inhibitor mixture that was tested for its ability to inhibit proteolysis inherent to membrane preparations without inhibiting MMP-7. FIG. 5B is a Western blot illustrating a Kinetics study of MMP-7 (0.2 U/μl) acting on the membranes (40 μg) that contain the engineered pore-forming polypeptide for periods of 0 to 720 min. Lanes 10 and 11 is an independent transfection where the engineered pore-forming polypeptide was overexpressed in an attempt to visualize additional cleavage products. FIGS. 5C-D are bar graphs illustrating the densitometry of FIG. 5B where arrows point to bands 'a' and 'b' respectively. FIG. 5E is an image of a PVDF blot that detects many cleavage products, 'a', 'b', and 'c' are those found on nitrocellulose blots (FIGS. 5A and 5B) while unlabeled arrows point to newly detected bands in lane 2.

M, molecular weight markers of which four markers bind anti-His antibodies. S, sham control of membranes (40 μg) prepared from CD8-transfected cells. On the right side of each gel, the letters a, b, and c point to the full-length engineered pore-forming polypeptide (~81 kDa) and its cleavage products ~57 kDa & ~37 kDa, respectively.

Figure 6:
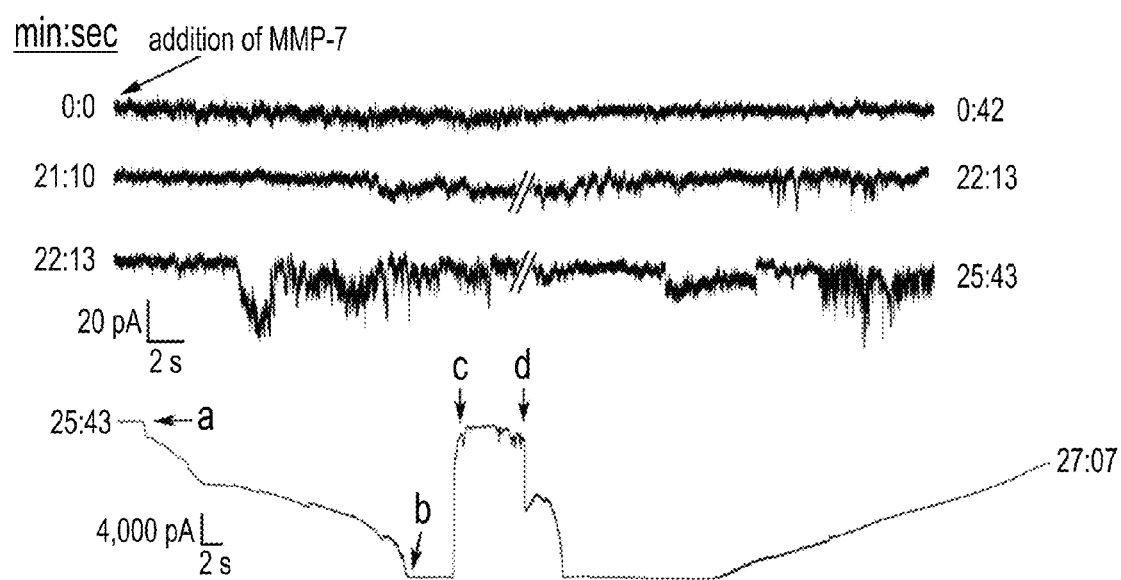

FIG. 6 are readouts of recordings illustrating ion permeation through the prototypic engineered pore-forming polypeptide. A cell identified to express the FhuA$_{7/10}$-1 pore-forming polypeptide (FIG. 3) was patched and human MMP-7 (0.4 U/μl) was then added to the recording bath (as indicated), at room temperature. In the first three recording lines, there are two sweeps per line; each sweep lasts 21 seconds. The first two sweeps are lined up consecutively, while the second and third sweeps are separated to indicate elapsed time. The fourth recording line corresponds to four consecutive sweeps. Recordings were performed at –60 mV.

Figure 7A:
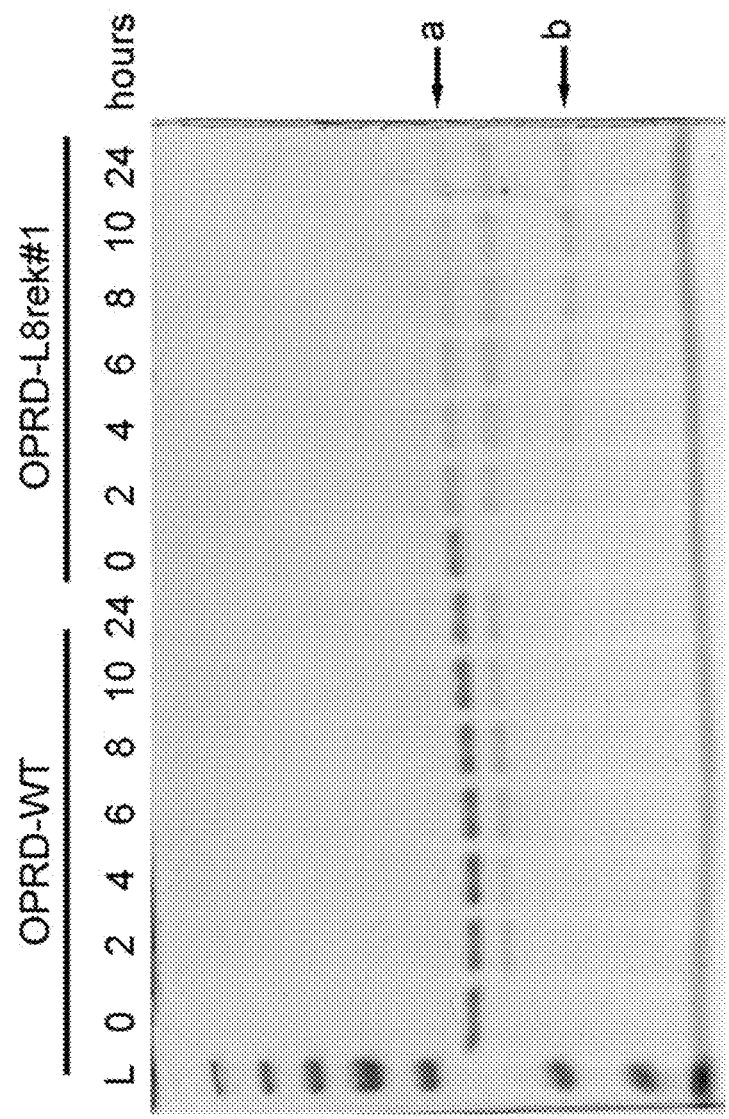
Figure 7B:
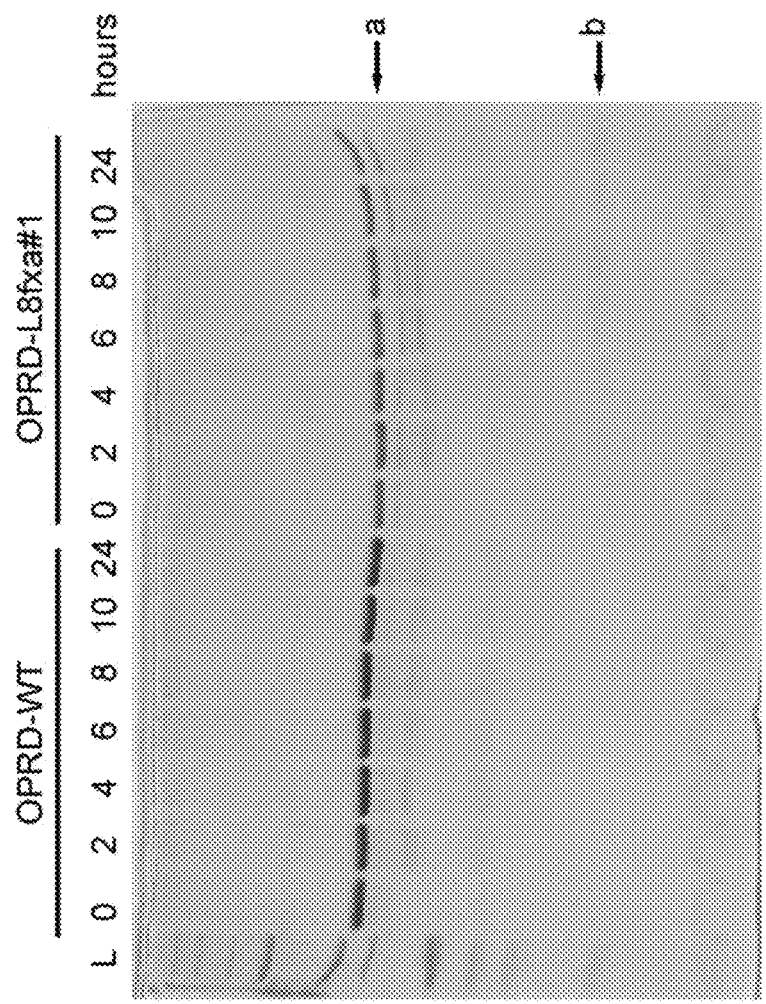
Figure 7C:
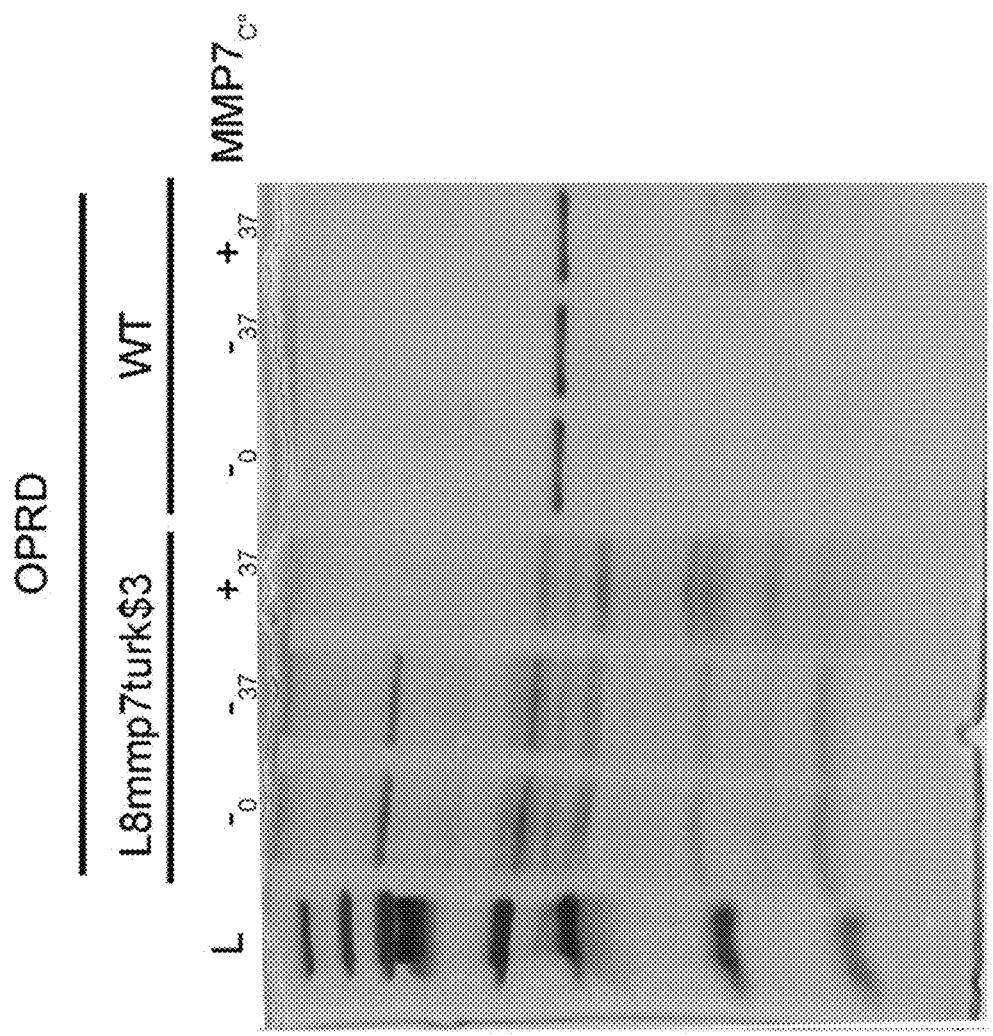

FIGS. 7A-C are images showing proteolysis of wild-type and mutant OprD incubated with the indicated proteolytic enzymes. FIG. 7A—Incubation of enterokinase with the wild type OprD yields a non specific band, that does not increase over time. However, incubating enterokinase with the mutant L8rek#1 (SEQ ID NO: 22798) shows specific cleavage since band "a" disappears and band "b" becomes more apparent over time. FIG. 7B—Incubation of Factor X enzyme with the wild type OPRD yields a few non specific bands. However, incubation of factor X with mutant L8fxa#1 (SEQ ID NO: 22788) shows specific cleavage, since bands "a" and "b" become more apparent with time. FIG. 7C—Incubation of MMP7 with wild type OprD yields a few non specific bands, compared with the control sample held at the same temperature for 24 hours but with out the MMP7. However, incubating mmp7 with the mutant L8mmp7turk#3 (SEQ ID NO: 22836) shows cleavage as the main protein band disappears.

Figure 8C:
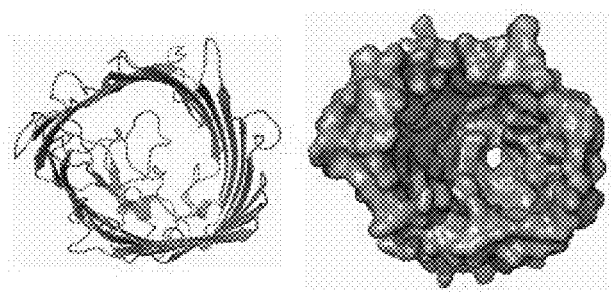
Figure 8B:
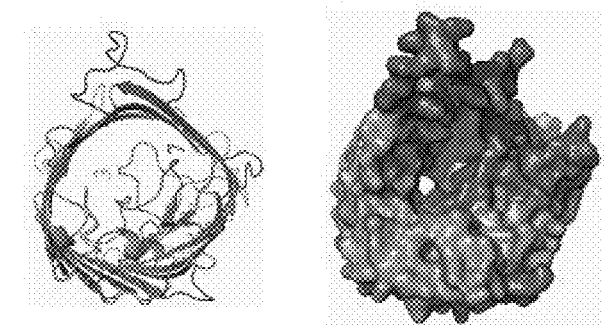
Figure 8A:
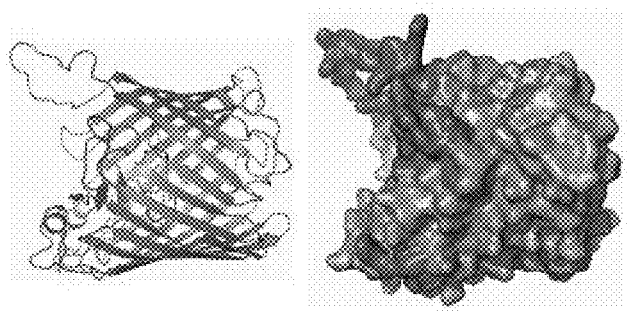

FIGS. 8A-C is a structural model for the full-length OprD. Upper panels: ribbon diagrams showing the β-barrel core in green, loops and helices which structure was solved by X-ray crystallography in salmon color, and loops which structure was determined by homology modeling in blue. Lower panels: solvent accessible surface of the structures shown in the upper panel with the same color code. FIG. 8A—Side view. FIG. 8B—Top view into the periplasmic space. Loops L3 and L7 are indicated in the upper panel. FIG. 8C—Bottom view, from the periplasmic space.

FIGS. 9A-B show that removal of a few loops opens up the pore of OprD. FIG. 9A shows the surface of OprD which pore-located loops have been removed. A Doxorubicin molecule (spheres) is centered in the middle of OprD. The loops that have been removed are L3, L7, L8 and L4. FIG. 9B is an alignment showing WT OprD and an OprD with amino acid sequences that were cut out (gaps, SEQ ID NO: 22984 and 22985) in silico.

DESCRIPTION OF SPECIFIC EMBODIMENTS OF THE INVENTION

The present invention, in some embodiments thereof, relates to pore-forming polypeptides that are naturally plugged and that are engineered to open by the action of proteases. The engineered pore-forming polypeptides may be incorporated at the surface of encapsulating particles such that they generate permeable pores (e.g. drug-permeable pores) in the particles only upon exposure to specific proteases. Opening of the pores releases the content of the encapsulating particle.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The delivery of therapeutic agents to solid tumors is a significant problem because of transport barriers that limit the delivery of drugs to the tumor site. A second problem in cancer therapy is that chemo- and radio-therapeutic agents are typically toxic to healthy cells as well as tumor cells, which leads to undesirable side effects during anticancer therapy. In an attempt to overcome these problems in cancer therapy, different types of drug delivery systems have been developed that employ macromolecules, vesicles, or particles as carriers for therapeutics. In general, these systems seek to maximize localization of the drug to the tumor while minimizing systemic toxicity. Although some of these approaches have shown promise in preclinical studies, there is significant room for improvement in the design of drug targeting systems for cancer therapy.

The present inventors have conceived of a novel drug delivery system that relies on a protease-sensitive pore-forming polypeptide for drug release from an encapsulating particle. The protease-sensitive pore-forming polypeptide comprises a modified pore protein that has been engineered such that the pore opens in the presence of a disease-associated protease.

As a prototype, the present inventors have introduced ten MMP-7 cleavage sites into loops and β strands of the pore-protein FhuA. The present inventors showed that the mutated FhuA beta barrel is expressed on the cell surface of HEK cells, and therefore it is inferred that the transmembrane topology of the genetically modified protein is similar to that of the wild-type (FIGS. 2A-F and FIG. 3). In addition, the present inventors showed that human MMP-7 was capable of cleaving the engineered FhuA in a membrane preparation where the engineered pore-forming polypeptide is integrated and folded in its natural environment, within the lipid bilayer (FIGS. 5A-B). Voltage-clamp experiments showed that prior to MMP-7 administration, the engineered FhuA remains tightly sealed, and does not allow the passage of ionic current (FIG. 6). OprD was used as a second prototype in which Loop 8 was shown accessible to enzymatic cleavage by a number of highly specific proteases (Faxtor X and enterokinase) as well as by the cancer associated human MMP-7 (FIGS. 7A-C). The proteins were successfully expressed in E. coli, substantiating their use as a drug delivery system.

The present inventors propose similar drug delivery systems for any disease which is associated with expression of a protease.

Thus, according to one aspect of the present invention there is provided an isolated pore-forming polypeptide comprising a naturally-occurring plugging module and a naturally-occurring pore domain, wherein at least one amino acid of the pore-forming polypeptide is mutated to generate a protease cleavage site. The protease cleavage site serves to at least partially remove the plugging module from the pore domain.

The phrase "pore-forming polypeptide" refers to a transmembrane polypeptide that naturally comprises i) a pore (i.e. channel) and ii) a plug (also referred to herein as a cork) which is capable of closing the pore. Accordingly, the pore-forming polypeptide of the present invention is of a size and shape which allows it to traverse the majority of a width of a membrane bilayer. According to one embodiment, the pore-forming polypeptide is capable of forming a pore spanning the entire length of a membrane bilayer.

According to one embodiment, the pore-forming polypeptide is a mutated (engineered) prokaryotic polypeptide.

The pore-forming domain of the polypeptide refers to the transmembrane domain of the polypeptide. According to one embodiment, the transmembrane domain comprises a β barrel structure. A detailed description of the β-barrel structure is disclosed in WO97/35022, incorporated herein by reference. According to another embodiment, the pore domain comprises an alpha helical structure.

Preferably, the pore-forming polypeptide forms a pore as a single unit or monomer.

The pore of the pore-forming polypeptide, at its minimum, must be wide enough to at least allow the passage of water when the plug is fully removed. According to one embodiment, the pore of the pore-forming polypeptide is at least 0.4 nm and more preferably at least about 1 nm when fully opened to allow water (~0.3 nm) to traverse the channel (even through cavities lined by hydrophobic amino acid side chains). According to another embodiment, the pore of the pore-forming polypeptide is between about 0.4 nm-10 nm and more preferably between about 1.4 nm-10 nm when fully open.

As mentioned, the pore-forming polypeptides of this aspect of the present invention also comprise a naturally occurring plugging module. The plugging module is such that it does not allow the flow of drugs or water via the pore, in both its naturally occurring state and modified state—i.e. it renders the pore non-leaky. The plug can be composed of, a single plugging domain (as in for example FhuA), or made up of several loops that are part of the protein (as in for example OprD). These loops can form a cap or plug on top of, or in the pore. The plugging module can be composed of a beta sheet, an alpha helix, or a loop structure (random coil) or any of these combinations.

Exemplary polypeptides which may be used to generate the pore-forming polypeptides of the present invention are those that belong to the family of Ton-B dependent receptors.

Examples of Ton-B dependent receptor polypeptides include, but are not limited to BtuB CirA, FatA, FcuT, FecA, FhuA FhuE, FepA, FptA, HemR, IrgA, IutA, PfeA, PupA and Tbp1.

Other exemplary polypeptides which may be used to generate the pore-forming polypeptides of the present invention are those that belong to the family of OprD outer membrane proteins.

Examples of OprD polypeptides include, but are not limited to OprE (GenBank Ref No: D12711); OpdT (GenBank Ref No: AF033849); and OprD (GenBank Ref No: X63152).

According to a specific embodiment the pore-forming polypeptide is OprD. A structural model of OprD is provided in FIGS. 8A-C. The present inventors have found that OprD is easily solubilized and therefore may be advantageously used along with the teachings of the present invention. The plugging domain is composed of a crown of loops at the top of the molecule which is readily accessible to enzymes for shearing. The crystal structure of OprD is available from http://wwwdotpdbdotorg/pdb/explore/explore.do?structureId=2ODJ, which is herein incorporated by reference in its entirety. Elecrophysiological studies have shown that the channel is non leaky and plugged in the wild type form. OprD was previously introduced into liposomes (Yoshihara J. Biol chem., 1989 v264: 6297-301, the teachings of which being incorporated by reference in their entirety).

Table 1A, below, lists the loop domains of OprD.

As used herein a "loop" is defined by a three dimensional structure not being a beta-strand, and an additional 3 amino acids upstream or downstream thereto.

According to a specific embodiment the mutation in the at least one amino acid is in a tier2 loop which is a corking loop. A tier2 loop is L3, L7 or a combination of same.

Mutations in Tier1 loops are also contemplated. According to a specific embodiment the mutation is in L5, preferably L6, more preferably L9, even more preferably L4 and most preferably L8.

According to a specific embodiment the mutation is in a combination of a Tier2 loop and a Tier1 loop.

According to a further specific embodiment, the mutation is located in L3, L7. L4 and L8 in accordance with the model provided in FIGS. 9A-B.

The present teachings also envisage mutations in the bottom loops, which face the periplasmic space, see FIG. 89A. Such mutations may govern the orientation in the encapsulating particle. Such mutations are provided in SEQ ID NOs: 22804, 22842, 22882 and 22954.

TABLE 1A

| | |
|---|---|
| L1 | nrdGKSGSGDRVdwt/22988 |
| L2 | kldGTSDKTGTGNLPVMNDGKPRDDysr/22989 |
| L3 | lkwGEMQPTAPVFAAGGSRLFPQTATgfq/22990 |
| L4 | ghfTEGKEPTTVKSRGELYATYAGETAKSadf/22991 |
| L5 | aelEDIyrq/22992 |
| L6 | rtnDEGKAKAGDIsnt/22993 |
| L7 | kvhGDQPFDYIGFGRNGSGAGGDSIFLANSVQYSDFNGPgek/22994 |
| L8 | ngkDIDGTKMSDNNVGYKNYGYGEDGKhhe/22995 |
| L9 | hraNADQGEGDqne/22996 |
| BL1 | FVSDQAEAKGFIEDSsld/22997 |
| BL2 | tyeSGFTQGTVgfg/22998 |
| BL3 | vriSKtml/22999 |

TABLE 1A-continued

| | |
|---|---|
| BL4 | lqsSEFEGldl/23000 |
| BL5 | yaiTDNlsa/23001 |
| BL6 | iplASDqsl/23002 |
| BL7 | ytlDAhtf/23003 |
| BL8 | dlnLASYGVPGLltf/23004 |
| BL9 | kyvVQSGPAKDLsfr/22982 |

Abbreviations - top crowning loops (L) bottom loops (BL). The lower case letters are part of the beta-strands directly before and after the loops, but for the context of this invention, they are to be considered part of the loop structures. The sequences can be aligned to Wild Type OprD P32722 (PORD_PSEAE).

TABLE 1B

| Structural | | Example of Mutant | | | |
|---|---|---|---|---|---|
| location | Loop | MMP7 | MMP2 | MMP9 | reK |
| Crowning | L1 | L1mmp7turk | L1mmp2turk | L1mmp-9 | L1rek |
| Tier 1 | L8 | L8mmp7turk#1 | L8mmp2turk#2 | L8-mmp9#1 | L8rek#1 |
| Crowning | L3 | L3mmp7turk#1 | L3mmp2turk#2 | L3-mmp9#3 | L3rek$3 |
| Tier 2 | L7 | L7mmp7turk#1b | L7mmp2turk#1 | L7-mmp9#2b | L7rek#1b |
| Bottom | BL | BL7mmp7turk | BL7mmp2turk | BL7-mmp9 | BL7rek |

Specific examples of OprD sequences which can be used in accordance with the teachings of the present invention are set forth in SEQ ID NOs: 22778, 22780, 22782, 22784, 22786, 22788, 22790, 22792, 22794, 22796, 22798, 22800, 22802, 22804, 22806, 22808, 22810, 22812, 22814, 22816, 22820, 22822, 22824, 22826, 22828, 22830, 22832, 22834, 22836, 22838, 22840, 22842, 22844, 22846, 22848, 22850, 22852, 22854, 22858, 22860, 22862, 22864, 22866, 22868, 22870, 22872, 22874, 22876, 22878, 22880, 22882, 22884, 22886, 22888, 22892, 22894, 22898, 22900, 22902, 22904, 22906, 22908, 22910, 22912, 22914, 22916, 22918, 22920, 22922, 22924, 22926, 22928, 22930, 22932, 22934, 22936, 22938, 22940, 22942, 22944, 22946, 22948, 22950, 22952, 22954, 22956, 22958, 22960, 22962 and 22986).

Of note, the above sequences are provided as mere examples; however it will be appreciated by the skilled artisan that there is flexibility in the position of the mutation (e.g., 2, 3, 4 or 5 amino acids N-terminally or C-terminally of the proposed location, indicated by arrows above) and the nature of the mutated sequence. Expression and activity assays for qualifying the mutated sequences are provided hereinbelow and in the Examples section which follows.

Other exemplary polypeptides which may be used to generate the pore-forming polypeptides of the present invention are those that belong to the following families of polypeptides, as described in: http://pfamdotsangerdotacdotuk/clan/MBB:

IPR000531 TonB-dependent receptor, beta-barrel;
IPR001702 Porin, Gram-negative type;
IPR005318 Outer membrane porin OprD, bacterial;
InterPro IPR018013 Nucleoside-specific channel-forming protein, Tsx-like;
IPR000036 Peptidase A26, omptin;
IPR000498 Outer membrane protein, OmpA-like, transmembrane region;
IPR000758 Virulence-related outer membrane protein;
IPR002718 Outer membrane protein, *Helicobacter*;
IPR003055 Nucleoside-specific channel-forming protein, Tsx;
IPR003394 Porin, opacity type;
IPR003684 Porin, alpha proteobacteria type;
IPR005017 Membrane protein involved in aromatic hydrocarbon degradation;
IPR005546 Autotransporter beta-domain;
IPR005618 Outer membrane protein, OmpW;
IPR007049 Carbohydrate-selective porin OprB;
IPR008722 OmpF;
IPR009331 Oligogalacturonate-specific porin;
IPR009746 Antimicrobial peptide resistance and lipid A acylation PagP;
IPR010870 Phosphate-selective porin OP;
IPR011250 Outer Membrane Protein Beta-Barrel;
Outer membrane protein G (OmpG); and
PagL (PF09411)

According to one embodiment, the pore-forming polypeptide of the present invention comprises a sequence as set forth in SEQ ID NOs: 24-22778, 22780, 22782, 22784, 22786, 22788, 22790, 22792, 22794, 22796, 22798, 22800, 22802, 22804, 22806, 22808, 22810, 22812, 22814, 22816, 22820, 22822, 22824, 22826, 22828, 22830, 22832, 22834, 22836, 22838, 22840, 22842, 22844, 22846, 22848, 22850, 22852, 22854, 22858, 22860, 22862, 22864, 22866, 22868, 22870, 22872, 22874, 22876, 22878, 22880, 22882, 22884, 22886, 22888, 22892, 22894, 22898, 22900, 22902, 22904, 22906, 22908, 22910, 22912, 22914, 22916, 22918, 22920, 22922, 22924, 22926, 22928, 22930, 22932, 22934, 22936, 22938, 22940, 22942, 22944, 22946, 22948, 22950, 22952, 22954, 22956, 22958, 22960, 22962, 22986, 22964-22981.

Other exemplary pore-forming polypeptides which comprise a naturally occurring plug may be selected from the PFAM database, which comprises a library of outer membrane beta-barrel protein superfamily (http://pfamdotsangerdotacdotuk/clan?id=MBB and www.ebi.ac.uk/interpro/). Other databases which may be used for selecting the polypeptide include the BOMB database (http://servicesdotcbudotuibdotno/tools/bomp); the University of Leeds TMBC-fa database; and the K-12-tmbeta-genome db http://tmbetagenomedotcbrcdotjp/annotation/.

The term "polypeptide" as used herein encompasses native polypeptides (either degradation products, synthetically synthesized polypeptides or recombinant polypeptides) and peptidomimetics (typically, synthetically synthesized polypeptides), as well as peptoids and semipeptoids which are polypeptide analogs, which may have, for example, modifications rendering the polypeptides more stable while in a body or more capable of penetrating into cells. Such modifications include, but are not limited to N terminus modification, C terminus modification, polypeptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified, for example, in Quantitative Drug Design, C.A. Ramsden Gd., Chapter 17.2, F. Choplin Pergamon Press (1992), which is incorporated by reference as if fully set forth herein. Further details in this respect are provided hereinunder.

Polypeptide bonds (—CO—NH—) within the polypeptide may be substituted, for example, by N-methylated bonds (—N(CH3)-CO—), ester bonds (—C(R)H—C—O—O—C(R)—N—), ketomethylen bonds (—CO—CH2-), α-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—CO—), polypeptide derivatives (—N(R)—CH2-CO—), wherein R is the "normal" side chain, naturally presented on the carbon atom.

These modifications can occur at any of the bonds along the polypeptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the polypeptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids, as well as glycosylated amino acids.

Tables 2 and 3 below list naturally occurring amino acids (Table 2) and non-conventional or modified amino acids (Table 3) which can be used with the present invention.

TABLE 2

| Amino Acid | Three-Letter Abbreviation | One-letter Symbol |
|---|---|---|
| alanine | Ala | A |
| Arginine | Arg | R |
| Asparagine | Asn | N |
| Aspartic acid | Asp | D |
| Cysteine | Cys | C |
| Glutamine | Gln | Q |
| Glutamic Acid | Glu | E |
| glycine | Gly | G |
| Histidine | His | H |
| isoleucine | Iie | I |
| leucine | Leu | L |
| Lysine | Lys | K |
| Methionine | Met | M |
| phenylalanine | Phe | F |
| Proline | Pro | P |
| Serine | Ser | S |
| Threonine | Thr | T |
| tryptophan | Trp | W |
| tyrosine | Tyr | Y |
| Valine | Val | V |
| Any amino acid as above | Xaa | X |

TABLE 3

| Non-conventional amino acid | Code | Non-conventional amino acid | Code |
|---|---|---|---|
| α-aminobutyric acid | Abu | L-N-methylalanine | Nmala |
| α-amino-α-methylbutyrate | Mgabu | L-N-methylarginine | Nmarg |
| aminocyclopropane-carboxylate | Cpro | L-N-methylasparagine | Nmasn |
|  |  | L-N-methylaspartic acid | Nmasp |
| aminoisobutyric acid | Aib | L-N-methylcysteine | Nmcys |
| aminonorbornyl-carboxylate | Norb | L-N-methylglutamine | Nmgln |
|  |  | L-N-methylglutamic acid | Nmglu |
| cyclohexylalanine | Chexa | L-N-methylhistidine | Nmhis |
| cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α ethylcyclohexylalanine | Mchexa |
| D-α-methylarginine | Dmarg | α-methylcyclopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |

TABLE 3-continued

| Non-conventional amino acid | Code | Non-conventional amino acid | Code |
|---|---|---|---|
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cyclododeclglycine | Ncdod |
| D-α-methylalnine | Dnmala | N-cyclooctylglycine | Ncoct |
| D-α-methylarginine | Dnmarg | N-cyclopropylglycine | Ncpro |
| D-α-methylasparagine | Dnmasn | N-cycloundecylglycine | Ncund |
| D-α-methylasparatate | Dnmasp | N-(2,2-diphenylethyl)glycine | Nbhm |
| D-α-methylcysteine | Dnmcys | N-(3,3-diphenylpropyl)glycine | Nbhe |
| D-N-methylleucine | Dnmleu | N-(3-indolylyethyl) glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nva |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-αthylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl)glycine | Nser |
| D-N-methylisoleucine | Dnmile | N-(imidazolylethyl)glycine | Nhis |
| D-N-methylleucine | Dnmleu | N-(3-indolylyethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-αethylhistidine | Mhis | L-α-methylhomophenylalanine | Mhphe |
| L-αthylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | mser | L-α-methylthreonine | Mthr |
| L-αethylvaline | Mtrp | L-α-methyltyrosine | Mtyr |
| L-α-methylleucine | Mval Nnbhm | L-N-methylhomophenylalanine | Nmhphe |
| N-(N-(2,2-diphenylethyl)carbamylmethyl-glycine | Nnbhm | N-(N-(3,3-diphenylpropyl)carbamylmethyl(1)glycine | Nnbhe |
| 1-carboxy-1-(2,2-diphenylethylamino)cyclopropane | Nmbc | | |

As mentioned, the polypeptides of this aspect of the present invention are genetically modified to incorporate a protease cleavage site.

As used herein, the phrase "modified polypeptide" refers to a polypeptide comprising an amino acid modification (i.e. mutation) as compared to the wild-type polypeptide. Any modification to the sequence is envisaged according to this aspect of the present invention so long as the pore of the polypeptide remains tightly sealed in the absence of pathological concentrations of the disease-associated protease and is capable of opening in the presence of pathologically-elevated concentrations of the disease-associated protease.

According to one embodiment, the protease of the protease cleavage site is associated with a disease.

In one embodiment of the invention, the protease is one that is associated with cancer invasion and metastasis in general. In another embodiment, the protease is one which is up-regulated and/or secreted by cancer cells. In still another embodiment, the protease is activated by receptors expressed by cancer cells.

Examples of such proteases include the matrix metalloproteinase (MMP) family, the elastase, and the plasminogen activator family tPA uPA, fibroblast activation protein, cathepsins, kallikreins, plasmin and thrombin.

Based on structural features (including the amino acid sequences, domain organizations), 26 different types of MMPs have been recognized in human tissues, which fall into five major classes: (i) collagenases, (ii) gelatinases, (iii) stromelysins and stromelysin like MMPs, (iv) matrilysins, (v) membrane type MMPs, and (vi) other MMPs (viz., MMP-20, MMP-23, and MMP-28) (M. Whittaker et al., Chem. Rev., 1999, 99, 2735-2776; G. Murphy et al., Methods Enzymol., 1995, 248, 470-484; R. Kiyama et al., J. Med. Chem., 1999, 42, 1723-1738). Although many of these MMPs have been implicated in different types of human diseases, gelatinase-A (MMP-2) and gelatinase-B (MMP-9) have been widely recognized to be involved in the progression and metastasis in most of the human tumors. Gelatinase-A and -B have been found to be overexpressed in breast tumors, (M. Polette et al., Virchows Arch Int. J. Pathol., 1994, 424, 641-645; K. Dalberg et al., World J. Surg., 2000, 24, 334-340; R. Hanemaaijer et al., Int J Cancer, 2000, 86, 204-207) colorectal tumors, (S. Papadopoulou et al., Tumour Biol., 2001, 22, 383-9; J P Segain et al., J. Cancer Res., 1996, 56, 5506-12) lung tumors, (M. Tokuraku et al., Int J. Cancer., 1995, 64, 355-359; H. Nagawa et al., S. Jap. J. Cancer Res., 1994, 85, 934-938) prostate tumors (G. Sehgal et al., Am. J. Pathol., 1998, 152, 591-596), pancreatic tumors (T. Koshiba et al., Surg Today., 1997, 27, 302-304; T M Gress et al., Int J. Cancer., 1995, 62, 407-413), and ovarian tumors (T N Young et al., Gynecol Oncol., 1996, 62, 89-99). In fact, the initial discovery of the involvement of MMPs in melanoma cancer and metastasis were ascribed to be due to the overexpression of gelatinase-A and -B (V. Kahari et al., Exp. Dermatol., 1997, 6, 199-213; U. Saarialho-K, Arch. Dermatol., 1998, 294, S47-S54; H. Nagase et al., J. Biol. Chem., 1999, 274, 21491-21494; E. Kerkela et al., Exp. Dermatol., 2003, 12, 109-125; A. R. Nelson et al., J. Clin. Oncol., 2000, 18, 1135-1149; L. A. Liotta et al., Nature, 1980, 284, 67-68). Additionally, MMP-14 (MT1-MMP) has been suggested to be overexpressed in every form of cancer, if not the cause of many malignant transformations (Golubkov et al. 2005 Membrane type-1 matrix metalloproteinase (MT1-MMP) exhibits an important intracellular cleavage function and causes chromosome instability, Biol Chem 280:25079-25086.

Examples of proteases of the plasminogen activator family include uPA (urokinase-type plasminogen activator) and tPA (tissue-type plasminogen activator).

It will be appreciated that the present invention contemplates protease cleavage site which are associated with diseases other than cancer. For example, gelatinase-A and -B have been found to be involved in gouty arthritis (M S Hsieh et al., J Cell Biochem., 2003, 89, 791-799), inflammatory bowel disease (ulcerative colitis) (E. Pirila et al., Dig Dis Sci., 2003, 48, 93-98), abdominal aortic aneurysms (R. Pyo et al., J Clin Invest., 2000, 105, 1641-1649), quiescent Crohn's Disease (A E Kossakowska et al., Ann N Y Acad. Sci., 1999, 878, 578-580), glaucoma (C. Kee et al., J. Glaucoma., 1999 8, 51-55), and sunlight induced premature skin aging (G J Fisher et al., Curr Opin Rheumatol., 2002, 14, 723-726).

In addition, gelatinase-B has been found to play a role in arthritis or in neurodegenerative diseases such as multiple sclerosis (Firestein, Curr. Opin. Rheumatol. 4:348-354 (1992); Gijbels et al., J. Neuroimmunol. 41:29-34 (1992)). For example, high levels of gelatinase-B have been detected in serum and synovial fluid of patients with inflammatory arthritis such as rheumatoid arthritis compared to healthy patients or patients with osteoarthritis (Ahrens et al., Arthritis & Rheumatism 39:1576-87 (1996); Gruber et al., Clin. Immunol. & Immunopathol., 78:161-171 (1996)). In addition, a correlation has been reported between the arthritic activity score of a joint and the amount of gelatinase-B in the aspirated synovial fluid (Koolwijk et al. J. Reumatology, 22:385-393 (1995)).

Expression of gelatinase-B is also detected in diseases of the nervous system. For example, prominent expression of gelatinase-B has been found in reactive astrocytes and macrophages in demyelinating lesions compared to normal brain tissue (Cuzner et al., J. Neuropathol. Exp. Neurol, 55:1194-1204 (1996)). MMP-9 is elevated in encephelomyelitis (Gijbels, et al. J. Neuro. Res. 36:432-440 (1993); Proost, et al., Biochem, Biophys, Res. Comm. 192:1175-1181 (1993)), in the cerebrospinal fluid of patients with multiple sclerosis (Leppert, et al., Brain 121:2327-2334 (1998); Rosenberg et al., Brain Res., 703:151-155 (1995)), and in patients with AIDS-related dementia (Conant, et al., Annals of Neurology 46: 391-398 (1999)). Furthermore, in patients with amyotrophic lateral sclerosis, gelatinase-B expression is found in the pyramidal neurons of the motor cortex and in the motor neurons of the spinal cord (Lim et al., J. Neurochem., 67:251-259 (1996)).

Gelatinase-B has also been associated with a variety of other inflammatory diseases. For example, a high level of MMP-9 activity is found in the vessel wall of aortic aneurysms (Freestone, et al. Arteriosclerosis, Thrombosis & Vascular Biology, 15:1145-1151 (1995); Newman et al., Connective Tissue Research, 30:265-276, (1994); Sakalihasan et al., J. Vascular Surgery, 24:127-33 (1996)). In addition, patients with giant cell arteritis have increased levels of MMP-9, and MMP-9 mRNA is found in smooth muscle cells and fibroblasts in the regions of fragmented elastic tissue in the lamina media of inflamed vessels (Sorbi, et al., Arthritis & Rheumatism, 35:1747-1753 (1996)). Increased levels of gelatinase-B are also found in sputum of patients with cystic fibrosis and in bronchoalveolar lavage fluids of those with bronchiectasis (Delacourt et al., Amer. J. Respiratory & Critical Care Med., 152:765-764 (1995); Sepper et al, Chest, 106:1129-1133 (1994)). High levels of gelatinase-B have also been found in blister fluids from the skin lesions of bullous pemphigoid patients (Stahle-Backdahl et al., J. Clinical Invest., 93:2022-2030 (1994)).

Gelatinase-B expression has also been implicated in the pathogenesis of several other diseases. For example, gelatinase-B has been implicated in polycystic kidney disease (Murray et al., Conn. Tissue Res., 33:249-256 (1996)), membranous nephropathy (McMillin et al., J. Clin. Invest., 97:1094-1101 (1996)), and Alzheimer's disease (Lim et al., J. Neurochem., 68:1606-1611 (1997)).

Non-limiting examples of selected cleavage sites recognized by some of these proteases are shown in Table 4 and further in the Examples section which follows.

Cleavage sites recognized by other proteases listed above are known in the art.

TABLE 4

| Protease | Forward cleavage sequence (*/* indictes site of cleavage) | SEQ ID NO: |
|---|---|---|
| Caspase 1 | YVAI/X | 17 |
| tPA | FGR/X | 18 |
| MMP14 | GGPLG/LYAGG | 19 |
| HK2 | GKAFRR/X | 20 |
| Thrombin | LVPR/GS | 21 |
| uPA | SGR/SAQ | 22 |

The cleavage site motif for a protease involves residues both N- and C-terminal to the scissile bond (the unprimed and primed sides, respectively, with the cleavage site for a protease defined as . . . P3-P2-P1-P1'-P2'-P3' . . . , and cleavage occurs between the P1 and P1' residues In general for creating an MMP cleavage sites the following criteria should be observed:

1. MMPs generally require hydrophobic amino acids at P1'☐ and prefer either hydrophobic or basic amino acids at P2'.

2. Whereas MMP-1, MMP-2, and MMP-9 prefer small residues (alanine, glycine, or serine) at P3', MMP-3, MMP-7, and MT1-MMP select for methionine at that position.

3. Although all MMP enzymes select aliphatic residues most strongly at P1', MMP-2, MMP-3, MMP-9, and MT1-MMP also had reasonable selections for phenylalanine and tyrosine at that position.

4. The major specificity site N-terminal to the scissile bond for all MMPs tested was at P3, where proline is preferred most strongly, although for most of the enzymes valine and isoleucine appear to be reasonable substitutions 5. The main selectivities for MMP-7 on the unprimed side in addition to proline at P3 are for hydrophobic residues (leucine, methionine, and tyrosine) at P2, and for serine, alanine, or glutamic acid at P1.

Table 5 herein below teaches preferred amino acids to generate MMP cleavage sites.

TABLE 5

| Common | | Cleavage Position | | | | | | | |
|---|---|---|---|---|---|---|---|---|---|
| Enzyme | Name | P5 | P4 | P3 | P2 | P1 | P1' | P2' | P3' |
| MMP-7 | Matrilysin | P | V | P | L | S | L | V | M |
|  |  | I | I | V | M | E | I | T | Y |
|  |  |  | R | I | Y | N | M | I | Q |
|  |  |  |  |  | A |  | M |  |  |
|  |  |  |  |  |  |  | K |  |  |
|  |  |  |  |  |  |  | R |  |  |
| MMP-1 | Collagenase-1 | V | V | P | M | S | M | M | A |
|  |  | I |  |  | Y | N | I | I | G |
|  |  |  |  |  | L | A | L | K | S |
|  |  |  |  |  | E |  | R |  |  |
| MMP-2 | Gelatinase A | D | I | P | V | S | L | R | S |
|  |  | L | V | V | A | G | M | Y | A |
|  |  | F |  | I |  | A | I | K | G |
|  |  | N |  |  |  | E | Y | M |  |
|  |  | I |  |  |  |  | F | I |  |
|  |  |  |  |  |  |  |  | V |  |
| MMP-9 | Gelatinase B | V | V | P | L | S | L | R | S |
|  |  |  |  | V | Y |  | M | T | A |
|  |  |  |  |  |  |  | I | Y | G |
|  |  |  |  |  |  |  | Y | V |  |
|  |  |  |  |  |  |  | F | I |  |
| MMP-3 | Stromelysin-1 | N | K | R | F | S | M | M | M |
|  |  | I | V | V | Y | E | I | K | A |
|  |  |  |  | I | L |  | L | I |  |
|  |  |  |  | R | M |  | Y | R |  |
|  |  |  |  |  | A |  | F |  |  |
| MT1-MMP | MMP-14 | F | I | P | X | S | L | R | M |
|  |  | L | K | V |  | A | I | K | A |
|  |  | D | V |  |  |  | M | Y |  |
|  |  | I | D |  |  |  | Y |  |  |
|  |  | V |  |  |  |  | F |  |  |

Further information for selecting cleavage sites for MMP enzymes may be found in Turk et al., Nature biotechnology, Volume 19, July 2001, incorporated herein by reference.

Additional MMPs and their recognition sequences are known in the literature, see for example, Netzelarnett S, Fields G, Birkedalhansen H, Vanwart H E. 1991. Sequence specificities of human fibroblast and neutrophil collagenases. J Biol Chem 266:6747-6755; Nagase H, Fields G B. 1996. Human matrix metalloproteinase specificity studies using collagen sequence-based synthetic peptides. Biopolymers 40:399-416; Deng S J, Bickett D M, Mitchell J L, Lambert M H, Blackburn R K, Carter H L, Neugebauer J, Pahel G, Weiner M P, Moss M L 2000. Substrate specificity of human collagenase 3 assessed using a phage-displayed peptide library. J Biol Chem 275:31422-31427; each of which is hereby incorporated by reference in its entirety.

Generally with reference to the polypeptides described herein but also with a specific reference to OprD, cleavage sites (e.g., MMP cleavage sites) are introduced into the plugging domain (crown loops at the top of the protein—tier one, and corking loops deeper within the protein—tier two, also cleavage sites are introduced to the bottom of the protein, see Table 1 above, and further examples above).

Since MMPs are known for their substrate sequence flexibility, modifications are also contemplated.

A specific generic sequence which is cleaved by MMP-7 is provided in SEQ ID NO: 22856 and Protein IVVLSLVM (SEQ ID NO: 23005), DNA ATTGTTGTTTTATCTTTAGT-TATG, SEQ ID NO: 23006 and SEQ ID NO: 22857). See e.g., Vargo-Gogola Biochemistry and Biophysics 408 (2002) 155-161, which is hereby incorporated by reference in its entirety. Likewise:

MMP2:

Protein: DIVVSLRS (SEQ ID NO: 22892)

DNA: GATATTGTTGTTTCTTTACGTTCT (SEQ ID NO: 22893)

```
                             -continued
MMP9
                                          (SEQ ID NO: 22928)
Protein: VVPLSLRS (SEQ ID NO: 22929)
DNA: GTTGTTCCTTTAAGTTTAAGATCT
```

OprD sequences which are implanted with these cleavage sequences are provided in SEQ ID NOs. 22888-22891, 22894-22927, 22930-22963 and 22986-22987.

Examples of modifications (e.g. mutations) contemplated by the present inventors include deletions, insertions and/or substitutions. Substitutions at one particular site on the polypeptide are typically in the range of about 1 to 20 amino acids, and more typically in the range of about 1 to 10 amino acids signifying the proteolysis cleavage site.

It will be appreciated that more than one cleavage site may be generated. According to one embodiment up to ten cleavage sites are generated. According to another embodiment up to fifteen cleavage sites are generated. The number of modifications made is typically restricted to a number that does not hinder the expression and folding of the polypeptide.

It will be further appreciated that the modifications to the polypeptide of the present invention may act to generate a protease cleavage site or alternatively to expose a protease cleavage site that naturally exists. According to one embodiment the polypeptide is modified at site x' to generate the protease cleavage site and further modified at site y' to allow better access of the protease to site x'. Alternatively or additionally, cleavage at site y' may help to weaken the overall 3-D structure of the protein of choice.

As mentioned, the pore-forming polypeptide may be modified such that the plugging module is completely removed from the pore domain thereby allowing passage of any molecule which has dimensions less than or equal to the width of the pore. Alternatively, the pore-forming polypeptide may be modified such that the plugging module is only partially removed from the pore domain, such that water is able to travel through the pore. Accordingly, the number of modifications will also depend on the extent of removal of the plugging module from the pore domain required, whereby complete removal of the plugging module may require more modifications than only partial removal of the plugging module from the pore domain.

The sites of modification are typically selected according to the suggested 3D structure of the pore-forming polypeptide. Thus, for example, modifications at site y' typically occur on outer loops of the polypeptide. Thus for example the modification may be on a loop that faces the extracellular milieu, periplasmic space, cytoplasmic space or spaces surrounded by inner membranes.

Modifications which serve to open the pore of the pore-forming polypeptide are typically made at the plugging-module itself (x').

Preferably, the modified polypeptide of this aspect of the present invention comprises at least one protease cleavage site on an outer loop of the polypeptide. Alternatively, or additionally, the protease cleavage site may be comprised on the loop connecting the pore domain with the plug domain.

According to one embodiment, conservative amino acid substitutions are made such that folding and subsequent expression of the polypeptide is not impaired. The conservative amino acid substitution may be effected at a predicted, non-essential amino acid residue.

A “conservative amino acid substitution” is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

According to one embodiment, the bond networks of the native and substituting amino acids are considered when selecting a particular modification. For example, native amino acid side-chains which face into the protein may interact via H-bonds with other amino acids, therefore, the mutating amino acid should attempt to keep this same interaction. To this end, the volume of the amino acid’s side chain, its charge, and overall chemical structure (aromatic side-chains in particular) should be kept similar. Hydrophobicity of amino acid side chains located at the perimeter of the pore domain also play an important role in determining the pore-forming polypeptide placement in a lipid bi-layer; therefore, polar and non-polar side chains should be kept constant during mutagenesis.

In some instances, protease cleavage sites have a requirement for a particular amino acid. Thus, as described herein above, an MMP-7 cleavage site typically comprises a proline at position P3. Accordingly, for generation of MMP-7 cleavage sites, loops that comprise native prolines may be preferred sites for mutation.

An exemplary amino acid sequence of a Fhu-A polypeptide that has been modified such that its pore domain is capable of opening in the presence of MMP-7 is provided in SEQ ID NOs: 5 or 7.

It will be appreciated that the pore-forming polypeptides of the present invention can also include sequences engineered to optimize stability, production, purification, yield or activity thereof. Such sequences may also aid in cell surface identification. These sequences can further comprise a cleavable moiety. Where a cleavage site is engineered between the polypeptide and the cleavable moiety, the polypeptide can be released from the chromatographic column by treatment with an appropriate enzyme or agent that specifically cleaves the fusion protein at this site [e.g., see Booth et al., Immunol. Lett. 19:65-70 (1988); and Gardella et al., J. Biol. Chem. 265:15854-15859 (1990)].

Typically, the polypeptide is engineered such that the affinity tag is placed on one of its solvent accessible extracellular loops.

Thus, for example the pore-forming polypeptide of the present invention may comprise a histidine affinity tag (or other tags such as FLAG or hemagglutinin).

An exemplary amino acid sequence of a Fhu-A polypeptide that has been modified such that its pore domain is capable of opening in the presence of MMP-7 and further comprises a histidine tag is provided in SEQ ID NO: 5.

The isolated polypeptides of present invention can be biochemically synthesized such as by using standard solid phase techniques. These methods include exclusive solid phase synthesis, partial solid phase synthesis methods, fragment condensation, classical solution synthesis. These methods are preferably used when it cannot be produced by recombinant techniques (i.e., not encoded by a nucleic acid sequence) and therefore involves different chemistry or when short peptides are synthesized.

Solid phase polypeptide synthesis procedures are well known in the art and further described by John Morrow Stewart and Janis Dillaha Young, Solid Phase Polypeptide Syntheses (2nd Ed., Pierce Chemical Company, 1984).

Synthetic polypeptides can be purified by preparative high performance liquid chromatography [Creighton T. (1983) Proteins, structures and molecular principles. WH Freeman and Co. N.Y.] and the composition of which can be confirmed via amino acid sequencing.

Recombinant techniques are preferably used to generate the isolated polypeptides of the present invention since these techniques are better suited for generation of relatively long polypeptides (e.g., longer than 20 amino acids) and large amounts thereof. Such recombinant techniques are described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

To produce the isolated polypeptides of the present invention using recombinant technology, an isolated polynucleotide comprising a nucleic acid sequence encoding such a polypeptide may be used. Exemplary nucleic acid sequences are set forth in SEQ ID NOs: 6 and 8.

The term "nucleic acid sequence" refers to a deoxyribonucleic acid sequence composed of naturally-occurring bases, sugars and covalent internucleoside linkages (e.g., backbone) as well as oligonucleotides having non-naturally-occurring portions which function similarly to respective naturally-occurring portions. Such modifications are enabled by the present invention provided that recombinant expression is still allowed.

A nucleic acid sequence of the pore-forming polypeptides of this aspect of the present invention can be a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

In order to generate the pore-forming polypeptides of the present invention using recombinant techniques, the polynucleotides encoding same are ligated into nucleic acid expression vectors, such that the polynucleotide sequence is under the transcriptional control of a cis-regulatory sequence (e.g., promoter sequence).

A variety of prokaryotic or eukaryotic cells can be used as host-expression systems to express the polypeptides of the present invention. These include, but are not limited to, microorganisms, such as bacteria transformed with a recombinant bacteriophage DNA, plasmid DNA or cosmid DNA expression vector containing the polypeptide coding sequence; yeast transformed with recombinant yeast expression vectors containing the polypeptide coding sequence; plant cell systems infected with recombinant virus expression vectors (e.g., cauliflower mosaic virus, CaMV; tobacco mosaic virus, TMV) or transformed with recombinant plasmid expression vectors, such as Ti plasmid, containing the polypeptide coding sequence.

Constitutive promoters suitable for use with this embodiment of the present invention include sequences which are functional (i.e., capable of directing transcription) under most environmental conditions and most types of cells such as the cytomegalovirus (CMV) and Rous sarcoma virus (RSV).

Inducible promoters suitable for use with this embodiment of the present invention include for example the tetracycline-inducible promoter (Srour, M. A., et al., 2003. Thromb. Haemost. 90: 398-405) or IPTG.

The expression vector according to this embodiment of the present invention may include additional sequences which render this vector suitable for replication and integration in prokaryotes, eukaryotes, or preferably both (e.g., shuttle vectors). Typical cloning vectors contain transcription and translation initiation sequences (e.g., promoters, enhances) and transcription and translation terminators (e.g., polyadenylation signals).

Eukaryotic promoters typically contain two types of recognition sequences, the TATA box and upstream promoter elements. The TATA box, located 25-30 base pairs upstream of the transcription initiation site, is thought to be involved in directing RNA polymerase to begin RNA synthesis. The other upstream promoter elements determine the rate at which transcription is initiated.

Enhancer elements can stimulate transcription up to 1,000 fold from linked homologous or heterologous promoters. Enhancers are active when placed downstream or upstream from the transcription initiation site. Many enhancer elements derived from viruses have a broad host range and are active in a variety of tissues. For example, the SV40 early gene enhancer is suitable for many cell types. Other enhancer/promoter combinations that are suitable for the present invention include those derived from polyoma virus, human or murine cytomegalovirus (CMV), the long term repeat from various retroviruses such as murine leukemia virus, murine or Rous sarcoma virus and HIV. See, Enhancers and Eukaryotic Expression, Cold Spring Harbor Press, Cold Spring Harbor, N.Y. 1983, which is incorporated herein by reference.

Polyadenylation sequences can also be added to the expression vector in order to increase the translation efficiency of a polypeptide expressed from the expression vector of the present invention. Two distinct sequence elements are required for accurate and efficient polyadenylation: GU or U rich sequences located downstream from the polyadenylation site and a highly conserved sequence of six nucleotides, AAUAAA, located 11-30 nucleotides upstream. Termination and polyadenylation signals that are suitable for the present invention include those derived from SV40.

In addition to the elements already described, the expression vector of the present invention may typically contain other specialized elements intended to increase the level of expression of cloned nucleic acids or to facilitate the identification of cells that carry the recombinant DNA. For example, a number of animal viruses contain DNA sequences that promote the extra chromosomal replication of the viral genome in permissive cell types. Plasmids bearing these viral replicons are replicated episomally as long as the appropriate factors are provided by genes either carried on the plasmid or with the genome of the host cell.

The vector may or may not include a eukaryotic replicon. If a eukaryotic replicon is present, then the vector is amplifiable in eukaryotic cells using the appropriate selectable marker. If the vector does not comprise a eukaryotic replicon, no episomal amplification is possible. Instead, the recombinant DNA integrates into the genome of the engineered cell, where the promoter directs expression of the desired nucleic acid.

Expression vectors containing regulatory elements from eukaryotic viruses such as retroviruses can also be used by the present invention. SV40 vectors include pSVT7 and pMT2. Vectors derived from bovine papilloma virus include pBV-1MTHA, and vectors derived from Epstein Bar virus include pHEBO, and p2O5. Other exemplary vectors include pMSG, pAV009/A$^+$, pMTO10/A$^+$, pMAMneo-5, baculovirus pDSVE, and any other vector allowing expression of proteins under the direction of the SV-40 early promoter, SV-40 later promoter, metallothionein promoter, murine mammary tumor virus promoter, Rous sarcoma virus promoter, polyhedrin promoter, or other promoters shown effective for expression in eukaryotic cells.

A variety of prokaryotic or eukaryotic cells can be used as host-expression systems to express the polypeptides of the present invention. These include, but are not limited to, microorganisms, such as bacteria transformed with a recombinant bacteriophage DNA, plasmid DNA or cosmid DNA expression vector containing the coding sequence; yeast transformed with recombinant yeast expression vectors containing the coding sequence; plant cell systems infected with recombinant virus expression vectors (e.g., cauliflower mosaic virus, CaMV; tobacco mosaic virus, TMV) or transformed with recombinant plasmid expression vectors, such as Ti plasmid, containing the coding sequence. Mammalian expression systems can also be used to express the polypeptides of the present invention.

An exemplary prokaryotic host-expression system contemplated by the present invention is *E. coli* strain BL 21 (DE3) omp8 (which lacks all major porins—OmpF, OmpC, PhoE, LamB, OmpA).

Examples of bacterial constructs include the pET series of *E. coli* expression vectors [Studier et al. (1990) Methods in Enzymol. 185:60-89).

In yeast, a number of vectors containing constitutive or inducible promoters can be used, as disclosed in U.S. Pat. No. 5,932,447. Alternatively, vectors can be used which promote integration of foreign DNA sequences into the yeast chromosome.

In cases where plant expression vectors are used, the expression of the coding sequence can be driven by a number of promoters. For example, viral promoters such as the 35S RNA and 19S RNA promoters of CaMV [Brisson et al. (1984) Nature 310:511-514], or the coat protein promoter to TMV [Takamatsu et al. (1987) EMBO J. 6:307-311] can be used. Alternatively, plant promoters such as the small subunit of RUBISCO [Coruzzi et al. (1984) EMBO J. 3:1671-1680 and Brogli et al., (1984) Science 224:838-843] or heat shock promoters, e.g., soybean hsp17.5-E or hsp17.3-B [Gurley et al. (1986) Mol. Cell. Biol. 6:559-565] can be used. These constructs can be introduced into plant cells using Ti plasmid, Ri plasmid, plant viral vectors, direct DNA transformation, microinjection, electroporation and other techniques well known to the skilled artisan. See, for example, Weissbach & Weissbach, 1988, Methods for Plant Molecular Biology, Academic Press, NY, Section VIII, pp 421-463.

Examples of mammalian expression vectors include, but are not limited to, pcDNA3, pcDNA3.1 (+/−), pGL3, pZeoSV2 (+/−), pSecTag2, pDisplay, pEF/myc/cyto, pCMV/myc/cyto, pCR3.1, pSinRep5, DH26S, DHBB, pNMT1, pNMT41, pNMT81, which are available from Invitrogen, pCI which is available from Promega, pMbac, pPbac, pBK-RSV and pBK-CMV which are available from Strategene, pTRES which is available from Clontech, and their derivatives.

It will be appreciated that the coding sequence may be modified according to the expression system used. For instance, to optimize expression, a native signal peptide may be used or replaced with a heterologous signal peptide. An exemplary heterologous FadL signal peptide is as set forth in SEQ ID NO: 22983.

Various methods can be used to introduce the expression vector of the present invention into cells. Such methods are generally described in Sambrook et al., Molecular Cloning: A Laboratory Manual, Cold Springs Harbor Laboratory, New York (1989, 1992), in Ausubel et al., Current Protocols in Molecular Biology, John Wiley and Sons, Baltimore, Md. (1989), Chang et al., Somatic Gene Therapy, CRC Press, Ann Arbor, Mich. (1995), Vega et al., Gene Targeting, CRC Press, Ann Arbor Mich. (1995), Vectors: A Survey of Molecular Cloning Vectors and Their Uses, Butterworths, Boston Mass. (1988) and Gilboa et at. [Biotechniques 4 (6): 504-512, 1986] and include, for example, stable or transient transfection, lipofection, electroporation and infection with recombinant viral vectors. In addition, see U.S. Pat. Nos. 5,464,764 and 5,487,992 for positive-negative selection methods.

Transformed cells are cultured under effective conditions, which allow for the expression of high amounts of recombinant polypeptide. Effective culture conditions include, but are not limited to, effective media, bioreactor, temperature, pH and oxygen conditions that permit protein production. An effective medium refers to any medium in which a cell is cultured to produce the recombinant polypeptide of the present invention. Such a medium typically includes an aqueous solution having assimilable carbon, nitrogen and phosphate sources, and appropriate salts, minerals, metals and other nutrients, such as vitamins. Cells of the present invention can be cultured in conventional fermentation bioreactors, shake flasks, test tubes, microtiter dishes and petri plates. Culturing can be carried out at a temperature, pH and oxygen content appropriate for a recombinant cell. Such culturing conditions are within the expertise of one of ordinary skill in the art.

Following a predetermined time in culture, recovery of the recombinant polypeptide is effected.

The phrase "recovering the recombinant polypeptide" used herein refers to collecting the whole fermentation medium containing the polypeptide and need not imply additional steps of separation or purification.

Thus, polypeptides of the present invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization.

Outer membrane fractions may initially be obtained using methods known in the art—see for example Erick-Helmerich and Barun, Journal of Bacteriology 1989, 171: 5117-5126].

An exemplary method for purifying a histidine tagged pore-forming polypeptide is described in protocol of Locher and Rosenbush Eur J Biochem 1997 and Nallani et al. 2006, [J Biotechnology 123, 50-9 (2006).]. Briefly, an outer membrane fraction comprising the polypeptide of the invention is solubilized in 1% Octyl Glucoside or 1% Octly-polyoxoethylene or 0.5% Dodecyl Maltoside (Locher 1997) by shaking for 1 hour at 37° C. and then for 10 hours at 12° C. The soluble fraction is then centrifuged for 15 minutes at 4° C. at 50,000 g and the supernatant containing the engineered pore-forming polypeptide is passed through an affinity chromatography column containing Talon Metal Affinity Resin (Clontech, Cat 635502) and eluted with 150 mM imidazole solution. The protein may be concentrated with Amicon ultrafiltration cell PM 30 and dialyzed against Hepes Buffer.

As mentioned, the pore-forming polypeptides of the present invention may be inserted into the lipid layer of an encapsulating particle such that it forms a protease-activatable pore through the lipid layer.

Thus, according to another aspect of the present invention there is provided a composition of matter, comprising an encapsulating particle and the isolated polypeptide of the present invention wherein the encapsulating particle comprises at least one lipid layer, and a compartment surrounded by the lipid layer, and further wherein the isolated polypeptide is positioned such that it is capable of forming a pore through the lipid layer in a presence of the protease.

The present invention also provides for a method of producing a drug delivery system, comprising encapsulating the isolated polypeptide described herein with an encapsulating particle, wherein said encapsulating particle comprises at least one lipid layer, and a compartment surrounded by said lipid layer, and further wherein the isolated polypeptide is positioned such that it is capable of forming a pore through said lipid layer in a presence of said protease.

As used herein, the phrase "encapsulating particle" refers to an entity that is characterized by the presence of one or more walls or membranes formulated from lipids and/or fatty acids that form one or more internal voids. The walls or membranes may be concentric or otherwise. The walls or membranes of vesicles may be substantially solid (uniform), or referred to as, for example, liposomes, lipospheres, nanoliposomes, particles, micelles, bubbles, microbubbles, microspheres, nanospheres, nanostructures, microballoons, microcapsules, aerogels, clathrate bound vesicles, hexagonal/cubic/hexagonal II phase structures, and the like.

The lipids used to formulate the particles of the present invention are generally amphipathic lipids having both hydrophobic tail groups and polar head groups. A characteristic of a vesicle-forming lipid is its ability to either (a) form spontaneously into bilayer vesicles in water, as exemplified by the phospholipids, or (b) be stably incorporated into lipid bilayers, by having the hydrophobic portion in contact with the interior, hydrophobic region of the bilayer membrane, and the polar head group oriented toward the exterior, polar surface of the membrane. A particle-forming lipid for use in the present invention is any conventional lipid possessing one of the characteristics described above.

The particle-forming lipids of this type are preferably those having two hydrocarbon tails or chains, typically acyl groups, and a polar head group. Included in this class are the phospholipids, such as phosphatidylcholine (PC) or lecithin, phosphatidylethanolamine (PE), phosphatidyl-N-methylethanolamine (PE-Me), phosphatidyl-N,N-dimethylethanolamine (PE-diMe), phosphatidyl serine (PS), phosphatidic acid (PA), phosphatidylglycerol (PG), a polyol-containing phosphatide, and phosphatidylinositol (PI), where the two hydrocarbon chains are typically between about 14-22 carbon atoms in length, and have varying degrees of unsaturation.

Other lipids which may be used to formulate the particles of the present invention include 1-monopalmitoleoyl-rac-glycerol (MP), Palmitoyl lysophosphatidylcholine (PLPC), and 1y 1-monooleoyl-rac-glycerol (MO).

The above-described lipids and phospholipids whose acyl chains have a variety of degrees of saturation can be obtained commercially, or prepared according to published methods.

Lipids for use in the present invention may be relatively "fluid" lipids, meaning that the lipid phase has a relatively low gel-to-liquid-crystalline phase transition temperature, e.g., at or below room temperature, or alternately, relatively "rigid" lipids, indicating that the lipid has a relatively high gel-to-liquid-crystalline phase transition temperature, e.g., at temperatures up to about 50° C. As a general rule, the more rigid, i.e., saturated lipids, contribute to greater membrane rigidity in the lipid bilayer structure, and thus to more stable drug retention after active drug loading. Preferred lipids of this type are those having phase transition temperatures above about 37° C.

The particles may additionally include lipids that can stabilize a particle composed predominantly of phospholipids, such as cholesterol in a mole ratio of 25 to 45 mole percent.

According to one embodiment the lipid layer of the encapsulating agents of the present invention comprise poly(acrylic acid) and/or poly(N-isopropylacrylamide).

According to one embodiment the lipid layer of the encapsulating agents of the present invention comprise phosphatidic acid and/or L-α-dimyristoyl phosphatidic acid.

According to one embodiment, the encapsulating particles of this aspect of the present invention are liposomes.

As used herein the term "liposomes" refers to fully closed carrier molecules comprising a spherical lipid membrane which itself is in a liquid crystalline phase or a liquid gel phase, in which an entrapped liquid volume is contained. The two liquid phases are immiscible. Thus, liposomes of the present invention, similar to membranes of cells, are in an entirely gel/liquid state and/or liquid crystal state and not in a solid state. Liposomes include niosomes, transfersomes, emulsions, foams, micelles, liquid crystals, phospholipid dispersions, lamellar layers and the like.

Liposomes used in the invention preferably contain between 30-75 percent phospholipids, preferably phosphatidylcholine (PC), 25-40 percent cholesterol, and 0-20 percent polymer-derivatized lipid, expressed on a molar percent basis.

The liposomes may optionally include a coating or a graft of a hydrophilic polymer chain, for extended circulation lifetime in the bloodstream (see U.S. Pat. No. 5,130,556). Such liposomes are typically prepared by including in the vesicle-forming lipid, 1-20 mole percent of a diacyl-chain lipid, e.g., a phospholipid, derivatized with the hydrophilic polymer, e.g., polyethylene glycol (PEG) having a molecular weight between 1-10 Kdaltons, preferably 2-5 Kdaltons. Methods for preparing PEG-derivatized phospholipids are detailed, for example, in the above cited U.S. Pat. No. 5,013,556.

One of the most desirable features of PEG is its approval by the U.S. Food and Drug Administration (FDA) for in-vivo administration. Ample guidance for selecting and utilizing PEG for practicing the method of the present invention is available in the literature of the art [for general guidance, refer, for example, to Zalipsky, S., Harris, J. M. 1997. Introduction to Chemistry and Biological Applications of Poly (ethylene glycol). Poly(ethylene glycol) Chemistry and Biological Applications. American Chemical Society, San Francisco, Calif. (p. 1-11); for guidance for covalently attaching PEG to molecules, such as therapeutic nucleic acids and polypeptides, refer, for example, to: Molineux G., 2002. Cancer Treat Rev. 28 Suppl A:13-6; Harris J M. and Chess R B., 2003. Nat Rev Drug Discov. 2:214-21; Sato H., 2002. Adv Drug Deliv Rev. 54:487-504; Roberts et al., 2002. Adv Drug Deliv Rev. 54:459-76).

Other hydrophilic polymers which may be suitable include polylactic acid, polyglycolic acid, polyvinylpyrrolidone, polymethyloxazoline, polyethyloxazoline, polyhydroxypropyl methacrylamide, polymethacrylamide, polydimethylacrylamide, and derivatized celluloses, such as hydroxymethylcellulose or hydroxyethylcellulose. Phospholipid polymer conjugates of these polymers are described in WO 94/02271, published Sep. 3, 1994.

One exemplary "rigid" polymer-grafted liposome formulation is formed of polyethylene glycol conjugated phosphatidylethanolamine, PEG-PE, hydrogenated soy phosphatidylcholine (HSPC) and cholesterol in a weight ratio of 1:3:1. Two exemplary polymer coated fluid liposome compositions contain the components PEG-PE, egg phosphatidylcholine (EPC), and cholesterol, in corresponding molar ratios of 6:56:38 and 6:62:32.

Another plausible approach to stabilize and create 'stealth' liposomes utilizes cholesterol terminated polyacrylic acid (Chol-PAA). Since it is easily inserted and cross-linked with 2,2'-ethylenedioxy-bis ethylamine on the surface of a liposome, this results in a very stable polymer-cage, as described in Lee, S. M., Chen, H., Dettmer, C. M., O'Halloran, T. V. & Nguyen, S. T. Polymer-caged liposomes: a pH-responsive delivery system with high stability. J Am Chem Soc 129, 15096-7 (2007).

Another approach to stabilizing liposomes is with the use of naturally occurring hyaluronic acid. Hyaluronan provides long term circulation as well as targeting of overexpressed hyaluronan receptors CD44 and RHAMM. Dan Peer and Rimona Margalit Tumor-Targeted Hyaluronan Nanoliposomes Increase the Antitumor Activity of Liposomal Doxorubicin in Syngeneic and Human Xenograft Mouse Tumor Models Neoplasia. 2004 July; 6(4): 343-353.

Sterically shielded lipids such as ganglioside-$GM_1$ and phosphatidylinositol may also be used to generate 'stealth' liposomes.

The liposomes may be prepared by any of the known methods in the art [Monkkonen, J. et al., 1994, J. Drug Target, 2:299-308; Monkkonen, J. et al., 1993, Calcif. Tissue Int., 53:139-145; Lasic D D., Liposomes Technology Inc., Elsevier, 1993, 63-105. (chapter 3); Winterhalter M, Lasic D D, Chem Phys Lipids, 1993 September; 64(1-3):35-43]. In a typical procedure, a mixture of liposome-forming lipids is dissolved in a suitable organic solvent and evaporated in a vessel to form a thin film. The film is then covered with an aqueous medium containing the solute species that will form the aqueous phase in the liposome interior spaces, in the final liposome preparation. The lipid film hydrates to form multilamellar vesicles (MLVs) having heterogeneous sizes typically between about 0.1 to 10 microns. Liposomes can be reduced in size by various techniques known in the art such as, extrusion or sonication.

In the general case, the liposomes are prepared in a solution containing a weak acid salt, such as sodium or calcium acetate, sodium or calcium formate, or other suitable salt of a weak organic acid, such as salts of propanoic, butanoic, or pentanoic acid, and derivatives thereof, as defined in Section I. The weak acid is one which, in its uncharged or undissociated form, is readily able to permeate the transmembrane barrier of the liposomes. The acid salt also preferably has a high solubility in water, e.g., greater than about 300 mg/ml. The hydration medium is preferably at least 50 mM weak acid salt, and typically between 50-300 mM. The medium is adjusted, e.g., by addition of acid, to a pH of between 5 and 7, but contains no additional buffering species.

After liposome formation, the vesicles may be sized to achieve a size distribution of liposomes within a selected range, according to known methods. The liposomes are preferably uniformly sized comprising a diameter of less than 150 nm. An exemplary selected size range may be between 0.04 to 0.15 µm. Small unilamellar vesicles (SUVs), which are single-walled vesicles typically in the 0.04 to 0.08 µm range, can be prepared by extensive sonication or homogenization (Martin, et al., 1990) of the liposomes.

Homogeneous sized liposomes having sizes in a selected range between about 0.08 to 0.4 microns, e.g., 0.07-0.12 microns, can be readily produced by extrusion through defined pore-size membranes, e.g., polycarbonate membranes, having defined pore size membranes with selected pore sizes ranging from 0.03 to 0.5 microns, typically, 0.05, 0.08, 0.1, or 0.2 microns. The pore size of the membrane corresponds roughly to the largest size of liposomes produced by extrusion through that membrane, particularly where the preparation is extruded two or more times through the same membrane.

The sizing is preferably carried out in the original lipid-hydrating buffer, so that the liposome interior spaces retain this medium throughout the initial liposome processing steps.

As mentioned, the encapsulating particle of this aspect of the present invention may also be a mesophase (cubic-phase). Cubic-phases are biodegradable, continuous lipid bilayers that are isotropically curved in three-dimensional space, in a manner that separates between two tunnel-like aqueous compartments (Luzzati, V. 1997 Curr. Opin. Struct. Biol. 7, 661-668). The aqueous compartments of these lipidic phases can accommodate solutes as large as lysozyme (Rummel, G. et al., 1998 J. Struct. Biol. 121, 82-91), making cubic phases a potential drug-carrier system. The cubic phases can be constructed out of various lipids mixtures including (but not limited to) 1-monopalmitoleoyl-rac-glycerol (MP), Palmitoyl lysophosphatidylcholine (PLPC), and preferably 1-monooleoyl-rac-glycerol (MO). When controlling the temperature and lipid/water content one can adjust the cubic-phase types as described in the phase diagrams in Caffrey M. J Struct Biol. 2003 April; 142(1):108-32. Review.

Any method may be used to insert the pore-forming polypeptides into the encapsulating particles of the present invention so long as it does not interfere with the required properties of the polypeptide. Preferably, the pore-forming polypeptide is inserted such that at least one protease cleavage site faces the outside of the encapsulating particle.

For example, reconstitution of a pore-forming polypeptide into a liposome may be performed following the procedure of Plancon, L., Chami, M. & Letellier, L. Reconstitution of FhuA, an *Escherichia coli* outer membrane protein, into liposomes. Binding of phage T5 to Fhua triggers the transfer of DNA into the proteoliposomes. J Biol Chem 272, 16868-72 (1997)., incorporated herein by reference. In brief, liposomes (e.g. 5 mM) are incubated with Octyl glucoside (e.g. 22 or 45 mM) for about 30 minutes. The pore-forming polypeptide (e.g. FhuA; 35 µg) is added and the detergent concentration adjusted to either 22 or 45 mM. The detergent is then adsorbed onto $SM_2$ Bio-Beads and at a concentration of 80 mg of wet Bio-Beads/ml, the suspension is shaken gently. 3 hours later, a second portion of the same amount of Bio-Beads is added and the suspension is shaken overnight at 4° C. Proteoliposomes are removed gently after decanting the Bio-Beads.

Other methods for the covalent attachment of the pore-forming polypeptide to the encapsulating particles include the use of an amide, ester, or ether bond, streptavidin and biotin (see, for instance, U.S. Pat. No. 5,171,578), and activation of a polypeptide with carbodiimide followed by coupling to the activated carboxyl groups (U.S. Pat. No. 5,204,096)). Other examples of methods that can be used to covalently bind a polypeptide to a lipid are disclosed in U.S. Pat. No. 5,258,499.

The encapsulating particles may optionally be prepared to contain additional surface groups, such as antibodies or antibody fragments, small effector molecules for interacting with cell-surface receptors, antigens, and other like compounds for achieving desired target-binding properties to specific cell populations. Here the lipid component included in the encapsulating particles would include either a lipid derivatized with the targeting molecule, or a lipid having a polar-head chemical group that can be derivatized with the targeting molecule in preformed particles, according to known methods.

Ample guidance regarding surface markers specifically overexpressed in diseases such as cancer, and antibodies specific for such surface markers is provided in the literature of the art (for example, refer to: A M Scott, C Renner. "Tumour Antigens Recognized by Antibodies." In: Encyclopedia of Life Sciences, Nature Publishing Group, Macmillan, London, UK, wwwdotelsdotnet, 2001).

Diseases associated with a target cell/tissue specifically displaying a growth factor receptor/TAA surface marker which are amenable to treatment by the method of the present invention include, for example, some of the numerous diseases which specifically display growth factor receptors/TAAs, such as EGF receptor, platelet derived growth factor (PDGF) receptor, insulin like growth factor receptor, vascular endothelial growth factor (VEGF) receptor, fibroblast growth factor (FGF) receptor, transferrin receptor, and folic acid receptor. Specific examples of such diseases and the growth factor receptors/TAAs which these specifically display are listed in Table 6 below.

Examples of therapeutic agents include, but are not limited to small molecule agents (e.g. those that are less than 1000 kDa), organic compounds, inorganic compounds, metal ions, polypeptides (e.g. enzymes or enzyme inhibitors), non-ribosomal polypeptides, polyketides, peptidomimetics and polynucleotides. According to one embodiment, the therapeutic agent is a chemotherapeutic agent including but not limited to fluoropyrimidines; pyrimidine nucleosides; purines; antifolates, platinum analogs; electrophilic alkylating agents; anthracyclines/anthracenediones; podophyllotoxins; camptothecins; hormones and hormonal analogs; enzymes, proteins, and antibodies, vinca alkaloids, taxanes and epothilones. Other contemplated therapeutic agents include viruses.

Specific examples of chemotherapeutic agents include Doxorubicin, Camptothecin, Paclitaxel, and Palatinate.

Examples of diagnostic agents include, for instance, positive or negative contrast agents that can be used for imaging such as gadolinium or magnetic particles and fluorescent dyes. Preferably, the internal compartment of the encapsulating particle also includes a pharmaceutically acceptable carrier, as further described herein below. The internal compartment may include a compound that inhibits the activity of the protease that cleaves the pore-forming polypeptide present on the surface of the liposome. For example, in those aspects of the invention where the trigger polypeptide present on the surface of the liposome is cleaved by gelatinase-A and/or gelatinase-B, an inhibitor of gelatinase-A and/or gelatinase-B activity may be used. Examples of gelatinase-A and gelatinase-B inhibitors are known. An example of such a compound is H-$Cys^1$-Thr-Thr-His-Trp-Gly-Phe-Thr-Lue-$Cys^{10}$-OH (cyclic: 1->10) (SEQ ID NO:23).

The present invention contemplates at least two possible mechanisms for releasing the inner contents of the encapsulating particle. In one embodiment, the pore-forming polypeptide generates a pore wide enough (in the presence of

TABLE 6

| Receptor* | Malignancy type | Review reference |
| --- | --- | --- |
| EGF receptor | Malignant glioma, glioblastoma, head and neck, breast, colon, lung, prostate, kidney, ovary, brain, pancreas, bladder | Kim, E. S. et al., 2001. Curr Opin Oncol 13, 506-13; Kuan et al., 2000. Brain Tumor Pathol. 2000; 17: 71-8 |
| PDGF receptor | Brain, prostate | George, D., 2001. Semin Oncol 28, 27-33 |
| IGF receptor | Breast, lung, colon, prostate | Wang, Y., and Sun, Y., 2002. Curr Cancer Drug Targets 2, 191-207 |
| VEGF receptor | Solid tumors, acute and chronic leukemias, myeloproliferative diseases, multiple myeloma, non-Hodgkin's lymphomas, and Hodgkin's disease | Rosen, L. S., 2001. Cancer J 7 Suppl 3, S120-8; Giles, F. J., 2001. Oncologist 6, 32-9 |
| FGF receptor | Melanoma, Caposi sarcoma, pancreas | Lappi, D. A., 1995. Semin Cancer Biol 6, 279-88 |
| Transferrin receptor | Leukemia, brain, colon, kidney, bladder | Singh, M., 1999. Curr Pharm Des 5, 443-51 |

*Abbreviations: EGF—epidermal growth factor, PDGF—platelet derived growth factor, IGF—insulin like growth factor, VEGF—vascular endothelial growth factor, FGF—fibroblast growth factor.

This interior compartment includes a liquid that is aqueous. The compartment also includes one or more compounds present in the liquid. The compound may be, for instance, a liquid, a solid that is dissolved in the liquid, or a solid that is suspended in the liquid.

The internal compartment of the particles may be filled with a wide variety of materials including, for example, therapeutic agents, diagnostic agents, water, oil, gases, gaseous precursors, liquids, fluorinated compounds or liquids, liquid perfluorocarbons, liquid perfluoroethers and/or other materials.

a protease) to allow the contents of the encapsulating particle to be released. In another embodiment, the pore-forming polypeptide generates a pore wide enough (in the presence of a protease) to allow water to filter into the encapsulating particle by osmosis thereby bursting it open and allowing the subsequent release of the inner contents.

Since the encapsulating particles may be filled with therapeutic agents, the particles may be used to treat a disease.

Thus, according to another aspect of the present invention, there is provided a method of treating a disease associated with an up-regulation of a protease in a subject in need thereof, the method comprising administering to the subject a therapeutically effective amount of the above described composition of matter.

Exemplary diseases that are associated with an up-regulation of a protease include, but are not limited to cancer (including solid tumors), gouty arthritis, inflammatory bowel disease (ulcerative colitis), abdominal aortic aneurysms, quiescent Crohn's Disease, glaucoma, and sunlight induced premature skin aging. For example, Vartak et al. Journal of Drug Targeting, January 2007; 15(1): 1-20 (which is herein incorporated by reference in its entirety) review the significance of MMPs in various pathologies including but not limited to, Arthritis, Inflammation, innate immunity, Cancer, Angiogenesis, Cardiovascular diseases, Cerebrovascular diseases, Pulmonary diseases, Ocular diseases, Gastrointestinal diseases, and Oral diseases. See also Example 8 of the Examples section which follows.

As used herein, the term "cancer" refers to a disease or disorder resulting from the proliferation of oncogenically transformed cells.

Exemplary cancers which may be treated according to the present invention include, but are not limited to tumors of the gastrointestinal tract (colon cancer, rectum cancer, anal region cancer, colorectal cancer, small and/or large bowel cancer, esophageal cancer, stomach cancer, pancreatic cancer, gastric cancer, small intestine cancer, adenocarcinoma arising in the small intestine, carcinoid tumors arising in the small intestine, lymphoma arising in the small intestine, mesenchymal tumors arising in the small intestine, gastrointestinal stromal tumors), gallbladder carcinoma, Biliary tract tumors, prostate cancer, kidney (renal) cancer (e.g., Wilms' tumor), liver cancer (e.g., hepatoblastoma, hepatocellular carcinoma), hepatobiliary cancer, biliary tree cancer, tumors of the Gallbladder, bladder cancer, embryonal rhabdomyosarcoma, germ cell tumor, trophoblastic tumor, testicular germ cells tumor, immature teratoma of ovary, uterine, epithelial ovarian, sacrococcygeal tumor, choriocarcinoma, placental site trophoblastic tumor, epithelial adult tumor, ovarian cancer, cervical cancer, cancer of the vagina, cancer of the Vulva, lung cancer (e.g., small-cell and non-small cell lung carcinoma), nasopharyngeal, breast cancer, squamous cell carcinoma (e.g., in head and neck), neurogenic tumor, astrocytoma, ganglioblastoma, neuroblastoma, lymphomas (e.g., Hodgkin's disease, non-Hodgkin's lymphoma, B cell, Burkitt, cutaneous T cell, histiocytic, lymphoblastic, T cell, thymic, cutaneous T-cell lymphoma, primary central nervous system lymphoma), gliomas, medullary thyroid carcinoma, testicular cancer, brain and head/neck cancer, gynecologic cancer, endometrial cancer, germ cell tumors, mesenchymal tumors, neurogenic tumors, cancer of the bladder, cancer of the ureter, cancer of the renal pelvis, cancer of the urethra, cancer of the penis, cancer of the testis, cancers of the uterine body, endometrial carcinoma, uterine sarcoma, peritoneal carcinoma and Fallopian Tube carcinoma, germ cell tumors of the ovary, sex cord-stromal tumors, cancer of the endocrine system, thyroid tumors, medullary thyroid carcinoma, thyroid lymphoma, parathyroid tumors, adrenal tumors, pancreatic endocrine tumors, sarcomas of the soft tissue and bone, benign and malignant mesothelioma, malignant peritoneal mesothelioma, malignant mesothelioma of the Tunica Vaginalis Testis, malignant mesothelioma of the Pericardium, skin cancer, cutaneous melanoma, intraocular melanoma, neoplasms of the central nervous system, medulloblastomas, meningiomas, peripheral nerve tumors, Pineal region tumors, pituitary adenomas, craniopharyngiomas, acoustic neuromas, Glomus Jugulare tumors, Chordomas and Chondrosarcomas, Hemangioblastomas, Choroid Plexus Papillomas and Carcinomas, spinal axis tumors, leukemia, and chronic leukemia.

The term "subject" refers to animals, typically mammals, including human beings.

As mentioned, the particles of the present invention may be administered to the patient per se or as part of an individual pharmaceutical composition.

As used herein a "pharmaceutical composition" refers to a preparation of the encapsulating particles described herein comprising one or more therapeutic agent, together with other chemical components such as pharmaceutically suitable carriers and excipients. The purpose of a pharmaceutical composition is to facilitate administration of a compound to a subject.

Herein, the term "active ingredient" refers to the encapsulating particles comprising at least one or more therapeutic agents, accountable for the biological effect.

Hereinafter, the term "pharmaceutically acceptable carrier" refers to a carrier or a diluent that does not cause significant irritation to a subject and does not abrogate the biological activity and properties of the administered compound. Examples, without limitations, of carriers are propylene glycol, saline, emulsions and mixtures of organic solvents with water.

Herein the term "excipient" refers to an inert substance added to a pharmaceutical composition to further facilitate administration of a compound. Examples, without limitation, of excipients include calcium carbonate, calcium phosphate, various sugars and types of starch, cellulose derivatives, gelatin, vegetable oils and polyethylene glycols.

Techniques for formulation and administration of drugs may be found in "Remington's Pharmaceutical Sciences," Mack Publishing Co., Easton, Pa., latest edition, which is incorporated herein by reference.

Suitable routes of administration may, for example, include oral, rectal, transmucosal, transdermal, intestinal or parenteral delivery, including intramuscular, subcutaneous and intramedullary injections as well as intrathecal, direct intraventricular, intravenous, intraperitoneal, intranasal, or intraocular injections. Pharmaceutical compositions of the present invention may be manufactured by processes well known in the art, e.g., by means of conventional mixing, dissolving, granulating, dragee-making, levigating, emulsifying, encapsulating, entrapping or lyophilizing processes.

Pharmaceutical compositions for use in accordance with the present invention thus may be formulated in conventional manner using one or more pharmaceutically acceptable carriers comprising excipients and auxiliaries, which facilitate processing of the active compounds into preparations which can be used pharmaceutically. Proper formulation is dependent upon the route of administration chosen.

For injection, the particles of the invention may be formulated in aqueous solutions, preferably in physiologically compatible buffers such as Hank's solution, Ringer's solution, or physiological saline buffer with or without organic solvents such as propylene glycol, polyethylene glycol. For transmucosal administration, penetrants are used in the formulation. Such penetrants are generally known in the art.

For oral administration, the particles can be formulated readily by combining the active compounds with pharmaceutically acceptable carriers well known in the art. Such carriers enable the conjugates of the invention to be formulated as tablets, pills, dragees, capsules, liquids, gels, syrups, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethylcellulose and/or physiologically acceptable polymers such as polyvinylpyrrolidone (PVP). If desired, disintegrating agents may be added, such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions, which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the particles may take the form of tablets or lozenges formulated in conventional manner.

For administration by inhalation, the particles of the present invention may be conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in an inhaler or insufflator may be formulated containing a powder mix of the compound and a suitable powder base such as lactose or starch.

The particles described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain formulatory agents such as suspending, stabilizing and/or dispersing agents.

Pharmaceutical compositions for parenteral administration include aqueous solutions of the active compound in water-soluble form. Additionally, suspensions of the active compounds may be prepared as appropriate oily injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran. Optionally, the suspension may also contain suitable stabilizers or agents which increase the solubility of the active agents to allow for the preparation of highly concentrated solutions. Alternatively, the active ingredient may be in powder form for constitution with a suitable vehicle, e.g., sterile, pyrogen-free water, before use.

The particles of the present invention may also be formulated in rectal compositions such as suppositories or retention enemas, using, e.g., conventional suppository bases such as cocoa butter or other glycerides.

Alternately, one may administer the particles of the present invention in a local rather than systemic manner, for example, via injection of the pharmaceutical composition directly into a tissue region of a patient.

Thus for example, the particles of the present invention may be administered directly into the tumor.

The pharmaceutical compositions herein described may also comprise suitable solid of gel phase carriers or excipients. Examples of such carriers or excipients include, but are not limited to, calcium carbonate, calcium phosphate, various sugars, starches, cellulose derivatives, gelatin and polymers such as polyethylene glycols.

Pharmaceutical compositions suitable for use in context of the present invention include compositions wherein the active ingredients are contained in an amount effective to achieve the intended purpose.

Determination of a therapeutically effective amount of each of the active agents is well within the capability of those skilled in the art, especially in light of the detailed disclosure provided herein.

For any of the active agents used in the methods of the invention, the therapeutically effective amount or dose can be estimated initially from activity assays in cell cultures and/or animals.

Below is a list of animal models and animal cell lines that can be used to ascertain the therapeutically effective amount of the active agents of the present invention.

Tumor Formation in Transgenic Mice Overexpressing an Oncogene

A transgenic mouse model for cancer (e.g., breast cancer) such as the erb model (Shah N., et al., 1999, Cancer Lett. 146: 15-2; Weistein E J., et al., 2000, Mol. Med. 6: 4-16) or MTV/myc model (Stewart T A et al., 1984, Cell, 38: 627-637), the c-myc model (Leder A., et al., 1986, Cell, 45:485-495), v-Ha-ras or c-neu model (Elson A and Leder P, 1995, J. Biol. Chem. 270: 26116-22) can be used to test the ability of the active agents, both individually and in combination to suppress tumor growth in vivo.

Tumor Formation in Mice Administered with Cancerous Cell Lines

For the formation of solid tumors, athymic mice can be injected with human or animal (e.g., mouse) cancerous cells such as those derived from breast cancer, ovarian cancer, prostate cancer or thyroid cancer, and following the formation of cancerous tumors the mice can be subjected to intra-tumor and/or systemic administration of the active agents of the present invention, both individually and in combination.

Toxicity and therapeutic efficacy of the agents described herein both alone and in combination can be determined by standard pharmaceutical procedures in experimental animals, e.g., by determining the IC50 and the LD50 (lethal dose causing death in 50% of the tested animals) for a subject compound. The data obtained from these activity assays and animal studies can be used in formulating a range of dosage for use in human.

Side effects of each of the agents of the present invention at doses which are effective at treating cancer may be assayed using standard assays known in the art.

The dosage may vary depending upon the dosage form employed and the route of administration utilized. The exact formulation, route of administration and dosage can be chosen by the individual physician in view of the patient's condition. (See e.g., Fingl, et al., 1975, in "The Pharmacological Basis of Therapeutics", Ch. 1 p. 1).

Dosage amount and interval may be adjusted individually to provide local levels of the active agents which are sufficient to maintain the cytotoxic activity, termed the minimal effective concentration (MEC). The MEC will vary for each preparation, but can be estimated from in vitro and/or in vivo data, as described hereinabove. Dosages necessary to achieve the MEC will depend on individual characteristics and route of administration. HPLC assays or bioassays can be used to determine local concentrations.

Dosage intervals can also be determined using the MEC value. Preparations should be administered using a regimen, which maintains local levels above the MEC for 10-90% of the time, preferable between 30-90% and most preferably 50-90%.

The amount of a composition to be administered will, of course, be dependent on the subject being treated, the severity of the pain, the manner of administration, the judgment of the prescribing physician, etc.

Compositions of the present invention may, if desired, be presented in a pack or dispenser device, such as a FDA approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accompanied by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the U.S. Food and Drug Administration for prescription drugs or of an approved product insert. Compositions comprising the active agents of the invention formulated in a compatible pharmaceutical carrier may also be prepared, placed in an appropriate container, and labeled for the treatment of a particular disease, such as cancer.

It is expected that during the life of a patent maturing from this application many relevant encapsulating particles will be developed and the scope of the term "encapsulating particle" is intended to include all such new technologies a priori.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683, 202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N.Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W.H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Materials and Methods

Engineering of FhuA:

The engineering of the prototypic pore-forming polypeptide was based on the 'X'-ray crystal structure of a histidine-tagged FhuA, which was previously determined at atomic resolution (Swiss-Prot primary accession no. P23979; RCSB Protein Data Bank (PDB) ID code 1FCP). Using Deepview/Swiss PDB-Viewer 3.7 and PyMOL, the His$_6$-tagged FhuA was carefully inspected and mutated in silico. Ten potential MMP-7 cleavage sites were inserted into the extracellular loops and the cork, these include 68 amino acid mutations for creating MMP cleavage sites and 5 mutations assigned to preventing clashes between the newly designed loops. The sequence of the in silico mutated FhuA$_{7/10}$-1 was aligned with the sequence of FhuA (1FCP), and then was submitted for automated comparative protein modeling via the SWISS-PROT alignment interface (http://swissmodeldotexpasydotorg/SWISS-MODELdothtml) [Guex, N. & Peitsch, M. C. Electrophoresis 18, 2714-23 (1997); Schwede, T., et al., Nucleic Acids Res 31, 3381-5 (2003)]. The rms difference (rmsd) between the backbone (2,820 atoms) of the FhuA structure (1FCP) and the mutated FhuA$_{7/10}$-1 was 0.08 Å. Energy minimizations of the FhuA$_{7/10}$-1 was performed with GROMOS96 (free energy reached −31,719 kjoul/mol). The sequences of the wild-type and mutated proteins are provided in Table 7 herein below.

TABLE 7

| Protein | Amino acid sequence | Polynucleotide sequence |
| --- | --- | --- |
| Wild-type FhuA | SEQ ID NO: 1 | SEQ ID NO: 2 |
| Wilt-type FhuA with histidine tag | SEQ ID NO: 3 | SEQ ID NO: 4 |
| FhuA$_{7/10}$-1 with histidine tag | SEQ ID NO: 5 | SEQ ID NO: 6 |
| FhuA$_{7/10}$-1 | SEQ ID NO: 7 | SEQ ID NO: 8 |
| Wild Type OprD | SEQ ID NO: 9 | SEQ ID NO: 10 |
| Oprd-D15 signal Peptide | SEQ ID NO: 11 | SEQ ID NO: 12 |
| OprD-D15-mutPL2b | SEQ ID NO: 13 | SEQ ID NO: 14 |
| OprD-D15-mutLa3 | SEQ ID NO: 15 | SEQ ID NO: 16 |

Transfection of Cultured Cells and Cell Harvesting:

Human embryonic kidney (HEK-293T) cells were cultured and transfected by using the calcium phosphate precipitation technique with expression vectors (pMT3)[53] carrying the cDNA insert encoding the engineered FhuA (FhuA$_{7/10}$-1). 10-20 μg DNA was used per 100-mm plate. Two to three days following transfection, when the cells started to lose their normal morphology and became round shaped, they were harvested with phosphate buffered saline (PBS) containing 5 mM EDTA and protease inhibitor cocktail (1 μl/3ml solution; Sigma-Aldrich, Israel, cat. #P-8340). Cells were then centrifuged at 800 g for 10 min and the pellet was frozen in liquid nitrogen and stored at −80° C.

Membrane Preparation:

Harvested cells were defrosted on ice and ice cold PBS was added with protease inhibitor cocktail (concentration as above). These cells were then homogenized with either glass-glass hand homogenizer or teflon-glass electric homogenizer (Heidolph 50110). The homogenate was centrifuged for 10 min at 800 g in order to remove nuclei and large debris; this step was repeated twice more on the pellet.

Supernatant was collected and centrifuged at 15,000 g for 40 minutes. After discarding the supernatant, the pellet was re-homogenized and centrifuged again for 40 minutes at 15,000 g, and finally re-suspended in PBS with or without cocktail and stored in liquid nitrogen.

Azocoll Spectrophotometry:

Azocoll, a general proteolytic substrate made from collagen with an embedded azo dye, yields a red color when cleaved, with an absorbance at 520 nm. 0.2 mg of Azocoll (Calbiochem, cat #194933) was incubated with 3.58 U of human matrix metalloproteases seven (MMP-7, Calbiochem, cat #444270) in PBS for 15 hours at 37° C. in the presence and absence of protease inhibitor cocktail (Sigma, cat #P8349). Measurements were carried out using the Ultrospec 2100 pro (Amersham Biosciences).

Cleavage by MMP and Western Blotting:

Membrane aliquots of 100-250 μl were washed twice with PBS, protease inhibitor cocktail, and 400 mM NaCl, re-homogenized and centrifuged for 30 minutes at 18,000 g, followed by three washes with PBS with or without cocktail.

Human MMP-7 was added at 0.25 μl (3.85 units) per 20 ul membranes for various times at 37° C. Samples were analyzed on a 10% SDS-PAGE, transferred onto nitrocellulose or PVDF paper, blocked with blocking buffer (5% Bovine Serum Albumin, Sigma, cat. #A2153 and 2% Blotting Milk, Bio-Rad, cat. #1706404) and blotted for 2 hours with anti-His$_5$ monoclonal antibody (Novagen, cat. #70796; diluted 1:1000, in blocking buffer). After six washes, which included three ten-minute washes with PBS and 0.1% Tween 20 (Sigma, cat. #P1379) and another three ten-minute washes with PBS alone, goat anti-Mouse HRP antibody (Calbiochem, cat. #401215) was added at a dilution of 1:20,000 in blocking buffer for 2 hours. After six washes, as above, the film was developed with ECL reagent (Biological Industries, cat #20-500-120). The film was scanned with a simple Canon scanner (Canoscan LiDE 30) and densitometry was performed using Adobe Photoshop 7.0 ME by inverting the image colors, tracing the band and measuring the mean gray value.

Confocal Microscopy:

HEK293T cells were transfected with 2 μg of FhuA$_{7/10}$-1 by the calcium phosphate method, in glass bottom microwell dishes (MatTek, cat. #P35G-1.5-14-C), where the glass was coated with 20 μg/ml poly-L-lysine. Three days after transfection, primary anti-His$_5$ antibodies (mouse, Calbiochem, cat. #70796) were added at 1:1000 dilution directly to the cell culture with 50 mM Hepes for stabilizing the pH, and cells were further incubated overnight at 4° C. Medium was washed out 3 times for 10 minutes with 5 mg/ml BSA dissolved in a solution of 140 mM NaCl, 2.8 mM KCl, 10 mM CaCl$_2$, 10 mM glucose, 10 mM HEPES, and 5 mM NaOH, pH 7.35. Secondary antibody (rhodaminylated goat anti-mouse IgG, H & L chains, Calbiochem cat. #401245) was added at 1:100 dilution and again washed with same solution as before, 3 times for 10 minutes. The Zeiss-LSM510 was used for confocal microscopy.

Electrophysiology in HEK293T Cells:

HEK293T cells were plated on poly-L-lysine coated glass cover slips (20 µg/ml) and transfected with 2 µg DNA (calcium phosphate technique). Ionic currents were observed upon addition of MMP-7 at 23° C. For that, voltage-clamp recordings in HEK cells were performed, using the whole-cell configuration of the patch-clamp technique. Signals were amplified using an Axopatch 200B patch-clamp amplifier (Molecular Devices, Sunnyvale, Calif.), sampled at 2 kHz and filtered at 800 Hz via a 4-pole Bessel low pass filter. Data were acquired using pClamp 10.0 software (Molecular Devices) in conjunction with a DigiData 1440A interface (Molecular Devices). The patch pipettes were pulled from borosilicate glass (Warner Instrument Corp, USA) with a resistance of 4-8 M. For current recordings in HEKcells, the intracellular pipette solution contained (in mM): 130 CsCl, 4 MgCl$_2$, 4Na$_2$ATP, 1 EGTA, 10 HEPES, adjusted with CsOH to pH 7.35 (290 milliosmolar). The extracellular solution contained (in mM): 140 NaCl, 2.8 KCl, 10 CaCl$_2$, 2 MgCl$_2$, 10 glucose, 10 HEPES, adjusted with NaOH to pH 7.35 (310 milliosmolar). Series resistances (3-20 MΩ) were compensated (75-90%) and periodically monitored.

Example 1

Engineering of a Pore-Forming Polypeptide (FhuA$_{7/10}$-1)

In order to successfully engineer a cleavage site motif into the FhuA—such that the protein will still be expressed—each amino acid mutation was considered carefully, attempting not to stray from the biochemical properties of each wild-type amino acid. Note, that drastically changing an amino acid may impair its folding and subsequently its expression.

To avoid such a situation, the bond networks of the native and substituting amino acids was considered. For example, native amino acid side-chains which face into the protein may interact via H-bonds with other amino acids, therefore, the mutated amino acid must attempt to keep this same interaction. To this end, the volume of the amino acid's side chain, its charge, and overall chemical structure (aromatic side-chains in particular) were kept similar. Hydrophobicity of amino acid side chains located at the perimeter of the barrel (FIGS. 1A-J) also play an important role in determining the FhuA's placement in the lipid bi-layer; therefore, polar and non-polar side chains were also kept constant during mutagenesis. Proline containing loops were selected for mutagenesis since they are contained in MMP-7 cleavage sites.

Seventy three native amino acids were replaced in order to introduce ten cleavage sites in loops and 13 strands of FhuA. Five site-specific mutations were performed in order to maintain the correct 3-D structure of the polypeptide. Prior to in silco mutagenesis, the overall free energy of the FhuA (PDB ID code 1FCP) was −26,481 kjoul/mol as calculated by GROMOS96, in vacuo. Following mutagenesis, the free energy of the $FhuA_{7/10}$-1 (FIGS. 1A-F) went down to −31,719 kjoul/mol. The resulting free energy is more negative, indicating that there were neither distortions in the backbone nor in the side chains. In the final structural model, no clashes took place between amino acids and the backbone, nor between side chains of amino acids. Most of the ten cleavage sites are solvent accessible and some are located at secondary-tier sites including the cork. The Doxorubicin that was modeled into the $FhuA_{7/10}$-1 (FIGS. 1B & 1G) is approximately the same size as the Ferrichrome (FIGS. 1C & 1H), which is naturally transported into bacteria by the wild-type FhuA. Therefore, Doxorubicin will have sufficient space to diffuse through the channel after complete cleavage. FIGS. 1D, 1I, 1E and 1J show the Connolly Surface of the $FhuA_{7/10}$-1, where solvents contact the surface of the molecule at each possible position. This affirms that the cleavage sites are on the surface and are accessible to MMP cleavage activity. FIGS. 1A, 1F, 1D, 1I, 1E and 1J also indicate that, prior to cleavage, the extracellular loops and cork of the engineered $FhuA_{7/10}$-1 will completely obstruct all possible leakage of Doxorubicin after loading it into liposomes, because the entire channel (formed by the β-barrel) is occupied.

Example 2

The Engineered $FhuA_{7/10}$-1 Folds Properly and Arrives at the Cell Surface To assess whether the engineered $FhuA_{7/10}$-1 folds properly, human embryonic kidney cells (HEK293T) were transfected with DNA encoding the $FhuA_{7/10}$-1. Living cells expressing the $FhuA_{7/10}$-1 were able to bind anti-$His_5$ antibodies (FIGS. 2A-F) and TALON beads coated with cobalt that displays a high affinity to the histidine tag (FIG. 3). These observations indicate that the many mutations did not affect the translation, folding, and cell-surface expression of the $FhuA_{7/10}$-1. The finding that the His tag is facing the extracellular milieu indicates that the transmembrane topology of the protein is similar to that of the wild-type.

Example 3

The Membrane-Integrated Pore-Forming Polypeptide is Accessible to Cleavage by Human MMP-7

The capacity of human MMP-7 to cleave the engineered $FhuA_{7/10}$-1 was examined in membrane preparations where the pore-forming polypeptide is integrated and folded in its natural environment, within the lipid bilayer. For that, HEK293T cells were transfected with a plasmid DNA encoding the engineered $FhuA_{7/10}$-1, and membranes were prepared as described in "Materials & Methods". It should be noted that membrane preparations might contain residual proteolytic activity that was procedurally inhibited by addition of a mixture of protease inhibitors. Therefore, as a preliminary set of experiments, the effect of particular protease inhibitors was examined on the activity of human MMP-7. FIG. 4 shows that protease inhibitor cocktail has no detrimental affect on MMP-7 activity. This inhibitor cocktail includes AEBSF, Aprotinin, Bestatin hydrochloride, E-64, Leupeptin hemisulfate salt, Pepstatin A, and does not include inhibitors of metalloproteinases.

FIG. 5A (lane 1, indicated by 'a') shows that the uncleaved $FhuA_{7/10}$-1 migrates as a ~81 kDa polypeptide, as is the case of the wild type FhuA. Incubation of the membranes with human MMP-7 for 30 minutes at 37° C. resulted in the appearance of ~57- and ~37-kDa bands (FIG. 5A, lane 3 compared to lane 2, indicated by 'b' and 'c'). It was also evident that some degradation takes place also in the absence of MMP-7. This might indicate the presence of inherent proteolytic activity in the membrane preparation. Therefore, the present inventors examined the effect of the aforementioned protease inhibitor cocktail on this plausible inherent activity and on the activity of MMP-7. Comparison of lanes 4 (without MMP-7) and 5 (with MMP-7) in FIG. 5A shows that the inhibitor cocktail used, does not inhibit the activity of MMP-7 and slightly inhibits the proteolytic activity inherent to the preparation. Longer incubation periods virtually gave the same results (FIG. 5A, lanes 8 & 9). One cannot exclude the possibility that some proteolytic activity takes place prior to cell harvesting owing to over expression of FhuA$_{7/10}$-1 in the cells, as well as due to some metallo-proteolytic activity naturally produced by HEK cell. Such inherent proteolytic activity can easily be seen in membranes prepared of over-expressing cells (FIG. 5B lane 10, compared to cleavage by exogenously added MMP-7).

FIG. 5B (lanes 1-9) shows a kinetics experiment with a range of cleavage times. It is clear that the amount of uncleaved protein (~81 kDa, indicated by 'a') decreases while the amount of the cleaved one increases (~57 kDa, indicated by 'b'). Interestingly, after approximately 3 hours, the primary cleavage product of ~57 kDa peptide (indicated by 'b') is further degraded and after 12 hours all His-tagged polypeptides (~81 kDa) completely disappear along with the ~57- and ~37-kDa bands (this was repeated twice more; data not shown). This is corroborated by densitometry depicted in FIGS. 5C and D. The complete disappearance of the FhuA$_{7/10}$-1 and its cleavage products may indicate that a complete digestion of all cleavage sites took place. Such a complete digestion should result in a small 3.6-kDa His$_6$-tagged polypeptide. Such as small protein would be very difficult to detect as it most probably crosses the nitrocellulose paper during blotting. However, when blotting was performed with PVDF, the present inventors were able to detect many more bands (FIG. 5E, lane 2).

Example 4

Permeation Through the Engineered Pore-Forming Polypeptide

In order to use the FhuA$_{7/10}$-1 as part of a safe release mechanism in the nanocarrier, it must maintain a tight seal to prevent leakage of the chemotherapeutic drugs, and it must be cleavable by MMPs. This was tested using electrophysiological recordings.

FhuA$_{7/10}$-1 expressing cells were identified by penning the cells with cobalt-coated beads (FIG. 3). The expressing cells were subjected to electrophysiological experiments at room temperature following the basic protocol of Sunesen et al., 2006 with a few modifications accounting for MMP-7 conditions (Materials & Methods). FIG. 6 shows that throughout a period of ~22 minutes from the time of MMP-7 addition, there is a tight seal with no ionic current, therefore larger molecules such as Doxorubicin cannot leak through in therapeutic applications.

Note that the baseline current started to fluctuate 3 minutes before the very large inward current (t=25 min 45 sec, indicated by 'a' in FIG. 6). This large inward current overwhelmed the amplifier after reaching 20,000 pA (indicated by 'b', where the current trace appears as a straight horizontal line at the bottom of the recording diagram). After 5 seconds the inward ionic current declines, as reflected by the movement of the current trace back, close to the baseline (to point 'c' in the figure). At point 'd', the inward ionic current drastically increases again, passing the maximal measurement capacity of the electrophysiological system. After 16 more seconds, this huge ionic current declines again but much slower than the first decline. This phenomenon of strong current fluctuations alludes to a blocking event of the cleaved β-barrel probably because the beta barrel has not disintegrated completely and parts of the protein, which still remain loosely associated through network interactions, do not enable continuous full opening of the channel.

The gradual decrease of the current of the clamp experiment indicates that the cell did not die but rather recovered, indicating that the ions indeed flow through the damaged channel of the engineered pore-forming polypeptide.

These preliminary results demonstrate the feasibility of designing a pore-forming polypeptide that becomes permeable to ions and possibly to large molecules upon cleavage by MMP-7.

Example 5

OPRD Switch

A new prototypic switch based on the OPRD pseudomonas aregenosa beta barrel channel was also engineered into a nanoswitch. This polypeptide has loops that act as a plug that may be cleaved by MMPs when engineered with a cleavage site.

OPRD was expressed with a non-native signal peptide (surface antigen D15) and a tag was added to the C-terminus of the signal peptide. This native protein does not undergo cleavage by MMP7 when incubated for ~20 hours. Two different MMP T sites, called PL2b and La3 were engineered to be expressed in the OPRD polypeptide.

Results

The native protein (solubilized in DDM) was not cleaved in the presence of MMP-7 (concentration 0.25 Units per 16 ug of total protein).

Example 6

Accessibility of the Crown Loops of OprD to Proteolytic Enzymes

Materials and Methods

Following purification of the protein as in Example 7 below, approximately 1-2 ug of protein were incubated with 0.75 Units (U) enterokinase (Novagen, cat#69066-3) or 0.75 U factor Xa (Novagen, cat#69036-3) or 7.7 U MMP-7 (Cal-Biochem, cat#444270) for various times 0-48 hours as indicated.

Results

Before introducing the matrix metalloproteinase (MMP) cleavage sites into the crown of loops at the top of the OprD, the accessibility of crowning loops to well characterized enzymes, having specific cleavage sites, namely the enterokinase (reK) and the factor Xa (fxa) was assessed.

These enzymes are ubiquitously used for cleaving-off affinity tags from proteins after purification on affinity columns and prior to crystallization. These enzymes (Table 8, below) cleave very specifically and therefore will act as a model for proof of concept.

TABLE 8

| | |
|---|---|
| Enterokinase cleavage site | DDDDK (cleaves after K) |
| Factor Xa | IEGR (cleaves after R) |

Fxa and/or the reK were added to the crowning loops of the OprD and tested for cleavage, the results are shown in FIGS. 7A-C.

As shown in FIGS. 7A-C the crowning loop 8 (L8), was cleaved using the fXa, reK and MMP7. As is shown, all three enzymes were able to successfully cleave the protein, while their respective controls (wild-type protein) lack the corresponding bands.

Example 7

Expression and Purification Protocol

The signal peptide of the native OprD was substituted for that of FadL (SEQ ID NO: 22983) signal sequence to increase the expression in E. coli. The FadL-OprD was tagged at its C-terminus with two glycines and 6 histidines and was subcloned into the petblue2™ vector from Novagen. The DNA was transformed into BL21 (DE3)omp8 a strain of E. coli cells lacking the major outer membrane porins, OmpF, OmpC, OmpA, and LamB. The cells were grown to $OD_{600}$=0.5-0.6 at 37° C., then chilled to 15° C. and induced with 200 uM IPTG and grown overnight. Cells were collected by centrifugation at 4,000 g. The cell pellet was resuspended in TSB buffer (20 mM Tris-HCl pH 8.0, 300 mM NaCl, 10% (v/v) glycerol) then passed through the microfluidizer (Microfluidics M-110S) two to three times (20,000 psi) and centrifuged at 65,000 g for 1 hour. The inner membrane proteins were then solubilized using 0.4% n-Octylpolyoxyethylene (Octyl-POE) in TSB at 37° C. for 2 hours followed by centrifugation at 100,000 g for 1 hour. The inner membrane protein depleted pellet was then solubilized again this time with 3% Octyl-POE and 0.5 mM EDTA in TSB for 2 hours at 37° C. followed by centrifugation at 100,000 g for 1 hour. The soluble fraction was then dialyzed at 4° C. against 0.2% LDAO in TSB overnight and then a second time for 3 hours stirring with a magnet in order to remove the EDTA. The dialyzed soluble fraction was then concentrated on a Ni affinity column (using GE Healthcare Ni Sepharose beads 17-5268-02) and washed with 5 mM Imidazole, 0.5% Octyl-POE, in TSB with final concentration of 0.5M NaCl. The protein was then eluted with 500 mM Imidazole and 0.5% Ocytl POE in TSB. The eluted protein was then dialyzed against 0.5% Octyl POE in TSB to remove the imidazole. Some preparations were then concentrated and dialyzed before cleavage experiments.

Example 8

MMPs Over Expression in Pathologies

The invention described herein, also applies to all of the following diseases since they have an overexpression of MMPs as indicated below.

Rheumatoid arthritis and osteoarthritis—Collagenases especially MMP-2
  collagenases and MMP-2 have been implicated as being related to development of rheumatoid arthritis (Rodriguez-Lopez et al. 2006).
Inflammation and innate immunity—MOSTLY MMP-1 and MMP-7
  MMP-1 for repair of skin wounds and MMP-7 for epithelialization in lung and gut (Pilcher et al. 1997; Dunsmore et al. 1998).
Cancer—MOSTLY MMP2 and MMP9
  Primarily MMP-2 and 9 with tumor invasion and metastasis has now been well established through numerous in vivo studies (Liotta et al. 1980; Stetler-Stevenson 1990).
  (MMP-14) has been proposed as being present in nearly every form of cancer if not the cause of many of the malignant transformations (Golubkov et al. 2005).
  MMP-1, -2, -3, -7, -9, -13 and -14 are overexpressed in colorectal cancers
Angiogenesis—MMP-2, MMP-9 and MMP-14
  has been observed in various diseases characterized by neovascularization. MT1-MMP (MMP-14) and MMP-2 and 9 seem to be predominant MMPs involved with angiogenesis (Bergers et al. 2000; Fang et al. 2000; Galvez et al. 2001; Oh et al. 2004),
Cardiovascular diseases
  MMP-1, -2, -3, and -9 found in the atherosclerotic plaque might be responsible for plaque progression and rupture (Galis et al. 1994).
  MMP-2 overexpression and activity has been shown to induce lower contractility in cardiac tissue (Wang et al. 2006)
Cerebrovascular diseases—MOSTLY MMP2, MMP9
  Not surprisingly, levels of active MMP-2 and 9 are markedly increased during cerebral ischemia (Clark et al. 1997).
  MT-1 MMP, MMP-2 and 9 have been found to be focally present in cerebral aneurysms (Bruno et al. 1998).
  MMP upregulation, especially of MMP-2, -3 and -9, has been observed in intracranial hemorrhage (Fatar et al. 2005).
  MMP-9 is correlated with cerebral edema (Fatar et al. 2005).
  MMP-2 and 9 seem to be involved in different types of dementia (Rosenberg et al. 2001; Adair et al. 2004)
Ocular diseases—MOSTLY MMP-2 and MMP-9
  MMP-2 and -9 are expressed during corneal wound healing as long- and short-term response, respectively (Fini et al. 1992).
Gastrointestinal diseases MOSTLY MMP-1, MMP-3, MMP-7
  High expression of MMP-1 and 3 has been shown in Crohn's disease (Kirkegaard et al. 2004).
  MMP-1, -3, -7, -9, -10, -12 and -14 are overexpressed by different cell types in inflammatory bowel disease (Pender and MacDonald 2004).
  MMP-3 is overexpressed in necrotizing enterocolitis.
  MMP-1 and -3 are increased in peptic and duodenal ulcers (SaarialhoKere et al.1996) while MMP-7 is overexpressed in gastric epithelial cells exposed to *Helicobacter pylori* (Wroblewski et al. 2003)
Oral diseases MOSTLY MMP-8
  Increased presence and activity of collagenases, especially MMP-8, has been known to cause substantial connective tissue destruction leading to periodontitis (Sorsa et al. 2004).

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (23004 sequences)

SEQ ID NO: 1 - protein, 747 aa, Artificial sequence
  E. Coli Wild-type FhuA polypeptide
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 2 - DNA, 2244 bp, Artificial sequence
  E. Coli Wild-type FhuA polynucleotide
atggcgcgttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggcctgctgcaactattgcggcgcgacagtctgctaccggcactaaaaccgatacgccgattcaaaaagtgccacagtctatttctgttgtgaccgccgaagagatggcgctgcatcagccgaagtcggtaaaagaagcgcttagctacacgccgggtgtctctgttggtacgcgtggcgcatccaacacctatgaccacctgatcattcgcggctttgcggcagaaggccaaagccagaataactatctgaatggcctgaagttgcagggcaacttctataacgatgcggtcattgacccgtatatgctggaacgcgctgaaattatgcgtggcccggtttccgtgctttacggtaaaagcagtcctggcggcctgttgaatatggtcagcaagcgtccgaccaccgaaccgctgaaagaagttcagtttaaagccggtactgacagcctgttccagactggttttgactttagcgattcgttggatgatgacggtgtttactcttatcgcctgaccggtcttgcgcgttctgccaatgcccagcagaaagggtcagaagagcagcgttatgctattgcaccggcgttcacctggcgtccggatgataaaaccaattttaccttcctttcttacttccagaacgagccggaaaccggttattacggctggttgccgaaagagggaaccgttgagccgctgccgaacggtaagcgtctgccgacagactttaatgaaggggcgaagaacaacacctattctcgtaatgagaagatggtcggctacagcttcgatcacgaatttaacgacacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacaccctgctgaccggtgtcgactttatgcgtatgcgtaatgacatcaacgcctggtttggttacgacgactctgtgccactgctcaatctgtacaatccggtgaataccgatttcgacttcaatgccaaagatccggcaaactccggcccttaccgcattctgaataaacagaaacaaacgggcgtttatgttcaggatcaggcgcagtgggataaagtgctggtcaccctaggcggtcgttatgactgggcagatcaagaatctcttaaccgcgttgccgggacgaccgataaacgtgatgacaaacagtttacctggcgtggtggtgttaactacctgtttgataatggtgtaacaccttacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatctcactaaaaccaacaacctgatggcggaccctgagggttccttcttctcggttgaaggtggcgagatccgcgcacgtggcgtagaaatcgaagcgaaagcggcgctgtcggcgagtgttaacgtagtcggttcttatacttacaccgatgcggaatacaccaccgatactacctataaaggcaatacgcctgcacaggtgccaaaacacatggcttcgttgtgggctgactacaccttctttgacggtccgctttcaggtctgacgctgggcaccggtggtcgttatactggctccagttatggtgatccggctaactcctttaaagtgggaagttatacggtcgtggatgcgttagtacgttatgatctggcgcgagtcggcatggctggctccaacgtggcgctgcatgttaacaacctgttcgatcgtgaatacgtcgccagctgctttaacacttatggctgcttctggggcgcagaacgtcaggtcgttgcaaccgcaaccttccgtttctaa

SEQ ID NO: 3 - protein, 756 aa, Artificial sequence
  E. Coli Wild-type FhuA polypeptide inserted with a histidine tag
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPSHHHHHHGSVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 4 - DNA, 2275 bp, Artificial sequence
  E. Coli Wild-type FhuA polynucleotide inserted with a histidine tag
atggcgcgttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggcctgctgcaactattgcggcgcgacagtctgctaccggcactaaaaccgatacgccgattcaaaaagtgccacagtctatttctgttgtgaccgccgaagagatggcgctgcatcagccgaagtcggtaaaagaagcgcttagctacacgccgggtgtctctgttggtacgcgtggcgcatccaacacctatgaccacctgatcattcgcggctttgcggcagaaggccaaagccagaataactatctgaatggcctgaagttgcagggcaacttctataacgatgcggtcattgacccgtatatgctggaacgcgctgaaattatgcgtggcccggtttccgtgctttacggtaaaagcagtcctggcggcctgttgaatatggtcagcaagcgtccgaccaccgaaccgctgaaagaagttcagtttaaagccggtactgacagcctgttccagactggttttgactttagcgattcgttggatgatgacggtgtttactcttatcgcctgaccggtcttgcgcgttctgccaatgcccagcagaaagggtcagaagagcagcgttatgctattgcaccggcgttcacctggcgtccggatgataaaaccaattttaccttcctttcttacttccagaacgagccggaaaccggttattacggctggttgccgaaagagggaaccgttgagccgctgccgaacggtaagcgtctgccgacagactttaatgaaggggcgaagaacaacacctattctcgtaatgagaagatggtcggctacagcttcgatcacgaatttaacgacacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacaccctgctgaccggtgtcgactttatgcgtatgcgtaatgacatcaacgcctggtttggttacgacgactctgtgccactgctcaatctgtacaatccgtctcatcatcatcatcatcatggcagcgtgaataccgatttcgacttcaatgccaaagatccggcaaactccggcccttaccgcattctgaataaacagaaacaaacgggcgtttatgttcaggatcaggcgcagtgggataaagtgctggtcaccctaggcggtcgttatgactgggcagatcaagaatctcttaaccgcgttgccgggacgaccgataaacgtgatgacaaacagtttacctggcgtggtggtgttaactacctgtttgataatggtgtaacaccttacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatctcactaaaaccaacaacctgatggcggaccctgagggttccttcttctcggttgaaggtggcgagatccgcgcacgtggcgtagaaatcgaagcgaaagcggcgctgtcggcgagtgttaacgtagtcggttcttatacttacaccgatgcggaatacaccaccgatactacctataaaggcaatacgcctgcacaggtgccaaaacacatggcttcgttgtgggctgactacaccttctttgacggtccgctttcaggtctgacgctgggcaccggtggtcgttatactggctccagttatggtgatccggctaactcctttaaagtgggaagttatacggtcgtggatgcgttagtacgttatgatctggcgcgagtcggcatggctggctccaacgtggcgctgcatgttaacaacctgttcgatcgtgaatacgtcgccagctgctttaacacttatggctgcttctggggcgcagaacgtcaggtcgttgcaaccgcaaccttccgtttctaataac

SEQ ID NO: 5 - protein, 756 aa, Artificial sequence
  E. Coli  FhuA 7/10-1 polypeptide inserted with a histidine tag
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGIVVLALVQGNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPVPLALRVPLSLQEGAKNNTYSRNEKMVGYSFDHEFNDTFTVRQNLRFAENKTSQNSVYGYGVCSVPLSLTAGQCAALVPLSLVLGLARKYVVDDEKLQNFSVDTQLQSKFATGDIDHTLLTGVDFMRMRNDINAWFGYDDSVPLSLVYGPSHHHHHHGSVNTDFDFNAKDPANSVPLSLTQGQKQTGVYVQDQAQWDKVLVTLGGRYDWADQESLNGGAGTTDKRDDKQFTWRGGVNYLFDNGVTPYFSYSESFEPSSQVGKDGNIFAPSKGKQYEVGVKYVPEDRPIVVTGAVYNLTKTNGLMADPEGSFIVVASLVLGARGVEIEAKAALSASVNVVGSYTYTDAEYTTSTTYKGSVPYSLVQGMASLWADYTFFDGPLSGLTLGTGGRYTGSSGSDPLSLKQGGSYTVVDALVRYDLARVGMAGSNVALHVNNLFDREYVASCFNTYGCFWGAERQVVATATFRF

SEQ ID NO: 6 - DNA, 2271 bp, Artificial sequence
  E. Coli  FhuA 7/10-1 polynucleotide inserted with a histidine tag
atggcgcgtagcaaaaccgcgcagccgaaacatagcctgcgtaaaattgcagtggtggtggcaaccgcagtgagcggtatgagcgtgtatgcacaggcagcagtggaaccgaaagaagataccattaccgtgaccgcagcaccggcgccgcaggaaagcgcatggggtccggcagcaaccattgcagcacgtcagagcgcgaccggcaccaaaaccgataccccgattcagaaagtgccgcagagcattagcgtggtgaccgcggaagaaatggcgctgcatcagccgaaaagcgtgaaagaagcgctgagctataccccgggcgtgagcgtgggcacccgtggcgcgagcaacacctatgatcatctgattattcgtggcattgtggtgctggcgctggtgcagggcaactatctgaacggcctgaaactgcagggcaacttttataacgatgcggtgattgatccgtatatgctggaacgtgcggaaattatgcgtggccctgtgagcgtgctgtatggcaaaagcagcccaggtggactgctgaacatggttagcaaacgtccgaccaccgaaccgctgaaagaagtgcagtttaaagcgggcaccgatagcctgtttcagaccggctttgattttagcgatagcctggatgatgatggcgtgtatagctatcgtctgaccggcctggcgcgtagcgcgaacgcgcagcagaaaggcagcgaagaacagcgttatgcgattgcgccggcgtttacctggcgtccggatgataaaaccaactttacctttctgagctattttcagaacgaaccggaaaccggctattatggttggctgccgaaagaaggcaccgtggaaccggtgccgctggcactgcgtgtgccgctgagcctgcaggaaggcgcgaaaaacaacacctatagccgtaacgaaaaaatggtgggctatagctttgatcatgaatttaacgatacctttaccgtgcgtcagaacctgcgttttgcggaaaacaaaaccagccagaacagcgtgtatggctatggcgtgtgcagcgtgccgctgagcctgaccgcaggccagtgcgcagcactggtgccgctgagcctggtgctgggtctggcacgtaaatatgtggtggatgatgaaaaactgcagaactttagcgtggatacccagctgcagagcaaatttgcgaccggcgatattgatcataccctgctgaccggcgtggattttatgcgtatgcgtaacgatattaacgcgtggtttggctatgatgatagcgtgccgctgagcctggtttatggcccgagccatcatcatcatcatcatggcagcgtgaacaccgattttgattttaacgcgaaagatccggcgaacagcgtgccgctgagcctgacacagggccagaaacagaccggcgtgtatgtgcaggatcaggcgcagtgggataaagtgctggtgaccctgggcggccgttatgattgggcggatcaggaaagcctgaacggtggagcaggcaccaccgataaacgtgatgataaacagtttacctggcgtggcggcgtgaactatctgtttgataacggcgtgaccccgtattttagctatagcgaatctttcgaaccgagcagccaagtgggcaaagatggcaacatttttgcgccgagcaaaggcaaacagtatgaagtgggcgtgaaatatgtgccggaagatcgtccgattgtggtgaccggcgcggtgtataacctgaccaaaaccaacggcctgatggcggatccggaaggcagctttattgtggtggcgagcctggtgctgggcgcgcgtggcgtggaaattgaagcgaaagcggcgctgagcgcgagcgtgaacgtggtgggcagctatacctataccgatgcggaatataccaccagcaccacctataaaggcagcgtgccgtatagcctggtgcagggcatggcgagcctgtgggcggattatacctttttcgatggtccgctgagcggtctgaccctgggcaccggcggccgttataccggtagcagcggtagcgatccgctgagcctgaaacagggcggcagctataccgtggtggatgcgctggtgcgttatgatctggcgcgtgtgggcatggcgggcagcaacgtggcgctgcatgtgaacaacctgtttgatcgtgaatatgtggcgagctgctttaacacctatggctgcttttggggcgcggaacgtcaggtggtggcgaccgcgacctttcgtttttaa

SEQ ID NO: 7 - protein, 747 aa, Artificial sequence; identical to SEQ ID NO: 1
  E. Coli  FhuA 7/10-1 polypeptide

SEQ ID NO: 8 - DNA, 2244 bp, Artificial sequence; identical to SEQ ID NO: 2
  E. Coli  FhuA 7/10-1 polynucleotide

SEQ ID NO: 9 - protein, 443 aa, Artificial sequence
  WT eOPRD polypeptide
MKVMKWSAIALAVSAGSTQFAVADAFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSIL

SEQ ID NO: 10 - DNA, 1332 bp, Artificial sequence
  WT eOPRD polynucleotide
atgaaagtgatgaagtggagcgccattgcactggcggtttccgcaggtagcactcagttcgccgtggccgacgcattcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgtaa

SEQ ID NO: 11 - protein, 463 aa, Artificial sequence
  OprD-D15 signal peptide
MRYIRQLCCVSLLCLSGSAAAANVRLQHHHHHHHENLYFQGLEDAFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSIL

SEQ ID NO: 12 - DNA, 1392 bp, Artificial sequence
  OprD-D15 signal peptide
atgcgctatatccgacagttatgctgtgtaagcttactctgcttaagcggatctgccgccgccgcgaacgtccgtctacagcaccatcaccatcaccatcacgaaaatttatattttcaaggtctcgaggacgcattcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctagaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgtaa

SEQ ID NO: 13 - protein, 463 aa, Artificial sequence
  OprD-D15-mutPL2b
MRYIRQLCCVSLLCLSGSAAAANVRLQHHHHHHHENLYFQGLEDAFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVAYSLTAGGEDGKHHETNLEAKYVVQSGPAKDLSFRIRQAWHRANADQGEGDQNEFRLIVDYPLSIL

SEQ ID NO: 14 - DNA, 1392 bp, Artificial sequence
  OprD-D15-mutPL2b
atgcgctatatccgacagttatgctgtgtaagcttactctgcttaagcggatctgccgccgccgcgaacgtccgtctacagcaccatcaccatcaccatcacgaaaatttatattttcaaggtctcgaggacgcattcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctagaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgttgcatatagcctgactgcgggtggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgtaa

SEQ ID NO: 15 - protein, 463 aa, Artificial sequence
  OprD-D15-mutLa3
MRYIRQLCCVSLLCLSGSAAAANVRLQHHHHHHHENLYFQGLEDAFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKRPLSLKAGGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSIL

SEQ ID NO: 16 - DNA, 1392 bp, Artificial sequence
  OprD-D15-mutLa3
atgcgctatatccgacagttatgctgtgtaagcttactctgcttaagcggatctgccgccgccgcgaacgtccgtctacagcaccatcaccatcaccatcacgaaaatttatattttcaaggtctcgaggacgcattcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctagaggcaggccacttcaccgagggcaaacgtcctctgtctctgaaagcgggcggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgtaa

SEQ ID NO: 17 - protein, 5 aa, Artificial sequence
  Caspase 1 prefered cleavage sequence
  misc_feature (4)..(5): Cleavage site
YVAIX

SEQ ID NO: 18 - protein, 4 aa, Artificial sequence
  tPA prefered cleavage sequence
  misc_feature (3)..(4): Cleavage site
FGRX

SEQ ID NO: 19 - protein, 10 aa, Artificial sequence
  MMP14 prefered cleavage sequence
  misc_feature (5)..(6): cleavage site
GGPLGLYAGG

SEQ ID NO: 20 - protein, 7 aa, Artificial sequence
  HK2 prefered cleavage sequence
  misc_feature (6)..(7): cleavage site
GKAFRRX

SEQ ID NO: 21 - protein, 6 aa, Artificial sequence
  Thrombin prefered cleavage sequence
  misc_feature (4)..(5): cleavage site
LVPRGS

SEQ ID NO: 22 - protein, 6 aa, Artificial sequence
  uPA prefered cleavage sequence
  misc_feature (3)..(4): cleavage site
SGRSAQ

SEQ ID NO: 23 - protein, 10 aa, Artificial sequence
  Exemplary gelatinase inhibitor peptide
  misc_feature (1)..(10): Cyclic peptide
CTTHWGFTLC

SEQ ID NO: 24 - protein, 1011 aa, Escherichia coli str. K-12
MLILIMFSLPLKAQNGRVSGCITDSDGLPVIGASILVKGTTNGIISDLDGIYVLENVPMESTLIYSFVGYDTQNIVYKGQSTIDVQLKTSAIALDEVVAIGYEVKKKSVVTGAISSIDSDDLLQSKPANAVNALSGRVSGVNVVTNSGQPGSAPKLVIRGVGTNGNSNPLFVIDGLPMDDMNSVNPNDIESMEVLKDATSAAIYGARAANGVVLITTKKGKKGKTSLAYDGYYGFSTVAKKPTMLNDEQYIMLMKEFADNDDMPLAGGVPTAPTGYNTDWFNEILNTAPVTEHNITANFGSDKGSSLLSLNYLDQNGIIGEDASFYKRFSTRLNSSYSINDFLSVGANVNYAYIENSGVATGINGYNPISYAYNIDPTTPVYDENSNDTFGYGVSPVPYSRMWNPIAFMDEAPKNKNITQQFFGNVYAEITFIKDLVFRTDFGINHRNFRGRMFAPKFFHSAECKEDNSRVEQSTNANSSWQWENTLRYKKSFGEHSTSVLLGTSASRDVYEFMTGTRNKYPNEAMTNENYWYLNAGDVMTSANSGGANPRHSMFSYFARLSYNYAEKYMAEVVVRRDGSSNFGPNNRYATFPGVSLGWNVSNEKFWKIKNFDVFKLRFSWGQNGNERISPFSYTSIIGNNYNYTFGNAITVGSAPNNLVNPDVKWETSEQFNVGADMTFYNGMIRASFDWFKKSTKDLLFQPTVEAIRGNNAAFRNLGNITNQGVEMQMTFNKNWNEINFSISANASYLKNEVVKIGNANGYTDGGSWRTSVNVTRMEEGHAMGYFRLYKNLGIFQNEEQIQNYKSKDGKVIQPDAVPGDFIWQDTNNDGQITDEDRTDCGNPWPKWTFGLNLGADWRGIDMTIFLTGKAGYKVFSDIYRQEAYGRSNLPSFYLDRWRKEGDDNGVPRLSSKDPNGNFGKPSDFYLYDGSHLKISSLEVGYSFPTKLINKLMLNKARIYAAIDNLATFTSYPFMDPEVGNMAGGNILSTGIDYGTYPQARTFRFGLSLNF

SEQ ID NO: 25 - protein, 167 aa, Escherichia coli str. K-12
MPGNSPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERYNLNLRQHLARLGRKSLSFSKSVELHDKVIGHYLNIKHYQ

SEQ ID NO: 26 - protein, 987 aa, Escherichia coli K12
MNDSRKVRFDRLAMGVSLLAIGIACQPALAQDDVVAQNEDDAIVVTGIRASLEQAQNIKRNAQGVVDAISAEDIGKFPDTNLAESLQRITGVSIDRASGEGSTVTVRGFGPEFNLVVVNGRQMPTSTLGDGFSAPSTRSFDFGNLAAEGVAGVEVYKSGRASLPTGGIGSVINIKLPRPLDRPGLNGSIGVKGVYDTSQLYGTDVTPEISGIISKTFADDRIGILLAGSYQKRNGGQAQFTVGNWRPGYTGAENNWGTLAQPGDPRFANIENRPGPTDIYQVPQNAAYDFYDFQRERINGQAVLQFKPTDSLDVSLDYIFAQNTFDSRQSSIGVWFNHNDTSSSWTNGPAAGANFYAENFAAAEGKDLAITGAVGSNRNINHSFGGNIKWEGPWGLRLELDGHHSTAESKPTSPYGSGIAVGTAIFGVASQRVDFTTDMPVISVAMHPGSEIAAENIRPAGNAFRNAYMKDTIDQVSLRGGFDFDASFIESLDFGASYLENDVRTAFGVIQNDTWGGTLSAADTPDSLFTPRALSPDLSGMSGSRDPAIIPTYFLIDTAGLISLLDDRLGICDAAPGDTCLAPYSTDRRILEKSITPWVQSFHSFDLGDARANLRLGLRYEKTKVTSRALAEIPTGTVWVAQNEISLVKTPGTDFTTLKGEYDNWLPAIDFDLSPFENVKLRASYSHTITRPDYASMQGGITLAQPLRVGAGGSQASAGNPALLPYKSKNVDLSAEWYYDRASYVSVGFFNKKVSNFIANDTTQTPLFDLPDPSQGAAATAARQALGPNASFDQIVAWVQANRPADYVAGVGTAGGVAGRAGDPNVIFTFTQPSNSDQQARLWGWEFAIQHNFWDTGFGAILNYTVVNSDTGFDNTLPWTTTQFAVPGASDSANAVLYYDKNGLQARIAYNWRDRFLAGKDQDPYYIKSYGQFDASLSYEFKKGLTAFVEGINITNADRTGVRRNDRAIFFAAPGYARYSAGIRFTF

SEQ ID NO: 27 - protein, 710 aa, Escherichia coli str. K-12
MNTFRKKKLSIAILSILLSYSVYAEDVTTLGVITVEGHNPEDYQPTSTSTATGIELAPVDTPRNVTAIDSKSLEDLQATSLHNALKIDTSVQERHNSDGMESFAIRGFRLDSGYGYFRDGEQKDSMLQEPSELYEQIEVLKGPTGLFFGKGSPGGIINMITKKPQGKSTTSFSQNIGSNNTYRSVFDTTGSATDKLRYRFIGSKQTKDNWRKYKDGNHPSTDRDLLALMLDYDLSENTMLSLNFDTKNQNGYSDHGLIFDKKGNQFNDKDLILDAPWAKNTKTEDVYGMKLTHYLNDAWQVSASYHHTDIHIAGYNSQISLDDDSIETGNYKIKPTYSQRHYDIHTAAINLTGEFTTKGIEHQLITGVNLRDHTLTTLSSDNDDAIIYDASINHSFPIPDFNISDLGSFKSGNTYPRQSYGIYVQDIMTFNPEWQLMAGLRYDQYHRDKTTNDKKEGTGKNIVINSIVPNISLMYHPYDNSTIYLSYAEGFEPQDPITDPLDVNYGKIPDPITSKLYEVGFKSKLFNDRTLLTTSIFHLREDDRGVTEKLPDNSEYEQITLLNASQIHTGADFSITGQISNKLKVITSAQYIIGKYESNPTLDGKTPKELPRFSASLLTSYDLTDSIELHNSIYYVGSRFGDNDNKAKKDAYTKIDSGLAYHVPINSKQDLSVMFNVNNILDKKYVDTGDYNGMTPGEGRNYMLSLKYDI

SEQ ID NO: 28 - protein, 798 aa, Escherichia coli str. K-12
MINRTSQQFLLSTIAVLVSSQLWAADAPAQEETKKDALGLERITVTGVARGTRVMDSSVSVSSVSLAELEVSTPRSSAEAFRIIPGMKVESTGGEGNANIAVRGLPVASGGAKFLQIQEDGLPILQFGDIAFGNADIFLRLDSTVQTIESIRGGSASTAASNAPGGIINVISKTGSSDAGSVSTTFGLDYDTFRTDFEYGTSINDSLRFHVGGFVRTGEGPRQAGYDANKGGQVKANITKEFDSGYVRLYFKHLDDKSIGYLPMPMYSDGSSVPGFNAKSDAIQSAYFLSTLSLGADGERRRGDMRDGMNPEVNSVGLEASFDLGNDWQVENRFRFSDVSGNFMAPFPAEVANGADIAASIAGTGAKLIYANGPDAGNPMDGLAMRIHTFDVKMNDFGSIVNDLKLTKTFDDTSVTLGYYNATQNINMTWMWNSYLMEVKGDNAALLDVVAADGTAYSDAGLYGYGVPYWGNCCQRNYDTEYNIKAPYLAVASSFGDLSLDASVRYDSGDASGYYAGNVQSQVDMNLDGVISIPEQSVSSIDNANPQPVNYDWSYTSYSLGANYQFDSDLAAFGRLSHGGRANADRLLFGKVRADGSVAKEDAVDNVDQYELGVKYRYDDLSVFATAFYSETEEQNFEATSQRFFDRKYKAKGIEIESAYFIGDFDFRGNVTWTDAEIAKDALTPDVVGNTPRRQADFIYSLMGRYNFDQGSVGINLIGTTDSYAQDNNDLKFDGYNQVNAFATYNLTQALSVSLNVNNLFDATGITEAEEGSIPDNNIIRARTINGRTTSATLRYEF

SEQ ID NO: 29 - protein, 1115 aa, Escherichia coli str. K-12
MKNVSYYRHLHPESLKKLVAITKITAVSLLTVLPSTMQAEPTYSQSVVISIKTERMLLTDLFSQIEKQSEFLFFYVDKDVADIKVNIKANSNQIDEILTQALTGTGLTYTINDRNINIMRKAYARQQQAKQITGKVLDNNGDPIIGANVVEKGTTNGSITDVEGLFNISIAPGAILSISYIGYKPTEIKVGSQNSYNITLEEDSETLDEVVVIGYGTARKIDLTGSTSSLGGDKLRMKSTPQLSSQLQGQMAGVQITRSSGDPSAGATIRVRGVTTMSTNDPLVIVDGVPGTLTDIAPEDVKDIQVLKDAASAAIYGSRAAAGVILVTTKRAKNKEFHLSYNGEYGINTPTAKPKFANAVQWMSGLNELAFNDGASSLHSLYSEDVINNYAQLRAEDPDRYADTDFMDLGLKSSTHHQRHSLSLSGGTEKLKTNFSLNYYNSEALIQTKDYERFNIRTNNDYQINNWIHANVDLNLLYSNANEPHGSIFTLMERAPIYNAYWSDGRFADGKDGDNPIAEHQLGGSMKKQNYSVGGKLQLDITPIEGLTLTAIVAPKYSFYKGKDHRKRYEVYRITGDPIPGVGYASTSLSESRNDNHSLTKQFYANYKMQLKRHSIGLMAGYEDYSYKWEEEGASRTNFNLVNYPYLNLGPEDYQYNSGKAGHNAYRSFFGRIMYSWADRYMLQANIRSDGSPRFADGHRWGTFPSVSAGWVISEEPWFNKSIVDYLKLRGSIGQLGNERLGKEFPYQAILSFGTGFIPNATTGVADVVQTAYQTDYAFNNLTWETTTTYGFGADITLLNNRLRASADYYYKKTTDMLMEVGFPSYFGYNAPQNNAADMNTKGWDLELSWSDQINDFRYGVSFNLSDYRSKMGYMANRQKIDDNKITEEGSYFNEWYGYKSMGIILNDAAMLDENGNTIPVLTNNDKAGNIRYQDIDGDGKITASADRVRLGNSLPEMQYGGSLWAEWKGLDFNLSFQGVGHQLAYWNWPGTPFNYQAYACPVNLIESHWSPTATDAENAKAKYPKLTTNSANIYAKSDFYIFNGAYMRIKNITLGYTLPSEFTKKFFVNKLRVYFSANDLPAFSKYPEGFDPEWGDRAKDLIMSSYIFGLNVSF

SEQ ID NO: 30 - protein, 1029 aa, Escherichia coli str. K-12
MKKRIMLTLVCLLAAIGWVAAQNSPITGIVISAEDNEPIIGASVLVKGSTTGAVTDLDGKFTITDAPAGAKILQVSFVGMITQEVPITPGTIRVTLKNDAKLLDEVVVTALGIAKKEKSLTYSTQVVNGDELARVKDPNMMNALAGKTAGVQINKSSSGLGGSSKVIIRGNRSVSGSNQPLYVIDGVPFGSSTNENTSTTIGGDNDSGNYDRGDGISNLNPDDIESMNILKGPAAAALYGSSAANGVVIITTKKGKEGRASISFNTSTTFDIAAYGIPEFQNHYTGVSTSWGSDIKGSPDYTDDFFKTGVTTINSLSLSMGSQAMQTYFSYANTYGKGVVEGNSLVKHNFNFRETANFLNNKLTVDANINAMYQRGNNRTTSGGYYMNPLVGLYHFPRGGVEGGKDFNYYKDNYQILNAGRNIMDQNWYKSQGTDMEQNPYWLINKVPNEDTRYRTLLNLSVKYKFNDLFSIQARGSADYVVDKNNTRMYAGTSPVLCGMNPAGTGTNGRYIYGESSSLSSYGDVLFTYQQQFTNFSVNASVGASINDYTGNGTGFDSYPGILSVPNVFTMQNCSLNKGSLTDWKTHTQSQSVFFTGQVGFKDQIYVDVTARNDWTSTLAFTKYKNKGFFYPSVGVTWLLNETLKLPSWIDLGKIRGAWSKVGNGLNTYTSNPLNSITKSGSINFNSTAPFAELKPEMTTSIEFGTEWRFFNSRLEFDFTYYKTNTKNQLFTLDAPSGSQYARYYINAGDIQNTGVEVMLNGTPVMTKDFRWKTGVNFATNKNEAKALAGDDFGYFTFSGGESNNVWSRLEVGGSFGDIYGTTFVRDEKGNIQYEPAKEGQKDSDRLPLVDKTNPVKLGNSTPDFNLGWSNTITWKDFSLYFLIDGRFGGEVMSLTEADLDQQGVSKATGDARDRGYVMLEGRQITDVEGFYNQVGGRAGVTEHYMYSATNIRLRELSIGYSLPQAWLAKTGVIKNAQVSLVGRNLFFFKNNAPYDPDGMLSTSNRLQGVDVFGMPTNRSIGFNLKVNF

SEQ ID NO: 31 - protein, 208 aa, Escherichia coli str. K-12
MLKKALGVAILAASCAASAQAADFSYRRQAAQPYTVNQPLNGFSWAGPYLGANLGYNWGSVSNSGTNPTGFAGGVQGGYNWQFGSPWVFGLEADIQATGADDTFAAWKFSNPWYGTVRGRVGYALNPNFMLYGTGGLAFGELKGSTPFYSASHVSAGWTVGAGAEFALNNAWSLKAEYLYVDLDSSNINGLPNGYNFSTVRVGVNYHF

SEQ ID NO: 32 - protein, 634 aa, Escherichia coli str. K-12
MRRILRVCPALLFALAAGQVHAKLPEVIVDPGGVPPAALQAINSAVDAIARLSEDQDGGEIDRLRRRARDATLAALATQGYFTPTVTLTPGTDVGGETWDIAIEPGPRARVASVDLKFTGRVARPEYAARIQKWRDDWALKAGQPFINGDWNKAKSGLLDAVSTRDFLLAHMTHSLAEVDAETAQVRLSVEIDSGPAVRMGALQTDGLQRVPESLVRRYVKYSEGAAYDQDKLDQWQQELQSTAFFRGAFVTLDQGARGGQDDVKVTAPGASARAPGSSGLASVAPAGDAEVAGGPTAAAPVLDSQGEITLPVDVRVVEAPPKRLAVSLGVDDEAGVRFETIYRQNVVFGQPVTMETGLGVDRLRQRAYLDFNLPPDERGRKDSFGLLFDHSDVQELDVTRYALGVTRLQERKGAGDSRVEYETRWGGLLAHDHVKIDGGDEYDLPTATLTAEWLRRDVNSKYDPREGNLIAVGGGVGATLDDGQPYMRLRLRGQKWWPIGKLDVLTLRGEVGRLWSNGRTRVPDDFGFRTGGARSIRGYRYQSIGVEQDDAIVGAPTLAVASVEYDHYFNERWGIGVFVDAGDAAESFGDMDIAVGYGVGARVRTPAGPLFLDVAYGQRERDLRLHFSLGIAF

SEQ ID NO: 33 - protein, 425 aa, Escherichia coli str. K-12
MIYYSAQLFSIKTITYLSDTGCLEIQGASLAVNNGSQVNVTDSSLVSDTIGLINGSSLNIGANGVVATDHLTVDSYSTVNLTESTGWNNYSNLYTNTITVTNGGVLDVNVDQFDTEAFRTDKLELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGKVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYEPGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 34 - protein, 618 aa, Escherichia coli str. K-12
MISVSYSKRISKTALLGVVAGLGASLALAQDESGLVIELPELYVTSSHTATVEPASTFGAPVSRLELNPQFDLQVRNIAEAQGDVSIRGGIFENTGFRVGAATLIDPQTGHYFAEIPIAPEMLRGPGLLVAGDNAFGGFNSTVGTVDYSWMEIAEGGSVAVGFGDNSLNFQRFHQAKVLSESADASWGVEIEISRSEGAGSIENGDHNFVRYSSRLQRLANDSQTDLFAGYQSKYLAWPELYAAPYGSNESDSVRTTLLMFNHAQSYGGDSKWEATAYHRRHHDHYLFNRASLDNRSFVHQTEVSAAAVNGAHVLSDVVTLNYMAQLTADEIESTNLENNFTSRSYAKLSVLPEFLISENGERRVSLRAGASFDDSNRNASKLSPIADVTWTNGDDSYYFSLSQTSQVSGYTAVGGSTGGLFASNPDLVREVTRNVEVGATLKRSDWSLSAAGFVREDADLVDWTYSFGSPNARSARNVDIDTYGVEIIASRRFGELELLGSATLLDKDEDYGDASVDASFYALNYAKVRLTAAAVWRATDLIQVRLDNEYRQQRESVLREGDDTAFFSHVGIYYTVPEVEGLELSASVENLWEDDFQEIPGTPGRGRQFSVGARWGW

SEQ ID NO: 35 - protein, 192 aa, Escherichia coli str. K-12
MSPWQITTLNVAGGLQFGSINSNSRFDQQFDRQNYSHIGNKNMGGIYLNGGYSFDNSLFIDGRLSSLANDNRGSADAVLGLGYYFAFTPDIDFYTVVGASRHALVFDASKDGKKTNTYNSASGEIGVKTKLSPDIGVNIAYRLANYDKRAFHEARIMADYALTQKLAAEVGYTYHNWRVSDQAMQVGLRYNF

SEQ ID NO: 36 - protein, 720 aa, Escherichia coli str. K-12
MFEMHSSFSRVSSARAAQSLSVRLSPLALACAFICLPAQAQTQTPTPTPTPPSTALPEVQVTGQAERIGQQLAQPARSASHTGVSNQEVPASVDGVSAEQMQERGDYALVDAVTRTVGLTASSTPGNGGLAFSSRGFAGVNSVGVAEDGMVLGVAAGTTAYPGDSWGYERIDVLRGPASLMYGSGTMGATVNAIRKQPSRTSSAEVLVGAGTDDTLRLGLGVTGALGAYASYRIDSYTARSAGERDLDQSRNGKFMSTLRLEPTSDLQIDLIADRSVQKPSRYWGTPGLDGKVVESLRDRNYNAEDSVLRYADERLRAKVQWKANDWLTVRNELYHVKSDRHWRNIEAYALNPATWTVGRSDYLEILHDLEQTGNRLGLNVDRGSHKIAMGWEAARINLRLSNNSPYGGSSTVSAWDPVHGSWASPDLTAAKTETGVTQHALYLEDAWRISNRWLAMAGLRRDVYDFASHSLVGGTDFDKTLAATSWRLGLTYELARNTHVYGQISSGHDPVNSLVSLNLANTAYKLSKGRQAEIGIKQQVAGGRGEWTLAVFDIKKDDIITRDPDRPAISIQGGSQSSRGAQATAAFQATPALRVEGNLSYVDAQFDKLIEAGGNRAGNRPQNVAKTTANLWGHYRVGAWQASLGLRYVGDRFGNNANTVNLPAYTVADAALSWQMDPRTTLSLIGRNLADRVYVGSSYGSQFLVGQGRRFEIAAHIRF

SEQ ID NO: 37 - protein, 354 aa, Escherichia coli K12
MLWKTKRAVALAVAAASGAMSAAAHAQSSVTLYGQVDAWVGAQKGFDSSRAGVVNPGGMSTSYWGLKGSEDLGNGLKSLFALEAFFRPDTGRAGRFDGDNFFARNAFVGLSSNAWGTIKLGRNTPPYFVSTILFNPFIDSYTFSPAVFHTYLGNGLSGAAGISGLVGDSGWNNSILYSTPDFNGLSANLIYGAGEQAGHNGQNKWGGSLLYFHGNFAATAAYQQVRFDANPGDLDTIVAGFRRQDAALLGATYDFGVVKLYGQYQHIKNTISTGDTKANGGQLGVSVPVGAGSILASYAYTKTSGAVDVKRNTWAIGYDYALSKRTDLYAAYFRDKVTSLSTADTFGVGMRAKF

SEQ ID NO: 38 - protein, 742 aa, Escherichia coli str. K-12
MDKNLMKGCVFLSIVGCGIQIGLASNPNPPDVDELLPIIVNADEDNKLPGRSVLKQKNIDQQQADNAADLINILPGVNMAGGFRPGGQTLNINGMGDAEDVRVQLDGATKSFEKYQQGSIFIEPELLRKVTVDKGNYSPQYGNGGFAGTVKFETKDATDFLKENQKIGGLFKYGNNSNNNQKTYSTALVLQNEQKNIDLLLFGSVRNASNYTRPDKSKILFSKNNQKSGLIKVNWQITPEHLLTLFSVYGIHKGWEPWAAKRDVMSRPTETEIKRYGIDVAWKRKLVYRDQKDESYSLKYRYLPENNKWINLSVQLSYSKTEQNDTRHEKVTSSFLGTLGNKSWITYSDLTFDISNTSTLNIGRAEHELLFGLQWLKNKRNTLMYHKEGVKKADYNYGYFQPYYMPSGRQYTHAFYLQDQIKWQNFLFTGGIRYDHINNIGQKNLAPRYNDISAGHDYSQKNYNGWSYYLGLKYDVNHYLSLFTNFSKTWRAPVIDEQYETQYSQASVSATSLNLEKEMINQTRVGGIITLNHLFQENDAFQFRTTYFYNRGKNEIFKTRGVNCVENALDVDNSVCPKIISNYRNLPGYVIQGAELEAYYQSSYLFGGLTYSYVKGKRDTSPRNPWSKTSTWIAETPPRKATATLGFNIPEYYFTAGWRAEFVRKQDRSPLSNDSKASYWALPSSKGYSLHSVFFSWSPTKIKGMNFKVTVDNLFNRPYYPYLGELASGTGRNVKFSLTQQF

SEQ ID NO: 39 - protein, 435 aa, Escherichia coli str. K-12
MTIALAASVGTAAASGFQIREQSAKALGNAMAGASAGAEDASYMAYNPATIGHLPENQLTGNLSYIDPEIRLKHANASTALGTPIQGPTDDGDVNALVPALTAKWRLNEKFDLGLGVYSFWGLKTDYNRAWIGRYHAVDTSLTTVAINPVLAFKPTPQLSVGAGLIAQYANARLTNAIDFGTIGAAQGLPGANPGNQDGFARVTGDDWGFGFNLGALYELTPNTRIGIAYRSKVEHTLKGKASFDPDQAGIANTLGAALGGAFTDTVGKADLTTPATASLGVLHQATKRLALMAEVQWTNWSEFGRLVVKFDNNTPNSVTDNDWQDTWFASIGASYRLTNRWLLRAGLAYDQTPIPDPRHRTPRIPGSDRKWLALGTTYSPVANFDITGSWVHAFLSDADSNLKAGDEGNSARGNLTGTYKVSADVFSLQAAWRF

SEQ ID NO: 40 - protein, 725 aa, Escherichia coli str. K-12
MYKPLFRTVLSIAILSSMFSVAYAEETEQKDTQKLEKIILTAEEQIKQSLGVSVITAEDLERIPVVNDISEYLRKMPGVNLTGNSSTGQRGNNRQIDIRGMGPENTLILIDGKPVTSRNSVRYGWRGERDTRGDSNWVPADAIESIEVIRGPAAARYGNGAMGGVVNIKTKKVTNEAHGTLELYTNQPENSKEGDTNRVSLNLSGPLIKDILSYRIYGNFNKTKNDAVDINPLIPSSGYRAAGREGFENKDLNARFAWQSTDNQTILFDLGSSRQGNLYAGDSQNSNLDPTANAILSELIDKETNTIWKDSYAITHEGKWQWGDSRVIAQFDRTKNKRFAEGTAGAAEGRINNLDNRTTSTLDTIRLNGEVNIPLDIYVPQNLTLGTEWVEDHFKDPGNTTQGTGSYADSLTSGDRSKMNSRIASAYIEDNLKITDSTDFVMGLRFDDHSKSGSNWSPSLNITQRLGDYFTLKGGIARAYKAPNLYQNASGYLLATNGNGCPIGLTQCVLQGNDNLKPETSVNKEIGIQFQKDIVNASLAWFRNDYKDKISSGNEVTQQVTIGGITYNVLQWTNIPKALVQGVEGNISLDWGNISWTNNLTYMVDSVDKQTGNPLSVIPKYTINSILNYQITDKTDVNFVYTMYGRQKPRQYVETNLENSRGIATQSIRSYSIAGINLGYKFTDHMSGRVGISNIFDEDKLRDLSVSQTYNEPGRAYYASLKYQF

SEQ ID NO: 41 - protein, 976 aa, Escherichia coli str. K-12
MKTIFAARTILASALAAALSACGDPLVRSETPTTPTTPTTPTTPTTPTTPTTPTTPTTPTTPTTPTTPTPLPDLDPALAAKFRAHLDVTNTEPAHTLGFTGKGYMIGVVDSGVNPDHVTLQGRVIRNNVYVDYQDPSSPHDVDGHGTTVAQLAAGRPFGDFPGGIAPGATIFSARVFSSAAESAKEDPIGGNFFEGEAAQLKRVNADMIAAGVRIQNNSWGYESDDSNGEPIWTSPIITGLFVNAYRDLVLNNNGLMIFASGNEKQTQPGQLARLPSLPTVEGGASPADLERGWLVVAALDSFDHPDQLTSYSNHCGIAMHYCLAAPGDVITVNSSVTNSSSVSDKYYVEQGGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLVLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGANNAYVTLKRLNVSAAAQALGIVDKVAQASALRVELAFRAIDAQQAQGRGALPTSFIGAAAALQQSSSAAVAAGSLQSLSGQSHVAAAAASLDAIDLGRRSLATRLDAPRSGERIVTWHQALGGPGQNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 42 - protein, 223 aa, Escherichia coli str. K-12
MMTARAAVRRTMCALPFAAVFAAGSACAADLSPRYAAPASAYTAPQPVYSWTGLYAGFNAGYAESGDDAFNNLAGATGGKVKGAVGGVQIGYNYQLSPMFVVGIENDFEGGDIKNHDALNSAAVSLPWYMTGRARAGIATMDSRLLFFGTAGLAAGEFKDGPINKMKMGWTAGGGVEWAFLPKWSAKAEYLYTEFKHDDLPDWNAAKFHTFRVGVNYHFDLFR

SEQ ID NO: 43 - protein, 493 aa, Escherichia coli str. K-12
MTIEGGPKRSQKVVFLQPVLTSLVALLAAGACLSPTVALAQDQLSPDEVAALRSEIATLRAQLQKMEQRLDAVTSAPQTTAPAAPPAIQPPAPVATTVAKASPPPAKPASAPTEITWKGSPQFTSGDRSFKAKGRIQIDVGQVDAPKGLVDRGLGYGAEMRRIRLGGEGDLGAGVGYELELELSDNAVKLVDTFVTYRTGPWLVTVGNHNPFQSLDELTGDTVGAFMERAAFTDAFNFERRLGVSAQYEKGPWVLQGGLFADDIDALSNSSDGPEGGDENNSYGLDGRAVYAPKLGQTQLHLGASAHWRTLKRVTDAGTRYRQRPYVHASNSRLIGTAVLPVEEEVHYGLEAAFVSGRWHGAAETYWQAAELTTGTRPTFFGGYAELGYFLTGDTRGYRGGQFSRTRPSKPLGGGGVGALQLNVRYDYLDLNDRGVVGGKQDAWLAALIWQPLDHLRFHLNYGLLDYQGATPLRNGDRDYRVNVAGARMELDF

SEQ ID NO: 44 - protein, 394 aa, Escherichia coli str. K-12
MSKKLAVHHVVASALVLAASAFSLNALAQSSVQFVGTVDAFAGSLKNSGDAGSKSVVNSSGMETSWWGVKGTENLGGGLQAQFALSSFFRPDTGAQGRFDSDTMFSRDAHVGLSGSFGRVSVGRDLAPNFIPTLTFSPFGGSFAFSPLELHTQTPSGSYRGQVWSPTVAGDTGWSNEIMYVMPKLGGFTTSLFFQFGEQAGKPGKNNYGANTMYEQGPLSFGAYFQSVKVNNPLDSVTSGDSRVFTFTPYNQATGATYTLAASRNDTWFVGGAYDLQFMKLFGTLNYSTNRLIGIANDSQYDLKSNTVQLGTSVPVGKGSVLFSWARTNVKADGDFSAVLGGAGGKSSIIRNTASLGYDYFLSKRTDVYSVVSYDKLTDQSTGISLGVGIRQRF

SEQ ID NO: 45 - protein, 817 aa, Escherichia coli str. K-12
MAGMNKPAGHTCSQFRSHLGCILLLLFCLAPANAQQREATLSVQVLDAAGNAPLEGVQVAIRECRCGGITDRDGRYSRVLPQGSYSVEFFYLGFQGVQRQVDLRESVDLVVRMQEQAEELSEVVLRARRIAENLESPQMGALELEMQEIKKIPMAAGEFDVLRGMTLLPGVNNAGEISNGLSVRGGSLDQNLILYDYAPVFNPTHLFGLFSVFTPEVISQVDLYRANIPARFGGRTSSVLDVKTRNPFPSKFKLNGGVGLVSSRLAIETPLIKDKLNLSLGGRAGFTDFLLPLFSERLDNTRARFHDATMKLLWLAGENDQVALTGFYSWDFYQLDLITRIQDINAANNQYKFRTLNGTLAWTHVLDDSSTLRNILVASDYQPENIFPEAESDNEIRYNSSVRYLSLNSEYQRFVGEGLDWYAGLQAARYRIAPGSLDPGSGNSINPVELQSEHSYEFGAYANLNWSPLENLSLSAGLRLNHFVLVGPFSQPAFDPDTGNLIATTFFEDGAGVKTYNGLEPRLGLNYSLGEFTSVKASYARLNQYLQNLYNTTTPLPTSRWKTSDPLIGPQQSDAFGLGIYQGLADNEMEISLEGYYRASRNNLTYKAGADFFLEPYLQREVIQADGKAYGVELSFRKPEGKVNGWLNYTYARSFLRSNGTGLRERINDNDWYPSEFDRPHVFNSTVNFEGDLYNTWSFNFTLQSGRPYSAPNSVFRYQDIDIPIFLDRNNARLRPYHRLDFSWTVRYGKKLDRRWVGDWTFTIYNVYGRRNPFNLFYSQRQGGEFGDIFLESPLGAYELSVLNSPLFAITYNFSFD

SEQ ID NO: 46 - protein, 710 aa, Escherichia coli str. K-12
MAKRSVAPASISMLGLLVVPAVHAAVQTQAQGSLALPATAVTSAYEQQSYKASESRSAMKIDAPLRDIPQTVNVVPESVIKDQGAQSMEDVLKNVPGIGLSNGDGQRDQVTIRGFSAIGDMYIDGVRDDALYFRDLSNVERVEVIKGPAAVLYGRGSSGGLINSISKKPSFTPKREVGMSFDSEGKRRTQFDTGWADPQSNQAYRVTGAFEDSDTFRDDGYIDRKAIAPSAYFRLSDDLELNLGATYLYDKRLIDFGIPALGNRPVDVDRDKRFGSGDADQDYARSEVFSLTASLDYRINDSFTLTNTSRYYRYDLDRNNTLADSSPTRFVTAPNGELLVKLNRGNVARDEYGVFNQTELKQQAQVAGMQHNLLYGVEVGLQDKYQRVLSQNNVAQVPVYRDALVPVPDHAANLSSKGTNFQQTTGLYLQDMIELNEHWKALVGVRYDIFGQEYDDDRVQNVDLDRTDKTWSPRAGLVYQPDTIQSYYVSVSRSYQPSGEVFAVSPTNQHLEPEETTNYEIGAKWDLLDSRLSLTAAVFRLERTNMKTADPANPNLTVLAGEQRTDGFEATVSGQLSDKWQVYAGYAYLDAEITKSNSKTNGVANEGQTPTLTPRNSANIWLVRTLTPEWRVAAGANYVDERYTALDNVVVMPGYTTFDAALLYSVPQWDAALRLKNAFDRDYYASAHGSVDLVTPGAPRTLEASFNYRF

SEQ ID NO: 47 - protein, 380 aa, Escherichia coli str. K-12
MKKTTLALFTSIFAIPSASAFNLVDNQEYGTKLDFVGSARIMWRNTSDKETDVADGSITREHINHAVQNNGSRFGFKLSQSLTNDFYVLGRVEWRFRGTDNNGVEARSQHNFDHIYTRQLYAGIGHSQYGELTYGNQTVLTDEVKQTDLPNTLSLSDGLLVSGARRTIQYVYTGNNGYTKGLKIGAFYGNRSPRGNNGLSLEEHRKDIWGGGAIQKFEIDEYQELVLSLGTTKERFERANLPVYSRTAYAFGSAYTYDDTTLGLDLERQERKNQDEAGAKRTYKEIRTVLYHKITPDWRAYTMYAYKTEKRNDVDSTDRKDKTHQFMLGSEYYLIPKNTGPISLKTFLEWQATRTKEYRTGELRQKERNYTTVIGLRAYW

SEQ ID NO: 48 - protein, 797 aa, Escherichia coli str. K-12
MAMKKLLIASLLFGSAAAYGADGFVVQDIHFEGLQRVAVGAALLNMPVRVGDTVSDEDIGRTIHALFATGNFEDVRVLRDGNTLIVQVKERPTIASITFSGNKSVKDDMLKQNLEASHVRVGEALDRTMLSNIERGLEDFYYSVGKYNASVKAVVTPLPRNRVDLKLVFAEGVSAKIQQINIVGNKSFSSDELLNRFQLRDDVPWWNLTADQKYQKQKLTGDLEALRSFYLDRGYARFNIDSTQVSLTPDKKGIYVTINMTEGDQYKISGIDLNGNMAGYQSEITKLAAIEPGSLYNGTQVTKMENDIKNLLGRYGYAYPRVMTQPEINDQDKTVKLHVNIDAGNRFYVRKIRFSGNDTTKDSVLRREMRQMERAWLGSDLVELGKERLNRLGYFETVDVETQRIPGSPDQVDVVYKVKERNTGSLNFGVGFGTESGVSFQIGAQQDNWLGTGNAVGINASKNDYSTYAELSFTDPYFTINGVSLGGRVFYNDFRADDAELSGYTNQSYGISGFLGFPINENNSLNFGLNYIHNSLSDMLPQVAMWRYLRSMGEKPDLESKAEFKADDFALTMGWTYNNLDRGFFPTSGVKSTLNGKVTIPGSDNEFYKVTLDTSAYYPINDDRTWVILGRSRLGYGDGLGGKELPFYENFYAGGSSTVRGFRSNNIGPKAIYLYKDGSPKKESPSRDAVGGNAMAVASLELITPTPFLDSKYSNSVRTSFFIDSGTVWDTDWNDSAVMKSKGIPDYSKPGNIRVSAGIALQWMSPLGPLVFSYAKPIKDYEGDRSEQFQFNIGKTW

SEQ ID NO: 49 - protein, 415 aa, Escherichia coli str. K-12
MKKWHLAALLFCLIPLNLFAAQSNQAAQTGRFFVNPMVGIIDMESSSYDPELNYSLGGGYNYNANLSSEILATYAEDKSGSDSDVYSISIGGIYHLIPEESLVPYLVAGLGLLTVDEDGEDNDHHGQLNYGAGLKYFLSDDFAVNTEVRHMLATSGESNNLLASAGLVYYFGGQKPAPAPLDSDGDGVIDADDQCPNTPAGVTVNSMGCPLDTDGDGVYDYLDKCPGTPAGVAVDGKGCPLDTDGDGVYDYLDKCPGTPKGVAVDAVGCPLPMDSDGDGVYDDVDRCPNSPAGAHVDEYGCQLVLTLLIEFDTNKADIRPQHIQDMTNAAAFINKYPGEKILISGHTDSDGSEAYNQQLSQRRADAVKAYLIQNYAIDGTNLTAKGFGESQPIADNTTAAGKQKNRRVELSLFNN

SEQ ID NO: 50 - protein, 90 aa, Escherichia coli str. K-12
MAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 51 - protein, 347 aa, Escherichia coli str. K-12
MKATQWMAMGVALAAGNAAAGTMQLFGVVDASIEYAKGSDSVVRMREGQQAASRWGIRGIEDLGGGLKANFLVESGFNIDTGTEFFGNNRLFGRQAYLGLSGNWGEFRLGRQYTPSFYALLRLDPFLLNGAVSPFNLLSATASQGTGHVAYGARFDNAVQYFSPKWGGFSFGAAVAPGEVPGSARSGLNFGMNATYEAGNVYAFYSYQGMYSGANVPVEPTLTSNHFVGGSYRFKPVEIGLLYSAASSDRPETRSARHYGVTFSWNVTQRDTFKAAALKRQILGGGQRPLAVTLGWDHDLSKRTTAYVRAVLVHNSPGGSVSNNSIVIDPGSGDDAKSVSVGLRHRF

SEQ ID NO: 52 - protein, 208 aa, Escherichia coli str. K-12
MSGLLGSVTTATLAAGEDWRLRVGPGRIAFHEQITLSIGGAPVPGAGAKLSNDTTLLAEIGYRFTPEWSAGLTVGIPPTTDIDGTGSAAAFGRLGEMKYGPLALTGQYQFNAGGRLQPYLGAGAVYYLVMDEKDGAVAGLTVDNAWGSVLQAGADYKLSPTLGLFVDVKKLFLKTTASGSLPALGGAPVKADAKLDPLVIQAGLLLQF

SEQ ID NO: 53 - protein, 672 aa, Escherichia coli str. K-12
MKAIYPLATCLLLPIVSYANETTDIQERIVIIGESMQSPSEWVVDSKQPRQPLPAHDAGDFLKSLAGFSATRKGGASADPLFRGMGAGRLTIVNDGQMLQGGCSSRMDPPTAYITPQSYDSVTIVKGPQTVLFAGSAASIHFEREATFFEVPEFTGYLNATTAQYGRLNTTADLTWGAQPGYVRVNASAATADDYEDGSGNSINSQYERWSGDIDLAWTPSRQHRLMLKLGVSDGEAAYADRSMDGVLFDRESVALNYQWQPDNRSLEELSVNTYFNTIDHVMDNYSLREFTPSMMMPSPTASNPDRYSRGFKIASEWQLPPSGQLKTGLEHNESAHRNRSSKDQFNQPFESLNRVDDAFIEQDGIYAEYRHSIDQEWQLVSGYRLDHWKMTDKRTDIQPMSAPAQSNPTANETRSENLHSGFLRIEKQLKNGYWYAGWGQAERFPDYWEAIGNSRQSPTSESAFYTDAETNQQWDIGLDINTDKWRLDASIFYSRVDDFILLQKGMMMQPDTVRNINARTWGGETTLSYQLTQAWSVSSALAITRGSNKTDDNYLPQQPADELRIGTDYRHNALTYSLLWRLVDKQERTAVNQGNVIGYDIGNSPGYGVLSANIDWKIDPKWQLSLGVDNILDKTYAEHLSRSAASISGYQQIDKVNEPGRTVWLQTNYHF

SEQ ID NO: 54 - protein, 802 aa, Escherichia coli str. K-12
MHRIHKVYRTGPMKKNVLLLLLLGLLTTVSAQPTHRIKGTVIDKASRQPLEFINVLVLGLGRGGVTDAEGHFNIGEVPPGIYRLQASAVGYKTILTPEYIVSTKDLTIQIETEENLTELEGVTVTASPFRRDPESPVGLRIIGLQEIEKSPGANRDISRIVQSYPGVAFSPAGYRNDLIVRGGSPSENRFYLDGVEIPNINHFSTQGASGGPVGIINADLIREVNFYTGAFPTDRGNAMSSVLDFKLRDGDMERNSLKATLGASEVSLASNGHIGKKTSYLVSVRQSYLQFLFDMLGLPFLPTFTDAQFKLKTRFNANNELTILGLGGIDNMKLNTKLDGEKAEYILSYLPKIQQETFTLGAVYRHYAGIHVQSVVVSHSYLNNRNTKYLNNDESSADNLSLKLRSVEQETKFRIENTSTFGNWKINFGANLDYSQYTNTTFQRVYIDEGRTFDYHTYLGMWRWGIFGTINYATTDERFTASLGVRTDANNFSSGMKGMGDQLSPRLSLSYRLTDGLYLSGNAGLYYQLPPYTGLGFKDNNGAWVNKYLRYMSVSQESLGLSWHPGNTFELSAEGFYKQYDKIPFSIADGIPLACKGNDYGVIGNEALSSTAQGRAYGIEILMKWLIAKKLNLASSFTLFKSEYRNNKQSEYIASAWDNRYIFNMSGTYNFPHNWSLGMKISCIGGAPYTPYDVEKSSLVTAWNAQGRPYYDYTKYNTGRLPAFGQLDVRVDKTFYLKRCMLGFYIDLQNVTNSKFKQPDILMSTGVIENPSAPMAEQRYKMKYITQKSGTLMPTLGITFEY

SEQ ID NO: 55 - protein, 774 aa, Escherichia coli str. K-12
MKTLNYSSISTAITLGLASISGLASIRAHADVLEVIEVTAQKRTQSVQEVGISITAFSGDQIDALGYDNAQEVTAMAPGVTAIQPNGPSAFYINIRGVAQNDFSGDHQESPVAVYLDEAYISASSGAGFQLFDIERVEILKGPQGTLFGRNATGGLVHYISRKPTDTFEGYGKVTLGSYNQVLTEGAIGGALTDTLFSRFSFTTNNHDPYINNTLGKDLNNGDDWAARLQFLLEVTDDVEWLVSARRGEQDIDSGFFEHSSARLNPATGLGEHFDGPNLTTSAYQEPDNGVYTGSYDRIGFNKVESQGVTSNLQWDFGDILFTSITDIWSLEKDYIEDSDASPQDYYNFFLQSDVDQFSQELRLNGQSENTRWVTGLYYLDIDGTFANGGEVRGFVDQLAGAGAGTGPVTGGPVTIWTPFDTTTETYSVFAQVEYDVNEQWTVIGGLRWANEEKSIDYSQNYVEIANGSNPSAANIVNPDPLGFGGPLFVFNDDTFDFASLDDDYVTAKAEVDFSPAKGTLFYLSYNRGIKSGGYNAPLDITDFLDGNPETGGPEEMKFDKETLHAYEFGIKHQLNSTTRVNGAVYYYDYDDYQAFRLEGLTTFVFNTGASVSGAELEITSNPIDNLDLLLGVSYVDNNVEDAYQLPNGDLIDRRAVVTPEWNINGLARYGWQLADGELAAQIDFVYMSEHYFQLKNSPVGEQSSYALFNARVSYTSDDGKWVFAGFVDNLLDKEYRVMAFDLAGGPEAGGFGMVENYYGKPRWWGLSATYKFE

SEQ ID NO: 56 - protein, 518 aa, Escherichia coli str. K-12
MTQSQKVRFLAPLSLALSLSFNPVGAEEDGGFMTFGYELGQVVQQVKNPGKIKAEELAGLLNSTTTNNTNINIAGTGGNVAGTLGNLFMNQLGNLIDLYPTLNTSNITQCGTTNSGSSSSGGGAATAAATTSNKPCFQGNLDLYRKMVDSIKTLSQNISKNIFQGNNNTTSQNLSNQLSELNTASVYLTYMNSFLNANNQAGGIFQNNTNQAYGNGVTAQQIAYILKQASITMGPSGDSGAAAAFLDAALAQHVFNSANAGNDLSAKEFTSLVQNIVNNSQNALTLANNANISNSTGYQVSYGGNIDQARSTQLLNNTTNTLAKVSALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSSQLASRPTATKFQFLFDVGLRMNFGILKKDLKSHNQHSIEIGVQIPTIYNTYYKAGGAEVKYFRPYSVYWVYGYAF

SEQ ID NO: 57 - protein, 412 aa, Escherichia coli str. K-12
MTILRSAKVVVAMLPLGWAFGVCAQSSVMLYGIVDPDVVFVSNAQVNKVGGTLHGARQVSLQDATTSAYVGSRFGIRGREDLGGGTSTIFTLENGFSVANGFLGQGGALFGRQAFVGLSNDSLGSLTLGRQYSPVVDFLSPLTTVTQWGGFITAHPDDIDNLGLTVRQNNSVKISSPVWHGWSASAMYGFGGVAGQMARNQVIAAGAGYVGGALRIGVGYLSAYDPNVSMWGNQPNGGGNLVNNIGSFGSETTPQKNPVMAGYASASREQTIGAGASYTLGRATLGAAYTNTRFVGLGSDAGPNPQGYVGSATFNTIEVNGAYRIAPAVSLGASYSYTLTRGPDAIGAHYNQINAGVHYALSKRTDVYMIAVYQRASGVDSLGQSAVASINGMTPSASRQQFVDAIGLAHRF

SEQ ID NO: 58 - protein, 488 aa, Escherichia coli str. K-12
MPGNENSAELLRFLQIPNGTVEEESQFVFDLVLSGDTGFALPGGNVAFAVGFQYRDTNFNSRPINDESNLDINPCFREGDRSCVGTSTEGVGPFIFLGGSRPVDLDQSVYAFFGEVQLPITDRIEAQAAIRFEDYGGAVGSTINPKGSIRFEATDWLTFRGSVGTTFRGPIPSQVAPISVTALQGFTAAGGNFKSLDIFGNPNDLGPETAFTYNIGAIMNVPLGAGNVIFSVDYWSIDLEDRITTTPGDAIASLVGNGQTTGTAPVDCSSPLANLITFSGNTCIQGTTTGLDISRVRTDWVNGPDVKISGLDFALTVNVPLGETADLSFGGNAVWNLDYSFDEFVVQGVVTEEAYDAIGFGNYFRDPNTVPEWRANGFVNVGWEPFNVRYSVTHIDGVTDDRCVTRPAPCFSTSAGPTDFGIESGSYTQHDIALTVDVDLGFVEAQLQAAIKNFTDAEPATAQLPLGFNPFIGNAIGRNYRFGIRTRF

SEQ ID NO: 59 - protein, 446 aa, Escherichia coli str. K-12
MPIHLLSRSPPSPRLFVRSPAMTALAPRRARTRLLCLSLTLALTPLAHAQDATDAFKLKLGYTGEAASMIDGGRKSGDAYAGQLMVGTDVDMDRLFGWNGATVKLYVTNRHGTNLANSSIGNSTSVQEIYGGQGTRLTNFTLLQKLFNDRLELEAGRSVANIHFLGSDLCQYFQGNSACGNPTFVFRTSNFTYWPVSSWAADATAWVTPKVYVHVGAYEVNPVQAQDGQHGLNWSTNDTTGVVVPYAVGYKNKGGDGSMAAMYELGGWQDNSDYTDPLRDRNGNPAVLSGLPYGNKQGRSGLFARFEQQVTNPDPSSTRGLTVFGAILQSTSGQAIEDHFVQLGLVQKGTFASRPQDNIAFVITQQKYSDQAIENLRLARASAGGTGTPADNQIMMELSYGIQVTKQLRIAPNLHYVINPDQFNEPTRTNDLKNALIAGLRIDWNL

SEQ ID NO: 60 - protein, 477 aa, Escherichia coli str. K-12
MKAFTKSILGGAMVATLLGSSAMGAGFQRGTPDTDILFEPGTTSMRWGLTYVDPQRGFDSINGQSGDFGEYVQEYNIPSLAVSVGGENFACSLHYTRSFAAEADYTGSPDGGLPFQNSATQSTDNDDRVFALNQGTTAYSRTRTIDFDSNEFGSTCRASYNSDYGRFSLLGGIFFEDFNFEGSSQGFRSLNANVAPAIAGLPAPTQAAINGAFANGMQIILPTLVRTEVDSGYDAGWRIGAAYEVPEIALRVQAMYRSEVEHDNITGSASVTANNSAFVAIGGEQTSIPLFDSLVSQAGTAASQQIQQANQAGLFTATLSDITSPQYLEIKAQTGIAEGTLLLGSFRWTDWSTNNAVVNSLISPDGTVTSTYQPYQWRDGYTASVGIGRAFNEMVSGAISLGYDRGVSTGAETTYTDLYTVSGGVSLKGADWAELRVGGLVGYWTDGEQKISDGAYFNGKVGDDVVLAGNASLKFTW

SEQ ID NO: 61 - protein, 547 aa, Escherichia coli str. K-12
MRVNLLIAMIIFALIWPVTALRAAVSKTTWADAPAREFVFVENNSDDNFFVTPGGALDPRLTGANRWTGLKYNGSGTIYQQSLGYIDNGYNTGLYTNWKFDMWLENSPVSSPLTGLRCINWYAGCNMTTSLILPQTTDTSGFYGATVTSGGAKWMHGMLSDAFYQYLQQMPVGSSFTMTINACQTSVNYDASSGARCKDQASGNWYVRNVTHTKAANLRLINTHSLAEVFINSDGVPTLGEGNADCRTQTIGSRSGLSCKMVNYTLQTNGLSNTSIHIFPAIANSSLASAVGAYDMQFSLNGSSWKPVSNTAYYYTFNEMKSADSIYVFFSSNFFKQMVNQGISDINTKDLFNFRFQNTTSPESGWYEFSTSNTLIIKPRDFSISIISDEYTQTPSREGYVGSGESALDFGYIVTTSGKTAADEVLIKVTGPAQVIGGRSYCVFSSDDGKAKVPFPATLSFITRNGATKTYDAGCDDSWRDMTDALWLTTPWTDISGEVGQMDKTTVKFSIPMDNAISLRTVDDNGWFGEVSASGEIHVQATWRNIN

SEQ ID NO: 62 - protein, 841 aa, Escherichia coli str. K-12
MPLRRFSPGLKAQFAFGMVFLFVQPDASAADISAQQIGGVIIPQAFSQALQDGMSVPLYIHLAGSQGRQDDQRIGSAFIWLDDGQLRIRKIQLEESEDNASVSEQTRQQLMALANAPFNEALTIPLTDNAQLDLSLRQLLLQLVVKREALGTVLRSRSEDIGQSSVNTLSSNLSYNFGIYNNQLRNGGSNTSSYLSLNNVTALREHHVVLDGSLYGIGSGQQDSELYKAMYERDFAGHRFAGGTLDTWNLQSLGPMTAISAGKIYGLSWGNQASSTIFDSSQSATPVIAFLPAAGEVHLTRDGRLLSVQNFTMGNHEVDTRGLPYGIYDVEVEVIVNGRVISKRTQRVNKLFSRGRGVGAPLAWQVWGGSFHMDRWSENGKKTRPAKESWLAGASTSGSLSTLSWAATGYGYDNQAVGETRLTLPLGGAINVNLQNMLASDSSWSSIGSISATLPGGFSSLWVNQEKTRIGNQLRRSDADNRAIGGTLNLNSLWSKLGTFSISYNDDRRYNSHYYTADYYQNVYSGTFGSLGLRAGIQRYNNGDSNANTGKYIALDLSLPLGNWFSAGMTHQNGYTMANLSARKQFDEGTIRTVGANLSRAISGDTGDDKTLSGGAYAQFDARYASGTLNVNSAADGYVNTNLTANGSVGWQGKNIAASGRTDGNAGVIFNTGLEDDGQISAKINGRIFPLNGKRNYLPLSPYGRYEVELQNSKNSLDSYDIVSGRKSHLTLYPGNVAVIEPEVKQMVTVSGRIRAEDGTLLANARINNHIGRTRTDENGEFVMDVDKKYPTIDFRYSGNKTCEVALELNQARGAVWVGDVVCSGLSSWAAVTQTGEENES

SEQ ID NO: 63 - protein, 1199 aa, Escherichia coli str. K-12
MKKHLLFLLACLFLMTGTVMAKIVKGRVIDSSDKEPIVGASIFVKSTKQGTITDIEGHFSLEIPDNVKTITVSFVGMTTREVAITPGEMTIELTAESQALDEVVVVAYGTQKKSSITGAITQVRNEELLKRPVTSVTSALEGSTPGITVTGNYGSPGSDPTVLIRGIGTVNGSTSPLYVIDGVPYGGNISDLNMEDIETMSILKDAASAALYGNRASNGVILITTKKSKSERIQFNFKTNQGWYERALPEYERTNPFQFMEVEYQNAANAFVHGGGDRTDKQAILNAVNSTLIPDRLYVNIFNKPDDQLFTLDGKMAADASIIDGYAGDLDWFDQATRKGYRSEYQFSGSGATSKSDYYFSLSYLDENGYMKDSGFDRLTGRMAVNIKPVKWLRAGMSINASHQKFQNTSNGVGDGSSSYSNPFYFCRYMAPIYPVHSHYTETGTVYDNAGTPIQVNKGDYVLDGAGNPQWDGGSYIIYDQNGNPQEVITRNQNRDRHVIWESELNDSRTIRNTLNGIGYLDLVLPYGFTATLKANVNTRNSDYYKYENAVIGDARGTVSEDGSISGRNGALAKTLYTYKNWTLQEQLRWNMTYNDRHNIEVLLGHENYSYRYDYTYTSKTNEAFPNRYALSNFSEMASISGYKTRYRTESYLARVQYGYDNRYNIEASFRRDGSSRFAKESRWGNFGSLGANWVFSNEEFMKKYRWLNQGKLRASWGQVGNDSGSGYYAYYGLYGSWTQNSKPAYVVSQNPARDLHWETGESWGAAVEGRLFNRLNLSVEYFDKRNKDLIFSVYAPSSAGGTSTGSSTSTTDRNIGTISNRGWEISADFDIVKSKDWTVSVSANLTTTKNKIVKLPEQNKKKTVYPIDPSGKLGQREDLPVGITSGSYLISEGKSRYDYYTYHWAGVDEMDGQSLYEANLNDYYIVLPDGSQLGGKQKLNDEGELMWDANGNPVQGATELAPENYRLINGKYYVLKTTYAQKKWAGSALPTTYGSFSANIRWKNINISAMFTYSLGGKIYDSPYSSLMTPGQSAGNYHVDLYNNAWRINDRSNAMITTYKNAYDDAYNAAIAAGQTTSEANYAGYYAANKAVDGNGRINPNTNPEINNLTSTDNNAGSDRWLVSRNYLCFKNLNISYTLPKRWTAKVNLSTVRFLFSAENIHLWSARKGMNPMMGIGGGQSNYLVPARVFTFGINATI

SEQ ID NO: 64 - protein, 1002 aa, Escherichia coli str. K-12
MKKKVHYFLTVLALLCIQGMIAQTKTVSGTVTDASDGSPLPGVNVLVQGTTNGAQTDFDGNYSIQASEGDVLLFSYLGMKSQSATVGSSSTINVTMEEDAEALDEVVVTALGIKRKEKTLTYAQQTVGGEELTNTRDVNFVNSISGKAAGVEIRKSSSGPGGSTKIQIRGSKSLNGDSSPLFVIDGIPMVNNKGSQPGLWDGVDQGDGLSQLNPDDIESMSILKGANAAILYGSQGANGVVIITTKSGKEGAATVQFNTGITFESIIDTPELQFRYGSEGGTKESWSTTRGDYDSNYVDDYFETGVNYFNSVSVSGGNEKTQAYFSYANTTSSGVTPMNDYGKNNLTFKQSTKLFNDKVKVTSNILLAQEKTDGRNRAGYYNNPLTGLYWFPRDRNFNDFKNNYSVPNLARNTNEMNWFIADHLQSNPYWLLNEESQEDKTSRVIGSLNIEYDISEEFKFQLRGNYDYAAKEFNNQRNAGGNTTTVPSNGRWRYEKYDDTSVYLDGILTYNETFGEDFTLSALAGGTYQKTTFGNGVAVDTGGSADGLQYANEFYFQNLLPVVQVRSTLDSRVEKQSLFANATFGYKEMLFLDVAGRNDWASTLALTGNDSYFYPSFGLTAILTEMFDMPQEISFAKFRASYASVGNEIPYNAIFPRHSINSDGSVNFNTTKPFTDAKPEIITTTEFGLDWRFFNNRLGLDLTYYNINSQDQFIRINQPIEDYTSFFVNAGEITNKGVEITLSGKPIVTEDLTWSTAFNYSNNTNEIVELHPDTQNIGQGGAEGISIRMVEGGSIGDIYARKFQRDDQGRILLDDGNGRPLRTDRELFGNAEPDYILGWSNTVNYKDWGLNVQVNGKFGGLVASQTEALLDGYGVSERSAVARDRGYEIINAVQNGSAVTQIDPFTYYDAIGGRNGIDEPHIYDRTSVRLAQLALSYNINVDSIDWVKNASVSFIGNNLFFFYKDAPFDPEIQQATGRNNVGIDNYNLPSTRTYGLNLSLTF

SEQ ID NO: 65 - protein, 442 aa, Escherichia coli str. K-12
MQAAHHHYHRYTDKLHRQNHKKDLISPKPTEQEACNTSSLSKELIPLSEQRGLLSPICDFISERPCLHGVSVRNLKQALKNSAGTQIALDWSILPQWFNPRVSHAPKLSIRDFGYSAHQTVTEATPPCWQNCFNPSAAVTIYDSSYGKGVFQISYTLVRYWRENAATAGDAMMLAGSINDYPSRQNIFSQFTFSQNFPNERVSLTIGQYSLYAIDGTLYNNDQQLGFISYALSQNPTATYSSGSLGAYLQVAPTASTSLQIGFQDAYNISGSSIKWSNLTKNRYNFHGFASWAPRCCLGSGQYSVLLYVTRQVPEQMEQTMGWSVNASQYISSKLYVFGRYSGVTGHVFPINRTYSFGMASANLFNRNPQDLFGIACAFNNVHLSASPNTKRKYETVIEGFAAIGCGPYLSFAPDFQLYLYPALRPNKQSARVYSVRANLAI

SEQ ID NO: 66 - protein, 1124 aa, Escherichia coli K12
MSHWRLRLGALLLGCLCAGSLFAQEITGDIRGIVKDASGALVAGATVEVTNTDRNTTIRTVTTDTNGNYVAAYLPVGHYKVSVKKEGFKAAETNNVVLNVHDRLTVDETLQVGSSGQTVTVNENPSQVNLDNATAQGVITGNQVRQLTLVTRNYEQLVAALPGVSTNLASDQLFVGVSNPVGTSNQINFSINGTRPTQNNWQIDGSDNVDRGANLTLLAYPSVDSIQEFNVLRSNYMPEQGRSSGGQVNVITRSGTSAFHGSAYEFFRNDVLNANNFFNNRADVERPAMRWNDFGFTIGGPIYIPGHYNTEKNKTFFFYSQEWRKIITYNTFTSGVLPTSANLGGDFGSTICVALNPDGTCAALGNHVSTISPTAQAYINDIYSKFPAPNNADGTLTWVGRNQFNYREENVRVDHNFSSKFSIFGRYLDDQIPTQEPGGLFTGLAVPGVAVTNTNAPGRNASIHATIAFSPTTLADMGYAYSYGAVISSPAGTMASANSPDVNPTLPFGLGPLLPGIGFFNSTQGLAGFGPYNDYNYNHNAFATLTKVIGKHSLKFGGTFNYYTKDENVNGYGLQSGSYTFADCVDSSATVTSPYPCSDTGSTDQEWANFLNGNVSSFNQTNIDFRALVHQHQWEFFGQDEWRLTPYFTLSYGVRYSLFQAPTYGNGLLTTFDPSKFDSTNTPAIDSNGLYAAVPSAPYTNGILIGGKDSPYGDAVNRTPKLNFAPRLGFAWDPTHTGTTSIRGGFGLFFDSPAVNSMEQFQPGNPPFVTSTSISNTNFDNPGSVQAAPNLSPPDIGGIAPNWKQPYTMMWSLDVQHQFTPSTIFDIGYYGNAGRHLIGVVDVNQAPLGGFQALGIPGPVSSGDTQKLNQIRPYQGYASIDLFSPVFTSSYNGLQTSFTKHFTENSMIVLNYTWSHALGTASSDYRAPQYSMDIGAEYGNLDYDRRNMFTANYVYDLPFFKHQQGVAGHVLGGWEVSGLFYAYSGAHYTASASRDPGGLGLRDPNTFEGGRPDLIGNPQQGAPNHLDKWFNTSAFALVPAGDVRVGNEPRGVIVGPGYFRWDASLFKNIKFTERLNLQFRAEAFNVLNHTNFNAPNVSATSSLFGQILSARDPRQLQLALKLTF

SEQ ID NO: 67 - protein, 1119 aa, Escherichia coli K12
MLYAMIQADRVSKWAALVVAAMVLFAFAPHVMAQSVAVAEVDGHVTDPSGQAVVGAAVKMTEIDKQQVHTVSTDSTGRFALPNLPVGSYRLEVTSSGFKAYIQSGITLQVASNIEIPVTLQIGSVTESVQVTANAAMVETKENSISQVIDQQRIEDLPLNGRNPTQLLTLSGGTSNMTLNGGDLTGSKNMQGSNGSGQFSVAGAQANGVNFLLDGGDNNDAFSNVNMPIPFPDAIQEFNVQTNGLSAQYGLHPGGVVNIVTKSGGNSYHGNLFEYLRNGDLNARPDGVAGLQPVRDSLKRSQFGGTFGGKIIRDKLFFFAGYQGTRQRSDPAQNTAYVPTDAALKGDFSILDGAKSSGGCLATARALKNASGVPYPNNQIPVSTFDAAGLKLASSYIPVSSDPCGKYIFGYLANNPDDQWIGRIDWAVSERHNFYARYYIYDFTAQSLFDGKNALTTGTPGNQDRSQTMTVGDTYTFGGGTKVNSFHATFDRRRDNRASALNLFSPKDLGVNMFINIPNYTQLSVSNYSGSGFNVGCGTCALANFDINTYQVADDFTWIKGRHQFAFGVDGRKDQFNSFNNQQSNGQFTFNGQTSGDGLADLLIGRFSGLTDGNVISDYLRQTVFAAYAQDSFHAARNFTINIGVRWEPANPAYDKYGRGNQFSWPLFLQGWHSSVYPQAPAGLIFTGDKENKYGNALTASHYALFSPRLGLVWDPKGDGRQTIRASFNLMHDTTELFYPERWTTNAPYVSSITLTSGQFSNPFANYTLNGVTGDPFPGNVVFPTQGTYISVPGNIKPQYMMQWNISYQRQLGANWLLQANYLGNATRHIWGSTDINYAVSSIAGASTSNTNNRRLTYLANPTTGQYYANIQQTDDGANGEFHGLFLSAQKRLSHGFTLQSNFNWSHCVSSWDFAGELAGVIYQNPLNRATGERGNCGFDHRLTFTNTLVAISPGVGSGMAKTITRGWQLAPLVSFSTGNPIQITDGGKDISLSGQGLDRPNVIIPDQVYGPKSINSYLNPAAFMCAGSNAACTTFSGQFGNLGRNSVYGPGNITWDMAVSRRFKFNERFSLAFRSDFFNIMNHANWNNPTTNVTSGTFGQITTFGAPRIIQMSMKLFF

SEQ ID NO: 68 - protein, 340 aa, Escherichia coli str. K-12
MSLHPVVCLDRSRRGPGDFPLLSMTAVAMRRGVSSLLGVAGTLALAAPAWAQARQDAASAAHPTWMAAAGNWQVLEGGPGVARVKQRTTGVYAGSEHALGAGLRLGGVLGLTRSTARVDDLHAKGHVNSYSLALYGARTVAAGAGDFNAVAGAAYTWHDMDTRRHFHWAGTSQPLTADTHGSTFQAFGELGYRWRASARVQIEPFAALAWRDVRTRAFVESGGWAAISAGPSRLTQTTTTLGVRGEAGYMLGPAPGKLRLTLGWRRAFGDVDPQATLVLDGGNALAATGAPIARDAVLAGLGAELALSRSAAIGLAYIGQYGGGNREHTGSLSLRWLFGA

SEQ ID NO: 69 - protein, 859 aa, Escherichia coli str. K-12
MIKRTKVASAINVAIVTSISAGTFVASNSFAAEETAKVERIEVTGSRIQRQDMETASPVTVIDAAAIKAEGFTSVDQMLQVQTSMAGAAVGSTTNNGADGVAQVDLRGMGSQRTLVLLNGRRMVNSGSGANSSVDLNSIPVAMIARVEILKDGASAVYGSDAIAGVVNIITKKDFEGFQLDFNGSGTDKGDGENGDVSALYGFNTDGGNYTFGAAYSDRRGVIQGDRNWYDPIENTSGIIPTGSLNTTDNSVQRVLDANGNWVKRTGSYDFSDDVYFQTPSERRSLFANMTQELGNDVVLTADAIYTNRRSNQQLAAQPAQIKLNVCGDPRVTDPTAGCLDLDQSMIDAGIKADARGQVQYNRRMKDVGPRIYNQDTDTWRLSTGLAGSLDVHTGMNWNVDYTFGKNKAKTGVANSINATLMANSIYADPYAWFEGSPLTDEMKDVSYDQQESGGNEQQTLSAGLNGELFDLKAGAVGFAIGAEYRRESGFYNPDPIVVAGDSTAAQQDPTNGHYNVVSVFQEVSVPFTEKLTGEFALRLDDYSTFGKASTWKIGLTYTATDDLMVRTVAATGFRAPSVAELYGGNSGSFDYLTNPWLSISEQTGQILVNRTSDPDLKPEESESYTVGLVYSPSYIDGMSLTLDYWRFKVTDAIARADVQVGLDACHAGNAEACSTFNITADGDLFNLTSALTNVGSQDTSGIDFNLAYKFELMGLDWKVSNDTTYLVKFEQDGENYTGTIDGNMGAYARVRNNFSISAGLDDWSVMYFNRYIRAMTDVYTDYDANNNPFVAERGVDAILYHNISGTYHINDSTTVSLGVKNFTDEKPLYVTNGSDAGTVPEVYDTIGRTIYGGVTVKF

SEQ ID NO: 70 - protein, 86 aa, Escherichia coli K12
MSGDSGGQSSGEASSRVLILIDGQEVTYQRAGDNYGVGLLIDESALERVEVVKGPYSVLYGSQAIGGIVNFITKKGESPDSLYHLN

SEQ ID NO: 71 - protein, 816 aa, Escherichia coli K12
MLRTTRWVAAIIFLYSFPGYAEETFDTHFMIGGMKGEKVSEYHFDNKQPLPGNYELDFYVNNQWRGKQDITIPESPVKPCLPKVLLTKLGVKTGNLNTEDNCILLDKAVHGGQYQWDISEHRLNLTVPQAYINELERGYVPPESWDRGIDAFYTSYNLSQYRSYDSNNNSNTASYGRFNSGLNLFSWQLHSDASYSKPDDMKGTWQSNTLYLEHGWSQILSTVQIGENYTSSLIFDSLRFSGIRLFRDMQMLPDSMQSFTPLVQGVAQSNALITVSQNGYIIYQKEVPPGPFTIADLQLSGSGSDLDVSIKEADGSVRSFLVPYSSVPNMLQPGISNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLMIPHRENHLVLDTANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 72 - protein, 995 aa, Escherichia coli K12
MHSWKKKLVVSQLALACTLAITSQANAANYDTWGYHDNTTTDLVWPYDTDNDGIADAGGMDPMGSDGNYVTYNGFVYYNNANGDFDTVFKGDTVNGTISTYYLNHDYASGSVNQVDISNSVIHGAITSELPFGYYSITPAEVNAKGEVVTPQTYNGYNFYNGITTDLDYNWYDGDVFTLNVSNSTIDDDYEALYFTDTYLDGDKSKSTNETFYTALGVAVNLDVESNINITNNSRVAGIALSEGNTSNTTYTSEYHQWDNNINVSNSTVTSGSQTPLEESNGFFGKSAEPSDYAGNGGENDVALSFSDNAGSNYSMKNNVNFDHSTLLGDVEFTSHWNNDGVFFYSTGHDSNGDGVLDTNGGWVDDAQNVDELNITLNNGSKWVGSANMSAEVIAPADMYDVAPNSLTPGATIEANDWGRIIDNKVFQSGVFNVALNNGSEWNTVNSSVIDTLAVNNGSQVNVTDSSLVSDTIGLTNGSSLNIGEDVLVATDHLTVDSYSTVNLTESTGWNNYSNLYANTITVTNGGVLDVNVDQFDTEAFRTDKLELTSGNIADHNGNVVSGVFDINSSDYVLNADLVNDRTWDTAQANYGYGVVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 73 - protein, 376 aa, Escherichia coli K12
MDVNMMKNTLKVVLLTSMLPFAASAAQELTPWYVGGGLGVNNYEPSCDQKTMKVCGEDDPYAWDVFGGYLFNEYVGIELGYRDLGRAEWTDYSNKRNDVGARGMSLGFVGFYPLADKWSLSAEAGAFNYLISNKKEYNTEYYSDSGIAPYLGAGIGYNFTDNLKLQAKYRRYENLDEEKWNTLSMESNYWGLELSYRFGTSAPAPVAAPVVVAPVVVPLGDDDKDGVTNNIDKCPDTPSTHKVDATGCSVYENVTTKYDLGGILFANDSAEIRAGSFADLEKLADHLTKYPQHTVSVQGHASNVGKAEYNMKLSERRAVAVASALNKKYGISISRISSVGYGVTKPVMQGSSAEANRVNRRIEAIVTGTEKRVVLR

SEQ ID NO: 74 - protein, 939 aa, Escherichia coli str. K-12
MKRSLLATTISSCLVLTACGGGGGGGNVRNDPPPTTTVVPAPITDPTPAPAPTPAPTPAPTPAPTPSPAPAPAPPPTADPLPKTAPVPVAPPRYQGLASNLLVPTNADLAQQAGARGQGVKIGVMDDNLVQTYAPVAGKVDAFTDYTAVPGAAESTSNRLRGHGSVVSALVLGSAQDGFAGGVAPDADLIYGRICAENSCGTQQARRAAVDMAAAGVRIANLSIGASYADAASSANAALAWRFALTPLVQADALIVASTGNDGAAEASYPAAAPVQEASLRNNWLAVGAVEIDSAGNPAGLSSYSNHCGSAAQWCLVAPGMYAAPALAGTELQGQIAGTSFSTAAVSGVAAQVLGVYPWMSASNLQQTLLTTATDLGDPGVDALYGWGMVNAAKAIKGPGQFASNWAANVTSGYDSTFSNDISGSGNLTKNGAGRLTLSGNNSYAGGTSISDGVLALSGSVRSDVLVLNSATFESRGGTINGNYSLVNSTGTTAIELGKGLTVTGQASLKGNLLLLPEAAGYTVAGSERIVRAGALQGTFDRVQYANNFFWTAALAYDPTSVTATLTRNAAAASAQAAGASQSVVAGARQADSLVKALDTRVASGDTANLGGVITATGALLLATDAQVASSLPTLVGQVHGIERTLGFQSALNDARVAADRLPLLASTTTLTTWMQGSYLDGDLSRAGYASADYTQRATTVGFDMPLGGAGTIAGAALTSGEDRGTISASASRLRADRYAMTAYLYQPVGMAYLSAIGSYGMGSVETERSVQAGSIGERLQDRRHDTNWSLRTELGLLPRAGLSPFVAAGVVSQTQDAFSEASVTGLGLSAASDTLRAGYGEVGVRGHLAHGKWGFDGLVAYRSLFGDNRADFTAWFTGLPEARFTVAGEPLSKEALRASVGVRYSVSDTFSLYGNVGAERGSSDASSVNANVGLRWQF

SEQ ID NO: 75 - protein, 1125 aa, Escherichia coli str. K-12
MEKLRNVARFGKYGKRLCMMFLFLCITTSGLMRASVFAQTTVTAKFRNVTLNEVLWEIQKQTDFTFIYSTNDAKKVRVENLDVKNELISEVLNKCLRNSGLTYTVHDGVIAIRKAEPVRTETVAREKYTITGKVIEDSGEPIIGANVIVKGTTNGMMTDMDGNFHLEVTDKKVTLMVSYIGYTSQEVVATPGKPMSIILKVDNNLLDEVIVTGYGTFKKSAYAGSASIVKTDAVKDVPNVSFQQMLEGAAPGVSVNTGSGIPGSSTSIRIRGMGSFNASNSPLYVVDGVPVLSGNIGASGSDSGLDVMSTLNTSDIESITVIKDAAAASLYGSRAANGVVIITTKQGKAGKPVFKLKSDWGFSNFAMPFRELMGGQERRNLIHEGLRNYALTYSGKTDDEVGLHQGMTENEAWAYADSNIDQYAPIPWCGFVNWDDYLFRNGSHQNYEFSASGGQEKIKYYTSIGYMKQDGVTINSGLERISARLNVDYQMAKWMNIGAKIQFSKVNQDTYSEGTSYTSPIYGTRNGATPSDPIWNEDGTWNRALIKLDDRNPMLSNSYNFKREYATRSFNTVYASFDIWKGIKFASTFSYDFVMNKSRAWKDPRTSDGDDDNGRFSKDYNDITNMTWSNILTYQTKIKKKHNLDLLAGYEINSKESDGLGTTISNFARWDKPEVNNGVVYQSMGGSNSTTRIVSYITRANYDYDNKYYLGASWRTDGSSRLARENRWGNFWSLSGAWRVSSESFMKPLQNWLSDLKLRVSYGVNGTLPSSYYGYMGLSSLTSNYNDNPGITQSQLENKELTWETNYNFNSGIDLGFFDNRLNVTFEYYVRTTKNLLYSRPLSLATGFSSYLANIGKLQNKGYELEIRSTNIETKDFRWSTSLNLGHNANKILKLDGDLKQVTSGTSIHKVGLPYSTYYMIEFAGIDPVDGEPMFYKNTTDENGNLNKETTKDPRSAEKVILQCADPTITGGLGNSISYKWFDLNFNVNFSFGAWNYDGAAGKLEHGGDGTLNIPIYYRKRWQKEGDETSIERFVVGRSISMTDYATTRRLYSGDYVRLKNLTFGFTLPKTWTRKVGIDNIRLYASGNNLLTWAAYDYIDPESGSSPSWDTPPMRTYTFGLEVKF

SEQ ID NO: 76 - protein, 777 aa, Escherichia coli K12
MKRDEFEIFEGSAANTPATELYIKAKARPPLKNAVVGLASLMLGGGAATAQESTNLALEQIEVEAGNASNNGSAYNPRSTGLDRLPEPILDTAQSINVIPQQLLRDQQTTTMVEALRNVPGISINSAEGGTQGDNINIRGFSARNDIYRDGIREPAWYSRDSFSVENIDVYKGPSSFIFGRGSTGGVINVVSKLPVFTNFTDFSLSGNTAPGVRSTIDVNRTFGDIAARIIILGTDWDTAGRNFIGTKRVGAAPSIAFRFTEQTKLTLSYIYQHDDNVPDYGIPIVPGSIFGTSYGKPAPVSRGTYYGQQTPGFNDTEKVDAHIVTAKLEHEFNKDWMLTNGTRFSNVDRFLRARAPQWVASTSAIYAQPVGGTALTSLAGVPIGSLYSIDNNHFQNHTINSMISNLTNVVGHEETWGLKHTIQMGLDLSKEDRYNARQATNNTTAATTNQRINLLYPDPYPFGNNFGPNTTLTRTEARDIGMYVSDQVKFNDYFELKGGFRYDFYKAWQFTANSSRADGSLSQNGTTPFNLSSTNNFASWNGSALFHPAPNATLYYSFGTSVNPLAEYTTITNGGQNLGATTNESHEVGAKIDLFDSRLSLTGAAFMITQNNAVETIDATTSPPTVALVGKTRVKGIEVGATGEVTPGWNVFAGYTYLDGRLLQSQQYANFVGNVVQNVPRNQASFSTTYQVTPDWKIGTSVYFVDSRWTNVQHAGWVPSYWRWDLMTSYQVTENFSLQANLFNVLNTTNYESIAGAGFAVPGVGRSLQLTARLHW

SEQ ID NO: 77 - protein, 424 aa, Escherichia coli str. K-12
MKILSIQKLKLQSSLLGGTVVTLSVLGLGAQANAEGMIEDTSASLNLRNFYHNRNFVDPTYPQGMAEEWAQSFILDVRSGFTQGPVGFGVDILGLYSLKLDGGRGTAGTQLLPVHDDGRAADDFGRLGVAVKARVSKTELKVGEWVSSLPVLRSDDGRSLPQTFRGAQITSKEIENVTLYTGQFRGNSPRNDGSMEKMFMSGRPGAVSDRFNFFGGEYSFNNQATQVGLWYAELQDIYKQQYFNAVHSQQLGDWRLGANLGLFLGDESGSAKAGEMDNKTATLMLSAKTGANTFYVGLQGVYGDTGWMRVNGAAGSALANDTFISSYDFAKERSWQIRHDFNFVALGIPGLTIMNRYLSGSNIHADAVTDGKEWGRESELAYVVQSGPLKDMSIKWRNSSLRRDFSNFDIDENRVIINYPVKFL

SEQ ID NO: 78 - protein, 413 aa, Escherichia coli str. K-12
MNIHANRKSLVLVIPTLLLPINVWAEGFVEDTSATLTLRNFFFERNFTAPGVTQSHAREWTQGFIFDLKSGFTQGTVGFGVDVLGKYAVKLDGGAGEYGALLLPKDGDGDPAGSFGRLGVALKAKLSNTEVKVGEWMPNFPIVTADDFRALPQTFRGAQIASQELKNWSFYAGEFTKTSLRNDSSMEDLSFGSAQSDSFTFLGADYRSSSKNTTVRLWSGELEDIYKQHYLGLIQKWQLSQTVSLTSNLGYFWGKDTGVAKAGSLDNQTASALFSLNIAQHSISIGLQNVSGDSGWMRIGGTGGIYLANNTFNHAFDNPRERSWQVRYDLNFVGYGIPGLTLMTRYVHGDNVELRNVKDGSEWVRESELGYVFQSGKLRDLAVRWRNSSVRRDFNASDYDENRLIVSYPLNIF

SEQ ID NO: 79 - protein, 1018 aa, Escherichia coli str. K-12
MKNYVKRVILFWFCMVFYMLVQAQVRENRITGHVYDSQNLPLAGVNIKVKNTPYGTVSNEKGEFVLAGKWEQGVSIEFSFIGMRRKTITYKGQTKLEVTLADDTNNMDEVVVTAKANINEIDIRARSGVVQEVDMRRINSKPMIDMGLALQGSVPGLIVTNTGELGSAPEIRIRGNSSLRRGNTTNEPLYVMDGKVISSETFYNLNPQDIKEIKVLKDAAACALYGIKAANGVLEITSQRGISGQTMVTYTLDMGITTRGRRGISMMNSVEKLELERRLQNVETPGYRYSADYYNKYHADDPNLPQLIAAGQQKLDELKNINTDWFHELIRNSLYQKHNVSIRGGSEETTYYVSANYTQQGGRLPGNDKRRMSLRMNMDQKLGHIGYALLSVNGGYAKTNTPNGTTSDPTQLVYELNPYETKDSGELVSYPGRTYNDLMNQYSQEDAAKTAGISGSLILNPLPGLDVAAVAGLDFLLDETEQFTPSTAYSEMTTGVPEIQRGIYSKSKNTTTNVSTNVRVTYNNVYAGKHNLTLGANIDYYLTQLDNVSITGYGVGTIKSAAAINQSIQGTRKAEVGALKDKNAQLGFGAVVGYTFDNIYDLYGTYKTDASSILPSDKRWNSAWAVGIGWTPSYYEFLSDNPVLTRLNLKASYGYTANLNGVSVSSTVATFAYSTNSYEDQRPLDLMGLYNKDLKPEQTKSIDAGINIGLFDRITLEASWYNRRTEQALLDVPIPSSTGYTTLKRNIGILENRGFEFGVNMKVLDTNDWLLSLRGNIAYNRNKVIDLYYADRIYTSEEALLPDYEVGKSYDMIYGPSSLGINPLTGYPVFLVKGNKEKQASEALTAEDVVALGHSTPPYSGSFGLSLSYKSFDLDMDFYYVHGGIHQFNYSYVRDKDDSNKNAVAGQTDKMWFKPGDEGKVYPTPFYTSAVAEDNLSQYPNSLTVGKSDYLKLSMVSLRYRVPPHFLRKTLPFVKYATLAFQGSNLFTWTSYKESDPESGTLAGSMQPIYTFNMSLTF

SEQ ID NO: 80 - protein, 129 aa, Escherichia coli str. K-12
MDFNTKSICFLSKVKQKEMTVNNIKVAKDDDTFVETTVGTELNKKFIFGNNGINFGLGVDYSMVKDLDDSKAHFVGGSTEFDLRNYDRKNRATAEIKFGYEHISGVTATFRIRKNKDITSSGFGLGYKF

SEQ ID NO: 81 - protein, 858 aa, Escherichia coli str. K-12
MPKKLRKVRSFYPFLLLLALFASAIARGQTAGEQDVIGLLRQLEARHQVAFSYVDEDLGNLRVGLPADLLASLPLEPVLEELRQQIQLRIEKLNERYYTVAKSNLVTICGQVYDNFEDNTISGASVEVLGSSIATVTGPDGAFRLQEIPRGATLRIRHLGFRTRYMRAEELVRRDRCTPLLLPVRYQELQEVVVYKFLTSGLRRGDNGSILMMPSEFGVLPGLTEPDVLQTIQALPGIKSVDETVSNINIRGGTNDQNLLLWDGIKMYQSGHFFGLISAFNPYLTREVEIIKNGSSARYGDGLSGIISMHTHDEVERTYFGGAGLNLLSGDAYGHIPISDRLAIQVSGRRSVTDFLNTPTYSNFSDRAFQDTQVSGPGGQNTERFQSRDEDFYFYDISAKLLYDLNAYHKLRVSALNIENQLSYREVLAADSTENRSRLDQSNLAVGGRLTSEWSDRFSTAVSGYFTRYLLDSYYATEASQQQLFQANEVEETALKTEMDYALNPYVNWQAGYQFLVTGITNNSEVNQPPFLSRIKDVLYTHALFSEWRYTGPGKRLDARAGLRLNYLSNPDDFDRFRLEPRLNLQYKLRPHLVLGVLGEMKNQTSLQKIDLEQNFLGIEKRRWILADDQNLPLVTSRQISLGLHHDRGHWIAGIEGFYKEVDGITTDTQGFQNEYQFNGELGRYRVHGVEALLNFKSAEWSSWVSYAWNRNDYRFEDLDPAEFPNNLDIRHTISFGTNYTSGNLKLGIGVNYRTGRPYTEPEPEPNSVDTSVFPNRVNFSEPNSSRLPEYFRADASAIYGFELSETVRASVGASVLNLTGRRNILNTYYRLNDQNEVEQVENVSLGLTPNLSLRVRF

SEQ ID NO: 82 - protein, 439 aa, Escherichia coli str. K-12
MNKSNLALAVALAALATEATAAGFIEDSKASIGLRNFYYDLNTKNTANNNGEAQEWGQGFIFNYSSGFTEGTVGFGLDAIGLLGVKLDSGGRNTKTGRDRTPGQLFPLDSDGSAVDEYSKAGVTAKVRLSKTEARLGTLLPKLPVVTFNDGRLLPQTFEGGQITSNEIDGLTLTAGQLESTKTRSSTDDIALRIAGATGDADTNKFYFAGGDYKLTKDLALQYYYGNLEDFYKQHFLGLAHNWAIGPGSLKTDLRYFDSGSDGKNGSAAGRAQGYRSAGYWRAGDSSTGEVDNQTWSALFTYTLGSHFASLGYQQVEGDSAFPFLNQGGGSSSYLITDRQIGKFQNAGERTWVAEYGYDFAKLGVPGLKASVAYLKGDNVDSANGDLKEWERDFRLDYTLQDGPLKGLGVSWRNATQRGNVTTDADENRLILSYTLTLL

SEQ ID NO: 83 - protein, 849 aa, Escherichia coli str. K-12
MMDPDIRPAAASTQDDDALRQPLEPPMLCPRPLVLALSLACASTVPLLPDSAHAQAATRSYDLPAQPLAAALDAYSRLTGVDLVIGAALPPGHSAPALRGDFDDAQALTRLLAGSGLRPRFVDARRAALEPAPAERADGSRRTGPLRVQGTTAHGQAPGAGASQYVPATRDGFAPSVGSERVAMAERQEGNSLLRSMPGTHSFHSRSQPGLQVNIRGMTGAGRVNTMIDGVTQTFRNNAGHGSGGPFAYVDPFLLAGVDVQRGAVAGGDGAGTLAGSANFRTLDIDDLLGEGRDWGLRAGYRHGNNGYGSGRTFAGAWRHSEEGGDRQFGLLAAASSSRSSEYATARGQKNNADPGSQQPSSWLLKARLQPSDQHRLDLSHMRYENNFYHNYPWQISARNQRASYHYTPYSPWIDLRATFAGNKTRLFYPPVEDSSYIGRRTHSSLSSWTVDNTSRFDIGALQARWNTGIKHQSDIYVADTPVLRGANPQGRSQLDSVFSTLELQYDIYALTAGLRQDRFGIRGHIPVCSDVPGQCAEINGGGIDVRRTERALSPSLAVSWQATDWLQLFAEASRTSRPPRVQEMFFEKIPLEGMSDADGVGANPFLRRERSRNLQFGANLSTDSLLVDGDLAQLRITRFDNRIRDYIKPQYLLIVHPPEVEPFVVPIDSDPQLTAWTDALDVDDFSTTTRWMNHPGVVRMRGIELEAHYASEHYHATLSWTRSHTSAPAIEFVNLEDITALPDRYWTLDVGGRWWQQRVQAGLRAEYSGPTEEGYDFFQTRKTGGTGVLLDFYASFKPQANTTLWLNIENLQNKAYDNNASIDSIFSPILDRGNGRGRTVSMGVNVAF

SEQ ID NO: 84 - protein, 250 aa, Escherichia coli str. K-12
MKHGFLFGAAALALLSTSSVALAGGPIVVPMEAPVTALAPSGTYDWSGFWIGGGLGYGSTNYDISGDADLAEGQSGALELPDLGGQGGLLSLEAGYAYALAPRWILAGQLDYAFGNIDNDADLSLDGELSLDASYDIKVKSMMAGTARLGYLPSDTTMIYGLAGLTRAKFEADYSVSGVTSGGYDFSDTGLTIGAGMETRLTEKIGLKLEYRYTKFDDYTIFDGNVAGADVKASSDTSIQSATASLTYRF

SEQ ID NO: 85 - protein, 399 aa, Escherichia coli str. K-12
MNKNNTAVRRILPLTLASLGALGGLQPAVADILLYDKDETTFSTDGYFNAFYVNSDVDREGETYDRRQSRVKMGFLPNYIGFNFGRKVDDLTLGGRASFWVTINDSETDGTDTAIDVRQFYGTVAGDWGEVLIGKDFGLFSRSNIFLDELLAGFGNPSDTLGLVDGKGVSFGNIGTGYPYPFPTSQITYRNNSLLPGLRIAVGILDPIDSNQIDKDASDGLDDKAYQDNPRYESEVSYQFDLGGTQIYSWINGGYQTSKNTSDTVDSVTSKGLGYGVQAKFGGFSLTGSGFTAKGINPFFTNNAGEAALREVDSRGALLQGSYSWGRNRLALSYGKTVDDGNGLGSAADYESRGIAYFRTINDNLKLVAELNRYRIDGRDGAALDEDTDTVALGAVLNW

SEQ ID NO: 86 - protein, 253 aa, Escherichia coli str. K-12
MKTALLASVAMLFTSSAMAADIIVAEPAPVAVDTFSWTGGYIGINAGYAGGKFKHPFSGIEQDGAQDFSGSLDVTASGFVGGVQAGYNWQLANGLVLGGEADFQGSTVKSKLVDNGDLSDIGVAGNLSGDESFVLETKVQWFGTVRARLGFTPTERLMVYGTGGLAYGKVKTSLSAYDDGESFSAGNSKTKAGWTLGAGVEYAVTNNWTLKSEYLYTDLGKRSFNYIDEENVNINMENKVNFHTVRLGLNYKF

SEQ ID NO: 87 - protein, 782 aa, Escherichia coli str. K-12
MTASSKFFGAASALAMSVALVASGTAGFSLASVSVAEAAVVSRIEVRGNTRVDAQTIRDNIDIRPGKAFTSADIDAAVQRLFAMGLFSDVRIHQSGSTLIVQVKERSVVNNVLFQGNKKIKDPDLAPCRQLKPRAPFDMATMEADKEAIKAAYSHIGRTDATVNARTVDLGQGRVNVVYEINEGSRTKIANIEFVGNQAFSGRRLRDVISTKRSNPLSWLTRNDVYDEGRLQADEETLRRFYYNRGYADFRVLSSNAVLDPSTNEYRSRSPWMKVRVIPFGRCKRGKQPLMVSIRRRLIVWSRPVRASLTSAKEIEDSVLSVTESVAGSGYAFAKVEPRGDRNFENHTISVVYSVDQGPRAYIQRIEIRGNDKTRDYVIRREFDLNEGDAFNQVMVQRAKRRLEALDFFQTVNISTAPGSDPDQVILVVDVVEKSTGEFSIGGGYTTGGESPGAQVEAAITERNFLGRGQYIRISAGAGQDDMRNYGLSFTEPYFLGYRLSAGFDVFRRSYRVNDDYDVEQTGGTIRFGLPITDNFSAGIAYNLVQEKYDLFRGDAENYYAPALLEAAENSPWLRSSVSYSLTYSSIDDIKNPHDGLYGKFIQEFAGLGGDAKYVKTTFKGNYYQTLSQEADIVGLLGVGAGYIHEFGDDGVRIFDLFKNSSDIIRGFKFNGIGPYQDAKNGKRYWMGGTTYFSGTAEVQFPMPVLPESLGVRGAFFADAATLYGNDTPDISGDDKKLRASVGVSLMWASPFGPLRFDYAFPVAKADTDKVQNFNFGVSTKF

SEQ ID NO: 88 - protein, 840 aa, Escherichia coli str. K-12
MSYQQKKQPRFNRSCLCLAISSALLCFAAAAEQNAPAEQGKKLLDLEKIIVTGTTRRGQTKLESSVSITTLDAKQLEREQPLGTADLLEVVPGFWVEDSGGETNNNVAPRGLRGGEGFRYIGVEEDGLPVVYDGVWVDFYQRQDLSIQNMEAVRGGTSGLLTVNGPAALVNFITRKPDDIEEGTIRVSTADYGMLKTELFYGTPISDNWKMAVGGFYRHSEGVRDTEFSADHGGQVRLTLVREFEKGQLTLSAKHLNDHTTFYVPIPLQDQQNPTGIPGVDPQSGTLIGNDQRLLSYRKADGNYVTRDLKDGQHTQFSTLGFNLDWELSDNWLMKLAGRYSKFDNDMYILLNFDNSTLMNANDRLAQQDVQGMLSHFADDGAVRAMYRYVGDDHIINDPSQLNGNGLVTTSYPLFSSYQAEQFVNKASFTYEGEQNNLTLGWLYAYVDADTLPVDKWESQFLTEVRSNARRLDIVAVNNSGDVVGQLTDNGSTGYAPGWGQATAFGTSSSHSFFINDEFQATDDLRLDAGIRIEWLKLDSTASGTQFAVPILGAFNANGDDSDNIMANNYADMPSSKFYNQTRNETEAAWTVGFNYTFNKDMAMFGRYADAFEMPRLLSHGQGIHSGKSADFNDVVNLTFSELGLRYSGESIGTSATLFRTKFNDLTERNFTSSNGAVANQTIDTITDGVEFEAAWQATDDLKIELTGVVQEPKMSGFEGDFKHWENNQVKRTPKMQLRITPTYYFNNGDVYLTMHHLGDRFSDGENKFELPAYTTWDAGVNYQFTSSLRLHVKAANLTDEIGLTEGNPRAINDQQAGYEYYYARPILGRTISASLTFDF

SEQ ID NO: 89 - protein, 746 aa, Escherichia coli str. K-12
MLCYNANIIASGRAGEESKLNACNSPARGLERLHESPRSPGITHVQHFLRHCPLPFALLLGGVAMASESPVDLPAVTVQAQAVEEGESDLHTPTTSGSRLELSALQTPASTSSLSGAEVRARNNLTVQDAVTRTPGISSIGSPGNGGTALSARGFTGHAATMQLYDGTRQYVGAGTVTFPVDTWSVARIDVLRGPASVLYGEGATGAVINVVPKKPFAGEVRNQLRLGYGSDDRRQAALDSGGSLSDELSYRFNVNQQASNGWVDRGDSDSVALSAALRWDANDDLSFTLSHDHGEQSPMRYLGTPLVAGKYRESIRERNYNVADADIRYNDQITRLVTDWRISNALSASNQLYYIKTQRYWRNAEAYRWQPGDTVERSEFYRIKHTQEQVGDRQTFTLDHALFGLDSRTVVGVDYNRIHFARQHDFASSFSDSVPLAGSGGGQYQSTDPLGYGPRERNLARQFSLFAENRTQLTERLSLVTGVRRDQVHLQRDNLIDGSRADRSLSGDNWRAGLVFALTPELSLYGQYATSTEGVSNLLTLNPTQQQFDLSEARQSEIGLKQMFWNGQGEWTLAAYHIVKKKLLSRETPTSPTEQIGQQSSDGLEATLELALGQGWQVSANAALVRAEYDDFIDGGGDRSGNRPTDVPRRTANLWLNKALGCGVEAGIGARYVDARYVDTANTAKVPGYTVVDANIAWQALPDVRLGLELNNLFNRQYATSASSDGEQWYLGAPRSFFVTADYSF

SEQ ID NO: 90 - protein, 962 aa, Escherichia coli str. K-12
MLIFFQGFSNTGALASHRSNKKQNTTMKKFYLLTTFLLLTLTGFAQKAIISGKILDADDKLPLPGAMVQIIGEKKYTVSDYNGRFELLNITEGTYKVEVKYIGYTTLTQEIKVEQGKNNVIDFALKAFENELKEVVVGDILKGQAKALNQQKNNKNIGNVISSDQMGRFPDANVGDALKRVPGITMQNDQGEARNIIIRGLAPSLNSVTLNGDRIPSAEGDNRNVQMDLIPSDMISTIEVNKTLTSDMDADAIGGSVNLITRATPNGERISATLAGGYLPIREHASYTAGFVYGNRFANDKLGVVFSGSYNNVDYGSDNIENEWVKDDFGNEYLQASEIRKYDIQRIRRSASLALDYKFNENNTIFANAIYNWRDDRENRFRTTIDDIEPLYNGEEIIGFEGRVKRQTKGGVDNSRNKNRRLEDQRVQNYSLRGEHLINSTLDLDWSANYAKAREYRPGERYIEYRQKGLDVFENLTDTRFPLVTTAGEALDQFKFDSVTENTDETSESEFGAKVNIRFPFSVIAGEKGRLRTGLRLRLKEKERNNMFYAYEPINDGMELLSEVPNSYYDGKNFNPGSKYVPGAFASASFLGSLDLNNPALFDKETDPAEYLAVNYNAKERISAAYVRWDQDFNDKLSMVMGVRVENTHIDYTGNRVLDEEELESKINNTNSYTNVLPSISFQYNATKDLVLRAAATTALARPNYYALAPYVNNIAADKEITAGNPGLKATYAYNYDFMVENYFKSVGLISGGVFYKKLNDFIYNYSDNQYTDAKFAADFPNQSNPIPTGENWSFLQSRNGDNVNVYGFEVALQRQLDFLPGKFLKGFGIYLNYTYTKSKAKGIADEDGNERKNISLPGTAPHMFNGSLSWENKRFSARISTNFTSDYLDELGSESYKDSYYDKQFFLDANASYKITPKLRFFAEANNLTNQPLRYYQGVAAHTKQAEYYQPRYNFGLKLDL

SEQ ID NO: 91 - protein, 831 aa, Escherichia coli str. K-12
MQELPVLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLEWQLHSDASFSKTNNNPGVWKSNTLYLERGFAQFLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGTMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNWRRISYTLAASQAYGENHHEEKRFNIFISIPCDWGDDVTTPRRQIYMSNSTTFDDQGFASNNTGLSGTVGSRDQFNYGVNLSHQHQGNETTAGANLTWNAPVATVNGSYSQSSTYRQTGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEIPPSVNVAIDKQQGLSCTITFGKEIDESRNYICQ

SEQ ID NO: 92 - protein, 1454 aa, Escherichia coli str. K-12
MSGKNWGMKLKGKAFILSDILLKRVQTKYLCVSIFGTTLLLCNVGYGKEQWLGAGGQDSWIAACDWTLCHLGGGATSDTLHIANGNQSGSFTFTSIDLRTNNFGGSVDLNIKSENPWEGKITIHDLYNSHTGLLGFNGNVNINVDTKIGGLAHNNTGGGTRLNVIIGANNGAYTKNLHIDRVSFNQNGLTGSQGVINLYANNINIGKAAGRLSQVLNVNADGSIVADDVYFDGIGGVGGFAVIPKSEIKFNAKEGGFISQSIKGMGHSNIFVSTKKDIVVGNVGFAVDICITQACAGWIELNSKEGDVIVKSVTGGTANESGIGSFNTLQIKGNNFYAGKVEAISLVTSLNNSYLDLSGVKNTTFIDDLQFRNGTLKAKNFHFNNFTVWKANANRVGFEHPTDGSAYTTVSENIGKSFINNLSMEIGTSHTADSAALWFKGGGDILNINFVAARPTSYINFGDIKQVNINELSAMEADIYMKTGIFNTITNKKGQTIITNGASKITANALNVNELLHLKDSSKHSGVMKIELNANGENIDQKFDKYLNVSVDSKDLKNMSGDEIAKLIESNKNTNGNNEKTESDYKNASGTYITTSDGKHYLVLPDIMTNDNITNSTGQVANGGNILIEQTELTKGALNNYGKILIDDGFVSGDKPTLYLTGNLNNYNTIDLGANGHIEVTGNFNNKGKILFSIQANPNDSSNNEIKNASMNIKGKATLDISPGSTGALQADIADSKTLSSISSQLNTNGSKGVEYNLIKAESISYTYTQGDYTTTFDKSNGNTTIKTEHTNGGQCTNKDCQTGSNGNTKQETDFTTNGKDNPWDMDKAQTDSNGNVVENGIGSTDNEGNLIQKPSQQDKQEECKQDGKYCGFGSNANATEANRGYDYAQQKMKNSFSLTYKGGSIDGKYIDIEKVVNDTTIGFKINKVDINNFIEGNTEKPLCNAESSTFDCALYMEAGGNNSWINAIKKESANSYEILKNLFYDDKSSLVFLINLDQTLAASRNLEYFLEVGRTLDTAIDHVSNLENKASTLHTLTLSMESAKLNRLARVASIHGSASSYIAMQNYQKNLEAALREAEKLKLASLDSNTNTRIAAINNIVSGNTNSNAVYRSSVATLASSSNTNTQNANNGVTDIQSDVTTDNNSNEVWFDTLADLIMRFNNREEYPNHAWVNMLGNLNFSKTGSAQLYGFNAGYDYFVDKLQTAFGAYGGYGYGTFNGNNNGFTSNNSNNMFAGIYTRTFIENHEIDVTLNTAFSFTNEKQNSQINNFDLLALFKDEYSYTLSNVDLNATYGYAFLMKKGYIVKPFAGLSYYVLGSSGFKRKSDNTPIFAMNTDDNIRQTISVNIGIDGRKYFANQSYIFIVAQLKQDAIILQNNVDSSGTTTTSIGNIGDSVNNFNMRYKAQGYKSYVFLTGGGEYSFGRWYLNGSLSLQSSVFDKNFGLGFNIGGRVVF

SEQ ID NO: 93 - protein, 613 aa, Escherichia coli str. K-12
MKLQSRMLSLAVLAALPALAQAANDTTALDQILVTATRTPIALQDSIAPAQVIDRAQIESSQATSLQELLRGRAGINLANAGGLGKQSSLFLRGTNSGHTVVLVDGVRINSADLGLAMYQDLPLAQIERVEIVRGPQSSLYGADAIGGVIQIFTRRNQGDFAPHFQLGGGSNGLREASGGIGGGTERGWFGADIAYQHSDGIDACRGSATLFAGCFADEPDRDGYRNLSKSLRGGYTFNDQWNVEGSALRADGRNHYDGYYNYSETRQQVLAGKVRYTPSERLAFTANVGRSDNESDNFGDFGARGSAQTHRDSASLQGDFGVAEGQLLSAGVDWSEDNLDGSSAGYLVDSRRNTGVFVQYQGRFGRHQLQASARNDDNQQFGNHATGSVGWAMELGHGLRLNASYGTAFKAPTFSDLYDPWSGVPTLKPEKSKSANLGVSQQGQGWHWGLDVYETRIDDLITYDAATFKMQQVEKARIRGAELTGGVLLAGFDINAQLSYTDPRNRTGGSTQFDNWLPRRAQQTARLDIDRRFGDFRAGLTVQGAGKRYDDAANAVKVGGYGTLDLRAEYALTPSWSLLARAANVFDRRYETVAWFNQPGREYQLSVRYQPK

SEQ ID NO: 94 - protein, 735 aa, Escherichia coli str. K-12
MTESKAEPPVDYSKNDSVLDRDSSQNDSNKKKPSISNQKSGQEVASAQDITVNAKIENGTGARTALPVVNFGPLGDMKPENAPFSILSVPHDVIRNQQARNVNDLMQYLPSVQLEMRGDPGTSRPQSRGFEADVIANSRMDGFNIATTTPYAAEQFENLQVLNGLAGAIYGPQNPAGTFEYTLKRPTTEMMEDFSVGIDSRGTVTEAADISGSTGKNNWFGYRVNLVHGAGSNYVRTGHINRNLVSGSFDIHVDPQTVIELNASHYVYDIKGGAPGFSYSNNIQLPKAPDLSTPYLGQSYAGYNAQTDTASGKIKHQFGDNWSLVAGGLFQNAWRDVFANANTLIDNIGDYKQTIASAATAYRFKIASNLAYLNGHFHTGFVRHDVALGSNGYVMSNYNPTSSQSFSLGTSNLYNPTRFDGTRPRSSGSYRSAIARNQSLIVSDTITFNKHWSILGAFSWSWMTSSSWNKAGTRTAHNYTQGAFSPNTSLIYHPIENHTAYFTWGRSIQQGMTAPAGSANVSQILNPYESEQYELGYKVKWRNLSLNIDGFRMTRPYAYVDTTTNVYGMYGTQRNWGFEFQMAGHIRHDLSVLGGVTWLDAKVGSTGNLTTSHKEIVGVPPVQSNILIDYTLPFSKESLANGLAINGSVRYTGTRAANNTNTTYAPQFVTANIGIRYPFKMANKPWVARFTVNNIMNEHYWASVYPSSINGAAGGTNSAYAGLPRTYSFTLECTL

SEQ ID NO: 95 - protein, 200 aa, Escherichia coli str. K-12
MKTLVSALALGVAAASFAAPAMAQSQGDWTFGVGIINVNPKSDNGTLAGAAATIDDNTQLSLTAEYFIRDNLGIELLAASPFEHDIALGGSNIGSTKQLPPTLSLVYHIPTKGKVTPFVGVGVNYTTFFSEESSLGTLDLDNSFGFAATVGADWQTSERGALRLNVRYMDIDTDARLNGAPIGKAEIDPVTVGVSYVHRF

SEQ ID NO: 96 - protein, 917 aa, Escherichia coli str. K-12
MKQTVLTVLLFCFFITGLQAQNIVKGIVVDGDSEKPLNDVSVTLSKNSSYMVKTDQNGVFTLQKLSNGSYILQIKLKGYEVQNFPVELTGNSIDLGTILLYKDFSIDQDLSLITITDDELNDDASAADNIAGLLQATRDIYLRTAAFEFSSSFFRIKGLDSGNGKVLINGIEMNKLYDGRAQWSNWGGLNDVLRNQEFSNGLAPSNYTFGGILGSTNIDTRASEQRAGTRISYSSSNRSYVHRVMATHSTGTLEGGWSMTFSGSRRTGIEGFNEGTSYNAYSLFASIEKKINDNHSVNFTSIFTPNRRGKSSPNTQEVFDLKGIAYNDYWGYLNDRKVNSRIKEVEEPILMLNHYWDLNDKTSLQTNVAYQFGKIGNSRLDFNGGANPSPTYYQYLPSFFERNDDLEGAYEARDRFENDGQLDWNRIFDANITNRAAGLNNAYVLYEDRNDDKQLTVNSILNSELTENITLNAKLEYKRLRSHSFAEVIDLLGGTGYLDINPFADTMDAMQNNLLDPNRVVGVGETFRYNYKLNSDVVGAFTQAQFKYNKVDFYGAVNVSRTTHQREGLYQNGRFVNNSLGLSEKLDFTNYGLKAGATYKITGRHLIDANVAYMTQAPTIRNSFSNSRENNTVVEDLQSEKVFSTDLSYIVRSPIITSRLTAYYTNVQDATEISFYFADGVGGDNTAFVQEVLSGIERNHIGLELGIEAQVTSTIKLKGAASIGQFTYANNPDLYLTSDVADNGGFDSNFRSKNYVALLENYKLASGPQNAYSVGFEYRDPDYWWVGATTNFFTNTYVDVAPLTRSSNFYEDADGLPFSDYDPELAKELLQQEKFDDYMVVNLIGGKSWKIGDKFISVFATVNNLFNKEYKSGGFEQGRNANFRQLRDDKALDTPVFGNKYWYGRGTTYFLNVNLRF

SEQ ID NO: 97 - protein, 870 aa, Escherichia coli str. K-12
MMTGIKKNFYLSSLSLAVSLALTGTLASAGAYAAADEEEVKVEKRENVEKIAVVGTRAAPRSIGDSPVPIDIISSDDLKKNGSTDMIDMLVTSVPSFNSRAQPISDAATLIRPVNLRGLPSDSTLVLVNGKRRHRASVIAFQGGGINDGAQGPDMSVIPTAALKQVEVLRDGAAAQYGSDAIAGVMNFVLKDDNEGGSLTYTKGEYYEGDGTTTTIDGNIGLPLTDDGFINISGQYKMADATSRSVQRPDAAAIAYGTDGTDGNPYIQNPAQTWGNPELSDDFSVFVNSGLEVNDTTRLYAFGNMSSRKAVGGFYYRNPQDRGLVYSKINEQDPNDPNDDTRELLVGALNGDQSSCGVVSAEVPNVLQTAAYKAMVADPNCFSMNQIRPGGYTPQFAGKIEDSSFVAGIKGELGEWNYDASAGTGNNQASFGLMNSLNPSLGLETPTNFDTGAYTQNESSINIDFSRFLNIGSIEDVSFATGFEWREESFKITQGEEASWVAGPYAEQGFNIGSHGFKGFGPESAGKNTRNNIGIYTDVEAYLNDDWLLGVALRYEDFSTFGDTLNYKITAQYIATDELSFRASHSTGFRAPTVGQENVVNTQTSIVNGELIQTFIAPPTNPLAAFYGGEVLQPEESMSIAVGFVYEYEDFFLTFDYYNIEVEGRISQSSQKDVLAKDYDALRAAGVEFPELISAVTYYANDFDTTTQGIDIVANYNMEAFSGDAKLSLAYGWTDTSVDKFSPDTTDEGKVRRLEDGIPAHRATLTWAQSWDDINVSVRSNYFGEYYATHADDTSDWGSEDVGSAVTFDLDFSYALNDAITLSVGANNIFDKKAQKLKDGTLGELGAVYYESGPYDYNGGFYYGRVNYRF

SEQ ID NO: 98 - protein, 869 aa, Escherichia coli str. K-12
  misc_feature (681)..(681): Xaa can be any naturally occurring amino acid
MKIPTTTDIPQRYTWCLAGICYSSLAILPSFLSYAESYFNPAFLLENGTFVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVXWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 99 - protein, 655 aa, Escherichia coli K12
MACHMRTPLALLVGGFACHGAAGQEPVQQLEPMVVVASRPASTLEVTLDPKKPGSPMPAADGAGYLKNVTGMSMVRKGGLGGDPVLRGMGMSRLNVQMDGGMLAGGCGGRMDPPTAYVFPQSFDRIRVLKGPQSLEQGATLAGTVLFERDRPEFTAPGVKAEASALYGSFGRDDQMLDATVGAPQGYLRGQFTHSDSDDYRDGHGDKVRSFYRRENGTAQLGWTPSEHTWLELTAERSNARAAYADRTMDGPMFDRESFGLKLRQEQISRHWQRSELTLWDNDIDHIMDNFSLRPNSGMKMLSNPDRRNTGGRWANDIALPADWLLTAGFDANRDQHRARSGVDYASQPRQRTLRFEQQGGFAELGRQQGAHSYKGGYRQDRVETTRYGAGDQTLYSDTLTLDSGFGRYEYQWSPAWSSYLAWGQAKRAPDYWERSKDSVPFTLNPERSRQWDAGLALRSRELDLTLSLFSADIQDYLLYNNKSNKVRNIDAQTRGGELEGRWQFAEQWRLDGGLAVVYGENRSDHQPLAQMPPLDGKLALGWQPAEAWNLTLLGRAVAAQERVDVGSGTVAGQDQGETPGFFTMNLSAAWQFQPGWQLSAGVDNLFDTFYYEHLSKSVHASQAGLGYEQVGRIPEPGRAYWLSVSYRFASAGVL

SEQ ID NO: 100 - protein, 749 aa, Escherichia coli str. K-12
MRRVLCSLLFLLAAAVPTVFAEEVDERDSNRYRYSILGDVVDENGQPMPGATVRVLETTFGAGTDSDGEFVIRLENAKEYTLLVSFIGYESQEVKAVPAVRPPRLHIRLVPSSNQLNDVVVTGSFVAKPLKEVPVLTRVISQKEIQALNPMNVETLLQYELPGLQIGYNSMSQMPEISYQGMDGEYMLFLIDGERVSGEGADHNVDFTRFNVDDIERIEVIKGAQSTIYGSNALGGVINIITKTANRPFSGNLNARYAGSNGQKYTASTGVKKNRLTSYTSLTYRTKDTYEIGDEVGKTTVTEGSDGSSAEKQADAGSTTVYGYNIWDFLQKIGYTCNEKLNADLKGSFYRNKRDKRVGKMYQDIFLDYTLNGKVTYLPGEKQQLVIGYIYDNYQKNQDYFLSGKKTTDYRNIKQTPRIDYTGTFGKHTVSVGFEGDFEYLKHYMLEDSSHVNNQLYAFYAQEDWDILDELNIVAGVRADYHEKYHWHVTPKVSLLWHFCDHVSFRAGYAQGFRSPSLKELYQAYDMGGMGWFMLYGNPDLKPETSNQVSLSGEFTKGGLNMSVSFAHNRFRNKIAYMSLGDGSSDMQYVNADNAKTTALETILRYRFGFGLILTGSYAYTNDYEEVDGRNTSLVRPHTATFNAMYSHKFGKIGFNCSLNGQWGAKFDTYTRNQNDDGTYAYEITTYDARTMCSLNTGVTLPKGISLNLGIDNLFNYKDKAADSSLQVPQKGISVIGTVNLNIADMFGL

SEQ ID NO: 101 - protein, 310 aa, Escherichia coli str. K-12
MKTLIRKFSRTAITVVLVILAFIAIFNAWVYYTESPWTRDARFSADVVAIAPDVSGLITQVNVHDNQLVKKGQILFTIDQPRYQKALEEAQADVAYYQVLAQEKRQEAGRRNRLGVQAMSREEIDQANNVLQTVLHQLAKAQATRDLAKLDLERTVIRAPADGWVTNLNVYTGEFITRGSTAVALVKQNSFYVLAYMEETKLEGVRPGYRAEITPLGSNKVLKGTVDSVAAGVTNASSTRDDKGMATIDSNLEWVRLAQRVPVRIRLDNQQENIWPAGTTATVVVTGKQDRDESQDSFFRKMAHRLREFG

SEQ ID NO: 102 - protein, 380 aa, Escherichia coli K12
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNGLNASGQNAEVWAAGLKYDANNIYLATTYSETQNMTVFGNNHIANKAQNFEAVAQYQFDFGLRPSVAYLHSKGKDLGVWGDQDLVEYVDVGATYYFNKNMSTFVDYKINLIDKSDFTKASGVATDDIVAVGMVYQF

SEQ ID NO: 103 - protein, 351 aa, Escherichia coli K12
MQTTFIVSNNNKINLRKPSPYSMKEHAAFLEDEWEILDDALYLTLGGRWTHNEFFGNHFSPRAYLVYNLNESWMLKGGVATGYKTPNVNEISSEVGTIQGGWRIINFGNSELKPEKSVTYEIGAYYDNSDDLRASVTLFRNEFKDKILDTDGSNLNRIPAYSGCTGAPSVNCPGWGTYFNIDGADVWGVELATDYDILKNLNLAANYTYNHSKIKTGNPSINTPNGSVNFDQTTLSRLDGKSLTATPKHNANLTLTYKPIASVSTFVGANYQSALTSVKFGPGNKVSENDKKLFTLDMGAGWEVNKNLSLNFTAYNVFDNIRYDEGLADDGNYYWYPEQGRRFWFKVSAKW

SEQ ID NO: 104 - protein, 316 aa, Escherichia coli K12
MNISNDVSIGSRVAMLNNPFGTYASKMNGLKFAALDSDMRPSYVNEYTNSVWANAFGGANIIDGDSGAMYGATVGVDKQANDNVLWGAYFTYANAKIKDNNLEQKSDNFQLGMYSTINIAPQWELNLKAYAQVSPTKQDNVQIDGAYNSDYTSKFLGLSANAGRVFDFSDNTLFIKPFAGVNYYFSYTPSHTENGAIAKDIDSMKNNSVSVEVGAEFRKYMNENSYIFVTPKIEQFVINSGDDYTANLAVNNAFFTSIEANNKKKTYGQIIVGGNVDFTNQLSMNLGFGAKQILAGKVDNKNETYLSGQVGLKYKF

SEQ ID NO: 105 - protein, 761 aa, Escherichia coli str. K-12
MRKFGTQKIGLLTGAAISALSFSAALAQEAAPTALDEIVVTAERRSENLQKVPVSVAVVAGDQLRAIQGGGDDILSLSGKVPSFYAETTTGRIFPRFYIRGLGNIDFYLGASQPVSIIQDDVVLEHVVLKSNPLFDVKQVEVLRGPQGSLFGRNTTAGIVKFDTNRPTETLEGRASASYGTYGTTTFDGGIGGPIAGDKLMFRLSALYQHRDDYVDNTFAGTSADGTVTPKKNAMGGFDEKDVRLQILAKPTDQLTVLASAHARNYEGTSTLFLRQALKKGSNNSTAPRDSVALDEGNNNPQAYDTQGTSLNVAYDFGPVTLTSISAYETTSGYSRGDTDGGAAANYPVGGVPNGFGQSMGRVRDLDQLTQEIRLASNGDDRLKWQVGALYFDSRDTTDFYQRAYFTKTNPNNWVELNNLNTSWAVFGQVSYKVTDALTITGGLRDTYDAKKTILAKTANTAANAVTYAGRRYVRLSDEQVSWDLSANYEVNPDLNLYARAAKGFRGPTIQGRSAVFNSDFTTANSETILSWEAGFKSTLLDNTLRLNASAFTYEVKDIQLNGNDSNGNGVLFNADKAKAYGLEADAEWRPVSNLTLTAGVSLLHSEIQDKRVYAQVCALNSVVVCTVKNPTIAIVGPFGTSTFAQIDGQPLPNAPKYNFNFTARYDVPVGADGKLFIATDWNVQGYTNFVLYDTDEFYSKGNFEGGLKLGYEGGNGAYEVALFGRNITNEKNLKGVIENYMAAVYNEPRIVGISVSAKLK

SEQ ID NO: 106 - protein, 990 aa, Escherichia coli str. K-12
MKENNLNRVIGWSGLLLTSLLSTSALADNIGTSAEELGLSDYRHFVIYPRLDKALKAQKNNDEATAIREFEYIHQQVPDNIPLTLYLAEAYRHFGHDDRARLLLEDQLKRHPGDARLERSLAAIPVEVKSITTVEELLAQQKACDAAPTLRCRSEVGQNALRLAQLPVARAQLNDATFAASPEGKTLRTDLLQRAIYLKQWSQADTLYNEARQQNTLSAAERRQWFDVLLAGQLDDRILALQSQGIFTDPQSYITYATALAYRGEKARLQHYLIENKPLFTTDAQEKSWLYLLSKYSANPVQALANYTVQFADNRQYVVGATLPVLLKEGQYDAAQKLLATLPANEMLEERYAVSVATRNKAEALRLARLLYQQESANLTRLDQLTWQLMQNEQSREAADLLLQRYPFQGDARISQTLMARLASLLESHPYLATPAKVAILSKPLPLAEQRQWQSQLPGIADNCPAIVRLLGDMSPSYDAAAWNRLAKCYRDTLPGVALYAWLQAEQRQPNAWQHRAVAYQAYQVEDYATALAARQKISLHDMSNEDLLAAANTAQAAGNGAARDRWLQQAEQRGLGSNALYWWLHAQRYIPGQPELALNDLTRSINIAPSANAYVARATIYRQRHNVPAAVSDLRAALELEPNNSNTQAALGYALWDSGDIAQSREMLEQAHKGLPDDPALIRQLAYVNQRLDDMPATQHYARLVIDDIDNQALITPLTPEQNQQRFNFRRLHEEVGRRWTFSFDSSIGLRSGAMSTANNNVGGAAPGKSYRSYGQLEAEYRIGRNMLLEGDLLSVYSRFFADTGENGVMMPVKNPMSGTGLRWKPLRDQIFFLAVEQQLPLNGQNGASDTMLRASASFFNGGKYSDEWHPNGSGWFAQNLYLDAAQYIRQDIQAWTADYRVSWHQKVANGQTIEPYAHVQDNGYRDKGTQGAQLGGVGVRWNIWTGETHYDAWPHKVSLGVEYQHTFKAINQRNGERNNAFLTIGVHW

SEQ ID NO: 107 - protein, 313 aa, Escherichia coli str. K-12
MKLKYWLVYLAFIIGLQATDYDNLEEENQQLDEKINNLKRQLTEKGVSPKEMDKDKFEEEYLERTYPKISSKKRKKLLKSFSIADDKSGVFLGGGYAYGELNLSYQGEMLDRYGANAPSAFKNNININAPVSMISVKFGYQKYFVPYFGTRFYGDLLLGGGALKENALKQPVGSFFYVLGAMNTDLLFDMPLDFKTKKHFLGVYAGFGIGLMLYQDKPNQNGRNLIVGGYSSPNFLWKSLIEVDYTFNVGVSLTLYRKHRLEIGTKLPISYLRMGVEEGAIYHNKENDERLLISANNQFKRSSFLLVNYAFIF

SEQ ID NO: 108 - protein, 749 aa, Escherichia coli str. K-12
MSPAVVHSPRPLALAVAALLAGSALTAQAETDATDIDTVHVTASQIARQALGTSTITAEDIARRPPANDIAELLRTMPGVNLTGNSASGQYGNNRQIDLRGMGPENTLILVDGKRIGARDAVRMGRSGERNTRGDTNWVPAEMIERIEVLRGPAAARYGSGASGGVVNIITKRPTGDLTGAVDLYGLVPEHSAEGGSERVGLQLSGPMTDTLSFRLYGNLNKTDADSLELNRQYATNPNAVPPAGREGVKNRDINALLRWDVTANQVVEFEAGTSRQGNIYAGDRAVSTTGTSTGVDLAALAEGEAETNRMYRNTGAITHRGRWGDVTSRVTAAVEAVNNSRINEGLAGGPEGSFNGTDWSTSRLRNYQLDGEVSFPTTLGGAENIWTLGFEYLDSRLTDPYSMSQSSSSGGGIPGLSADRARGKADAQTTAVFVEDNIYLGERWIVTPGLRFDHHSQFGNNTSPSLNAQFRINGDWVVKGGIARAFKAPNLYQSNPDYLYYTRGNGCPNALPSLGAGCYMRGNADLKAETSLNKELGIEWAPQSGWQASLTYFHNDYKDKIQAGYTQIGLTADTRGRIFRWENAPKAIVQGLEGNLVIPLLGEQGNRLKWSNNFTYMVENENKRTGQPLSVIPKYTVNTMLDWQATDKLSLLLTGTFYGKQKPATTNINNDPRCTGSCDPSIALQDRGAYNIWGVSARYKVTETVSFGFGVNNLADKRLFREANSSDAGAATYNEPGRAYWASLRFGF

SEQ ID NO: 109 - protein, 760 aa, Escherichia coli str. K-12
MRLALTSTCLLLSTCCGSALAQEIAEPPVVTVIAAPGGAIDRDDGLALGSGDIDRAGQPDLLSALARTVAGISLQDAQGNPWQPNLVYRGFTASPLQGQAQGLAAYLDGGRFNQPFGDTVGFDLIPEVALRRVDVLDASPVYGLNGLGGAILLTTHDGRSAPGIEAALSAGAYGEREGSVSAGGSKGAISWYVAGQHRREDGWRDFSPSRLTNGLADVGFDTAGGGLHLKLLGADTDLTGNGVAPVELLAARRKSVLSWPDRSKSQFQRASLHPWVALSERTRIEATLYAQDLKLKTVNGDIADIEPCDDDEALLCLEAGDDEAFLTDAGGQAIATPAGDGAFGVLNRGEAQTRAMGVLVQIADRRPLGEGENHLIVGASFDTSRTRFGTSVELGVLTPNRSVEGLGPRIVQSDGAVGPVGVISHTRYWGLFAQNLLPLTSRLSAEIGLRYNHARVRLDDRIGTALNGEHVYARVNPGLELDWQVRPSLALRAGYAENSRNPTPAELSCADENAPCSLANFFVADPHLRQVVARTWEIGASGRGRLAGWQASWLLSGYRTTNTDDIQHIASRIRGRAYFQNIGRTRRQGAELTARASKGGWQVSASYAFTDARFLDPLVLSSPSNPFAAADGTITVRPGDRLPGIARHGLSLAADYAGKGWSLGADMIVRSGVRLVGDEANEVPEVPGYAVFNARAALQIVRGVSLFGEVRNLFDRKYATFGTFAEIDEVYLAEAPDAQDPRALGPAAPRRWSVGVKAAF

SEQ ID NO: 110 - protein, 299 aa, Escherichia coli str. K-12
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 111 - protein, 88 aa, Escherichia coli str. K-12
MKINNILRNIFMKSKDTLKWFPAQLPEVRIILGDAVVEVAKQGRPINTRTLLDYIEGNIKKTSWLDNKELLQTAISVLKDNQNLNGKM

SEQ ID NO: 112 - protein, 98 aa, Escherichia coli K12
MLTYKFDLGLGLTLGAIVLSDQYLGYDYRTRIPLQFVLNSSLFYFSPKWEMRINLFNFTNEKYWLPAGVGMSPTRELDYTSIVAGYPFWAQGTVSYKF

SEQ ID NO: 113 - protein, 355 aa, Escherichia coli str. K-12
MKTKLLSAVAVGAILAAPSMAVADEGWYVSGALGYGAPGDVDVSGSLNGEIQGEGDIREKLALGYQWANNWRLEGELAHRFNDTGAVGNFENSSSDFQVWSGMLNLIYDFDTGSFWTPYIGAGLGWVQSDISAMGWDTGTYSPASTFVTVDDSDATVGYQLIAGIGWELARNLTLDTEYRYFGYGETDYAPNLELGRVGGHEAWIGLRYLFSAPEPAAPPPPPPPPPPPPPPPPPPPPPAPECEDAGFVVYFAWDRSEISSQAAAVINQAVSQARNCGVASVSIDGHADRSGAASYNVGLSERRARAVRDEMVRLGVPASAISLEAFGESRPAVETPDGVREPLNRRAEVMIDLN

SEQ ID NO: 114 - protein, 369 aa, Escherichia coli str. K-12
MRKQTLPATLLAISGIGGIGLSAGAAHAQSSVTLYGIADGGFTYTSNQGGKSNYQATAGSEQGSRWGLLGSEDLGGGNRAVFRLENGFNLMNGTASANGRIFGRQAWVGLSSDRYGTLTFGRQYNASQDSLEPLQLAADTVQYGTHPFDVDDINNTFRTDNSIKYVTPTFYGLQINTLYALSGNAGNFATNRSYSVGASYANGPWHLGAAYVMLDHPATDTTGAIPSDNYFTFLKGISKQRIYGAGGLYDMGNASVGLMYTNTRFELTPASQYQTYQNAEASLRYRISPAVHAAIGETYTNVSTNGKVDSWHYWQTTAGVQYFLSKSTDVYIDLLYQRATNAVAQIEGASGPSSSGTQFIAVTGIRHKF

SEQ ID NO: 115 - protein, 401 aa, Escherichia coli str. K-12
MKLQLLAGVALAAVFAAGAASAQETGWYGAVDLGYHWPEGINTESSQNLPDGAHAHWTWSTDDDWAGFVRLGYQFTPNWRAELEGGYRPGDLVGVRGNPVRQQPIGLCTPGVTRTTAAPKCGSPSGSIDSWSLMVNVLYDFAPDSWINPYLGAGVGINRLDVSALGQFSGVPGPINAGNPAIQNLTVDDNDMAVAWQAIAGASIKATDKLKVDVTYRWFATQDQAWNATGSHLLQTGNFEGQYKDQSLTVGLRYSFASPPPPPPPPPPPPPPPPPPPPPPPPPPPPPPAYEAREFIVYFPFDQYVLTPEAQSVVSEAANYATSGHATKLVVVGHTDTSGSPKYNAKLSERRAKAVADALVGAGVAADALAVDWKGESAPAVATGDGVKEPLNRRSTISINF

SEQ ID NO: 116 - protein, 854 aa, Escherichia coli str. K-12
MRYKYKLSFSVLMISSCLVQVANAVESRNRELTKVGDMRNGGTVPKGSALISRTFSNNVTIEDGGVEIVENGKTSLKSTIKKGGMQIVTRGGTALEAKILGGQQFVHEEKNIDLRSVVRGSSAYNTTVSGGGGAVGQQNVYDGAWTWYTKVGNNGEQNLYAGERKEGGRSMATEVSGNGRQHVLAYGTSYTTTLKDQATQVVYPQGFVDTLTITDFAQSWLHVNVKDVVGKVRINGHGELYLFAGDRTNHTTKKKIPIEGRAEETIFEVGERNIGEKPQVKIEDLGGQDGTVIFTSIPYDPRHISLHVEKLSGDLHFRFNISAAGDVSDYLSIDDGRGNHKIRVADSGREITGPLSQRNSFVTEFPLITDRSHNGGANFTLADLSGKDITAVDSGVYQYQLLKRERCASSSGNATIWYLSRAGGTERSSPEVECVNRKTKIPVALSDQGASSGGKKTGRRPPTKKEQPKQRPPRHLRETQNVSSVSVSSSQEKRTHVVFPPTGSRPLSDEKQAVVVSASSQSSADQMTLRPVHKDQTSPQLSEKLSVSDFLTTPSTDAVLSMSVAPAMVFHNEMQSVRAGRGILDKSKKNTVLWTYAIKSKESIATEHIDFKLDQTGIVLGINGLSEWENGDFYIGGFGSYDHARVAHARGGTSGINSYGIGAYVTYLDHSGWYLDSILKYNHYQNTLKAVSTNGLGIEGTYTQWAVGSSFEVGYRLQTSQSSWLQPYGQFTWLKVEGKEIKLSNDMTGDMRPFTSLRSEVGLSLGYEFGSRMNSSSLAYITAAWMREHKDDNQTLINQRHPFTTDVSGNAGKLGIGLSSLVSEKLKFYGEAHYIKGRKTKQSLQGIIGVRYSF

SEQ ID NO: 117 - protein, 413 aa, Escherichia coli str. K-12
MNKKLMALAIAGVMAVPLTAAADGTHVTIFGRLQAEYATIDVDGFNAQTAVADDALQSRWGLQIAEDLGMGLRALGRIEYALNPGGDLHNTAREQWVGLGGDQWGELKFGRVQSVLRDFAGGLTVDAFAETSLHANGSGGLMVSSANGYGSGEHGFVKSAVRFDSPVVEGFSVAGLLMPGDADKIDPTGASNFMGLPGSATAIGSENAGGENGEWDFQAAAKYSGQFDIVGVDVFGAYSRDNVSKFQKSYGVKDEQIWRGGAIFSVADFRLRGQYEHVIDANPFGGAATCTQAAAFGDINALGNNGRGQCNSAMNPNGNGSLWIVGADYTIGNTMLVAQGGMAVAKKTGEATEPFGTYAKRNVENITVGVIHNLSRRSSLFGGYQRVWVKDRNLAPGVDADRNVYTVGVRHDF

SEQ ID NO: 118 - protein, 353 aa, Escherichia coli str. K-12
MDMTMNKKLLALAISGAVFGTQAVAVELYNEDGTTFSVGGHVSVAVGDVNSSDRQNSDDIGVETVSPRINFGATHELGNGFTADAKGEWALNMLDGGEESFTTRLGYVGVSHDDYGRAAVGTQWAPYYNVAGVADMPIAFANDFIYEDHGNLGTGRGEEMVSYSNALDFGNAGSLGAAVAWQGRKVDGATTYGNRGQVALNYAIAGFTANYAYNTGDVDYALRGSQTADSHVVSATYGSYGAEGLYLAGVYAMNNYMNSAKVGSASIVLEETVAIELLASYALSNSLNLSVNYEAVEDDKMSETVYSTTALQAEYNFTSQFVGFAGYQFDLQGSGVYKEKADDQWLLGARYYL

SEQ ID NO: 119 - protein, 392 aa, Escherichia coli str. K-12
MQLRKLLLPGLLSVTLLSGCSLFNSEEDVVKMSPLPTVENQFTPTTAWSTSVGSGIGNFYSNLHPALADNVVYAADRAGLVKALNADDGKEIWSVSLAEKDGWFSKEPALLSGGVTVSGGHVYIGSEKAQVYALNTSDGTVAWQTKVAGEALSRPVVSDGLVLIHTSNGQLQALNEADGAVKWTVNLDMPSLSLRGESAPTTAFGAAVVGGDNGRVSAVLMEQGQMIWQQRISQATGSTEIDRLSDVDTTPVVVNGVVFALAYNGNLTALDLRSGQIMWKRELGSVNDFIVDGNRIYLVDQNDRVMALTIDGGVTLWTQSDLLHRLLTSPVLYNGNLVVGDSEGYLHWINVEDGRFVAQQKVDSSGFQTEPVAADGKLLIQAKDGTVYSITR

SEQ ID NO: 120 - protein, 204 aa, Escherichia coli str. K-12
MKKLILFSLVIAFLLSVSLSWAADEADKPANYLAIKGGIYSPSNDFDVQHIPGDSTFSRLDNKIGFAGEVAFGRYIMPAVAMELGAGYFESKGSGEAVAGQDARLRVVPVVLTAKVLLPLGPVEPYGEFGVGGYFSKVRDFKIDESTNTKAMFGLHAGAGLNFNITDGFFLGLEGRYLWTDDSWGSSDAKLDGFITMAALGFRY

SEQ ID NO: 121 - protein, 180 aa, Escherichia coli K12
MYWQQRASGEVATLLGTNGAIAINEVGNLGKTLRNGWDAQLNLQPDEQWRVWLGYSRQEAEIAIPDPSVPATRGKQIENVPRWLTNVGAEWQVLPKLKLSAWGNGQGNYYVERTNTLGRYGRYFLSNLSATWLLSNKSELTLQLNNATNRFYVYAWYDSGFSGYSPGDGRALYLTWNLTF

SEQ ID NO: 122 - protein, 759 aa, Escherichia coli str. K-12
MSGLRGVQPRRPFNQFIEVGTKMIRPFSRVSLRRHSRQNRHRTGQHCSYARHNKRLSSVWRKITCCGLLLAGRAIADPLSEPDAGVPGAGASRTAVLPTIQVTGQTSPAPYVGLVGKRAGIGTKTDVPIREIPQTTNVITAEQIEETGSSSVGDALRYMPGFSAYSVDTRTDWLTGIRGFAPNVFVDGMQVPSTELRASWRVDPYMIDSISVLRGPASALYGPGQPGALVDIQSKLADGERYRETGFQIGNYARKQFMFDLGSPIDKARSLSYRFVGVLRDGNMTTGPNGQQRISLAPSFRWQPDANTSIVFDATYLQDHGDWTSNYLPAAGTVLPNPNGKVPYDLYTGDPSLAHYAKKQWSIGYALDHTFSPDMSFRQKVRYLSVSLDTAALWGQGLAPLDPTRSHLKRLAELSQPHYNRMDVDNTLQTRFGAGPTEHTVLFGLEYDRQRSTDSDWSAPGPDLNLFDPVYGIVSPDIFSGPGVRRLSDRTTLDDLGVYAQDQIKWGRLALTVGGRYDWNRVDEDALTRGTHESHTDAGFSERVGLTFEGPLGLSPFVDYSTSFNPSQSIVTLSNGSTAAPNHGRQVEAGLRWEVPHKNMMLTADVYQIEQTNVLVPDPNDPLHQQQTGKVKSRGIEFSAVGRLSRNLSIIASYAYQDVKNAGADDRYAGKWPTTYPAAAPARVRMARLDVARRCPRRVGMGRRHSLPERYARQCRQHARRAVLYGARYRNSLRQRKVGIRVEREQSVGSALHRQLPKR

SEQ ID NO: 123 - protein, 398 aa, Escherichia coli K12
MDTTNEFSGAITSPTKDYGLRQGSSNAGQYSLENDIDWEKLANVRGFSTHALVVGRYGIPASRMFGDNLNPSSEIYGAGGNVVVHLVYAYAEETIAKGRVDLAGGRIPLLNDFSASPLYCTFQNNAFCGNPKASSDNITHSSYPDASWAFRVRTRPTTSTYIQTGVYFSQAGIYNNVQYRTGFKFNGADIHGEAIPMEAGWEPLFGKDKLPGHYKVGYAIDNAPHKDNYYDVNGQPYVLTGNPARTLNYSWSAWALADQMVWRHHVKGNADAGLILLGGMYANSPRTQLRAQQYSAGLIDSGFWAARPLDTIGINFSYVRVSKTATATERLQAMYGLPLMSSSLTPQTFGEVLEATYRIHVMRGITFAPDFQYYFRPGAQKALKDAAMLGFKSHIQFF

SEQ ID NO: 124 - protein, 703 aa, Escherichia coli str. K-12
MFKARAGIIAKQGAVSAGLAVILGVHAGAGMAADLAERARPRFIDWSGFYAGVQGSAGASFGNYDFGPTTIGSRRVRSISTGDATGSRDLGGDATTAVGGAFAGWNWQDGALVYGIEADLVGANLKRGARSDATGFGYEGIDPPFALIREKTDVFGAARARLGYAFGNNLIYATAGLTGANGRVLATYPDLAGGPTATATRNVSYLGFTLGAGVQFAVDPHLSLGIDYRYSDLGESGRFGLGTLPGPDGGPVTTRTSFVSNKMMARLIWHPQALTLVPEEEDETPKDARFSLHGQTTFVNQGVTGFRAPYRGPQSLVPDQAQATTTATLFLGLKLFEGTELYYNPEFSQGFGLSRTLGVAGFVNGEAQKAGAPFPKLRSNRYFVRQTFGLGGETEEVPDGPNSVAGTRDVERITVIAGKFALGDFFDGNAYAHDPRVDFMNWGLWAAAAWDFPANLPGFTQGVMVEYNRAEFAIRAAYTQVPKEPSSDVLDPRVFERAGAVIEFEERHTLPVLDQPGRLRLGLFSNVGNTANFRQVVALTQSGALPDINTAAAATREPRRKSGAYVNLEQALTADLGLFARASVNDGRNENLNFTDIDGSISGGLSLKGAAWGRPQDTVGVGAAANRISTAHRAYFANGGLGLLIGDGRLDNYAPERAVEVYYALNLTKAVTMTFDYQHIENPAYNRDRGPADFFGTRLHTDF

SEQ ID NO: 125 - protein, 323 aa, Escherichia coli str. K-12
MARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 126 - protein, 815 aa, Escherichia coli str. K-12
MKQALQRARVSTAAMGYCPLALAIGGMLLSGTIRAQENNTDDPRTLSTVVVTGNRGAEQRTVTSSPVPIDVVSARQLQSTGKPGLMEALSAVIPSLTLPEKTGWDASGIARAPNLRGLSAAEVLVLVNGKRRHTSATLNINGINTGAAPADLDLIPISAIDHVEVLRDGAAAQYGSDAIAGVINVILKADTSGTSVTNAGLGYDGKKQTVQQSLNKGFEIGDGGIVQLALDARSQNDDNKASANGYSYEQAYDLAGKSTYGGYGTPKTNLLTLGYNAELPVDGSLSLYSFTTYSRRKAEQGQNFRLPTITNTITTGPNGYPAGYTPTWYIDEDDVQAALGGKGAVGEWDWDLSSTYGRNEAEQGTTHNQNPSLGEATPNRFTSGTWISTELTTNLDFKRGFDIGLQKPLDVSYGLEHRRETYEVQAGDYESYANGGYCIAPGNCASSGAQVTNGISPDEENSASRNSVASYVDVGFNPVPDWYVGSAFRYEHYNQGVGATRSGKLTTRYDFTPQFAVRATVSNGFRAPSLANSLFSARSTTYGVVDGVYQSINYGVLPTGSGAAKALGAEDLKPERSTNFSLGFTLTPTERLTLSADAYVINLRDRITLTGTLLGDEVTQVLLNNGIDSTSGGQYFINGADTRTKGLDLVSNYSQDLGPYGALKWTAAFNWNQTKILSYKEFTSILGTSYELMDREARNLITGVQPRTKLILGGDWSIERFNLNLALTRYGAYKEVNSSANRDLDRVYGTKWITDLDLGYNLSKNLNVAVGAKNLFDVYPKKQGIPSSTMVSSYGTYSPYGFTGGYYYTRLTYAF

SEQ ID NO: 127 - protein, 705 aa, Escherichia coli str. K-12
MQLLFYLITTHQGILFMQTKLTRLTLSVSTALLSFSSLAQETPDVGEAGDKIMPAIEVIRVIGDSTSALLKQTGSVVIINQDQIDKIQPLSTQDVLRSIPGVNIKSEEETAIVSNIGIRGLSASESKSLLLEDGVPVAPGLFIGNARYFNPRIQRVSQIEVLKGSASLRYGPSTIGGVVNYKTKTPDDGVILTGRAGSFNMQEITVEAGGKNEDEDAFAGVLATRASSDGFMDKGYDMTDVMAKAGVIFDNGQKLGIKLSRYENDANISYRGLLLAEYEAGEDYNPAPDDYYLTERTAFDINHEWSLSNDATLNTLVYWSDVSRDYWRYSVDTEASNEANSWVYTDSLTGNNRSFERVGIETRLTLEHSLMGVEANSEFGLRFMQEESNDTRIRALRSSDRTGANDRHRIDSAQSYAGYAQSRIQLSNAFAFTPGLRVESYEQKRIILTNDNAEATTSNTEILPGVGATYDLNDSAQIYGGVYRAFSPASNGVALDGLSDQNLDGERSTNYELGLRGKQGDITYEAAAFIMDFSNQVVTGNSDPNLSQSNGGETEHLGMELLLAYDIGSGFYIDTNATFIPTSEFKTGENSGNRLPYAPKVIANVALSYESDKLSGALTVHHRGEQYGDASNTVDIPDDAAGGIWGGLLPAYTLLDVNASYTVNKNMKVFGAIKNLTDKRYITGMRQGIYVGPERSFEIGVNYRF

SEQ ID NO: 128 - protein, 1672 aa, Escherichia coli str. K-12
MSSMKWLSATAVFAAVLPSVSGFCFPESKELNFSRTGTSSSTTFTETIGENGTEYIVSGNSSFTNFTNIPVKKPTTDDSSTSTPTTSSAVDPTEKIVRASSSSSPNSGDTSATPDPKGGGAFYNEHSGILSFMARSGVEGSLTLSNIKMTGDGGAIYSQGELLFTDLTGLTIQGNLSQLSGGGIFGGSTISFSGINQATFSSNTAEVVPEETTPNPNPGTQTTTSQPSPTSKVQSLFTYSSSTQANGNGADSQTPSHKPGSGGAIYATGDLTISDSQEIVFSVNKASKDGGAIFAEKNVSFENITTLKVQNNGAEEKGGGIYASGDLSIQSSKQSLFNSNTSKQGGGALYIEGNVDFKDLEEIRIKYNKSGTFETKKVTLSLPEAQTNKSSVTAASQSGPNTTPTPTPPVTAKGGGLYTEKNLSISNITGIIEITNNKATDVGGGAYVKGTLTCKDSHRLQFQKNSSEKKGGGLYTEDTITLSNLTGKTLFQENTAKEEGGGLYIQGDDKTLTMTGLDSFCLIDNTSATHGGGAYVTKEISQTYTSDVEEFPGITPVHGETIISGNKATGGSGGGVCTKHLVLSNLQTISISENFASENGGGACTCPDNFPAPTASTPSTNQTAAPKDDKDFLIDYVVSTTIDKNKATKKGAGVYAKKAKLSRIDELNISDNAAQETGGGFCCTESLELDTIASLSVTKNLAGKEGGGLHAKTLNISNLKSGLSFSNNTANSSSTGVATTATTSQSPTVSSFLPRATAGSSPAPAQTTPTYAGVVGGAIYGETVSFSKCSGLCQFTENSAIDNTPSSPSLNVQGGAIYAKTSLSIEAEDPSTSYVFSKNSVSTGKAQTTGQIAGGAIYSPSVTLNCQTVFSGNSASMATTNPPSGTSPKDTIGGAIAGTTISLSKTSHFSENTADLGAAIGTLSGGSSSNLTEKITLSNGSFTFEKNKANKRGVIYAPSVSIKGNNITFNQNTSTHDGSAIYFTKDATIESLGSVLFTGNNVTAEQASSTATGGQTTNTTNYGAAIFGDPGTQTTDTTLKLIASSGNITFSNNSQNTATNNPATKFCSISGYVKLTLQAAQGKTISFFDSIRTSTKKTGQAQNSYETLDINKTENSNTYAGTVLFSSELHEVKSYVPQNVVLHNGTLVLKKNAELHVVSFEQKEGSKLIMEPGAVLSNQNIANGALAINGLTIDLSSLGAPQTGEVFSPPELRIVATTSNSGGGGGVGGYVTASKNLSAASPTVAATNPTMADNKVFLTGALTLIDPDGNFYQNPILGTDLTDVPLIKLPTTANQVDVSNLTLSGDLSPKKGYTGTWTLNPDPQTGKVVANWKFDMYRRWEYIPRDNHFYANSILGSQNSMIVVKQGLINNMLHNARFDDAAYNNFWVSGVGTFLSQQGTPLSEEFSYYSRGTSVAIDAKPRPDFILGAAFSKMVGRTKAIKKVHNYSHKGSEYSYQASVYGGKFLYFLLNKQHGWALPFLLQGVVSYGHIKHDTTTLYPSIHEKNKGDWEDLGWLVDLRVSMDVKEPSKRSSKRVALYGELEYSSIRQKSFTEIDYDPRRFDDCAYRNLSIPMGCYFEGAIMSYDILMYNKLSLAYMPSIYRNNPVCKYWVLSSNETSKVVCGVPTRTSARAEYSTQLYLGPFWTLYGNYTIDVGMYTLAQMTSCGARMIF

SEQ ID NO: 129 - protein, 712 aa, Escherichia coli str. K-12
MSSLLPRRHVVSALPLLGVLACAAAPATAAEPQARSLDAVQVRSDYAPYRALTVTGATKTEAPLRDLPISARVLDHSLLEDAGVTDLAGALDMASGITKANNLGGLWDSYSIRGFTGDPNFSSDYMVNGFNASRGYNGLRDGANTQSVEVIKGPASALYGRGEPGGAVNIVTKKPLFDAQHSVDLSAGRFDSYRAALDSTGPLSETVAYRVNLMHKDQHSFRDTVDSDATLLAPSLLWMPTPDTTVSYELELLRIHTPFDRGVTAIDGDANRLPASRFLGEPGDGDIDLHSTGHQVFAVHGLNQTWSLQGGATYRDSGMRGFSTEPWTLQADDRTLRRERRYRDYQGRDIAARAELLGTLGSGKVAHHVLFGIDGNRFNDSRYQLRARSAATPYSIDVLAPRYGVAQPGRLAPITDTDERQQVWGVYAQDQIDLGARWKALLGVRYDHYQQDIANRLRATTQQASDGVISPRAGLTVHLDDTLSLYASAAAGFRPNSGVGANGQSFAPEKSRSLETGLKYVQPGEGLEATLAVFRIDKENVLSLDPADTSFSLPVGQMRSEGAELDLLGRLTPHLAASVGLAYTDSQVTRSSAAAMGTGLAEGRRFPNVPRFSGNAFVNYAQPLSGTRSAAVGVGVSRTGERLGSVDSNTGFVLPAYTVWRLVGHYDLSERLRLYAKVENLTDRRYAAFSYSEQWVYPGAPRTWTVGARLRF

SEQ ID NO: 130 - protein, 212 aa, Escherichia coli str. K-12
MARKRKSRNNSKIGHGAISRIGRPNNPFEPCRNRYAQKYLTLALMGGAAFFVLKGCSDSSDVDNDGDGTFYATVQDCIDDGNNADICARGWNNAKTAFYADVPKNMTQQNCQSKYENCYYDNVEQSWIPVVSGFLLSRVIRKDRDEPFVYNSGGSSFASRPVWRSTSGDYSWRSGSGKKESYSSGGFTTKKASTVSRGGYGRSSSARGHWGG

SEQ ID NO: 131 - protein, 425 aa, Escherichia coli str. K-12
MLELLYTALLYLIQPLIWIRLWVRGRKAPAYRKRWGERYGFYRHPLKPGGIMLHSVSVGETLAAIPLVRALRHRYPDLPITVTTMTPTGSERVQSAFGKDVQHVYLPYDLPDALNRFLNKVDPKLVLIMETELWPNLIAALHKRKIPLVIANARLSARSAAGYAKLGKFVRRLLRRITLIAAQNEEDGARFVALGAKNNQVTVTGSLKFDISVTPQLAAKAVTLRRQWAPHRPVWIATSTHEGEESVVIAAHQALLQQFPNLLLILVPRHPERFPDAINLVRQAGLSYITRSSGEVPSTSTQVVVGDTMGELMLLYGIADLAFVGGSLVERGGHNPLEAAAHAIPVLMGPHTFNFKDICARLEQASGLITVTDATTLAKEVSSLLTDADYRSFYGRHAVEVLYQNQGALQRLLQLLEPYLPPKTH

SEQ ID NO: 132 - protein, 313 aa, Escherichia coli str. K-12
MNTFSQVWVFSDTPSRLPELMNGAQALANQINTFVLNDADGAQAIQLGANHVWKLNGKPDDRMIEDYAGVMADTIRQHGADGLVLLPNTRRGKLLAAKLGYRLKAAVSNDASTVSVQDGKATVKHMVYGGLAIGEERIATPYAVLTISSGTFDAAQPDASRTGETHTVEWQAPAVAITRTATQARQSNSVDLDKARLVVSVGRGIGSKENIALAEQLCKAIGAELACSRPVAENEKWMEHERYVGISNLMLKPELYLAVGISGQIQHMVGANASQTIFAINKDKNAPIFQYADYGIVGDAVKILPALTAALAR

SEQ ID NO: 133 - protein, 756 aa, Escherichia coli str. K-12
MATVIYKHTQHSFMEKRCKKAVRLTTLLVLLAAGTAHAEENSPDTAWKNYTTEEITVSGKKGDILQQVTGKESQVLNPSQMSVYKAINLIPSLSQQSVDPYGLADIVNYHESFRFRGVEATAGGVPATTVNVEGLPVTGRPGGGATIYDLENISDIDIYTGVMPAYAGLGLADVGGKIDMKIRRPEERFGVQLKQSIGSNDFSRTYLRIDSGRLAGSTKGFISFSETAADKWKGEGDAERKNLMAGITSEFSDNIKLETFLTWSKGDIHTYKPFTYTEIGDLDRAYETDYGTDAGSYDYYGWNRNEFEDWMFMANLEIKTGERSKINIKPYYWSDKGYYLETISTPNGQRIRRWDIDHDLKGVLGEYKTRVGDVDLDLGYIYHTQKRPGPPTSWKNYTVTASGDLKFAGWNILSNSSSHELHTPFIDAVWHAGDYQLEAGLKYVCYTLPSIITYTTTGIGEDVSYDDALALDPAIDTEASALDTKSFSRLFPNLTLTRFLGDNVSIHASYGESYVTHVDIYPYYISQRKQFHDKGVTFQDLWDKRRMEISKNTEIGMRFTGSNWSIEPTVYYSRHENKQAVLYDADIDACYPINNADAEGYGIELEAEYKPLDNLKCYGSFSWNRFAFTQDIYSEKESLIDVKGEQVPDAPEFLAKAMVSWKIGDFTISPVMRYSSTRYGDVLHNEKIDGTTLFDLDLTWSKAMLGFKQVDCSLSLMNIFDEHYVSMISTSDYKTLKTSYQPGAPFTVMATVALHY

SEQ ID NO: 134 - protein, 515 aa, Escherichia coli str. K-12
MMKKNRTLFLSLALCASISYAEDDGGFFTVGYQLGQVMQDVQNPGGTKRDELERELNAGVTNNILGNNTGGNVAGALSNAFSQYLYSLLGAYPEKLNGNDVSANALLGGAVGSGTCAAAGTAGGRSLNTQSACTAAGYYWLPSLSDRVLSTIGSQTNYGTNTNFPNMQQQLTYLNAANVFFNVMNKALEAKDGTSGASGATGSNGQTYSQNAIQYLQDQQNILNNAANLLKQDELLLEAFNSAVAANIGNKEFNSAVFTGLVQGIIDQSQSVYNELSKNPISGSAVNSAGINSNQANAVQGRANQLSNALYNAQVTLDKINALNNQVRSMPYLPQFRAGNSRSTNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKVNNTHFQFLFDFGMRMNFGKLDGKSNRHNQHTVEFGVVVPTIYNTYYKSAGTTVKYFRPYSVYWSYGYSF

SEQ ID NO: 135 - protein, 413 aa, Escherichia coli str. K-12
MKTINTTLALSAFLLLGSTAYASESADIKALKQEVKELREMTQTLVDETSDLKTGFNYTTVNSEKSHSGLGAAASKVYYSKSPLSIGGYGEMYYSDAKTNNNADKTTLDVYRFVPYIGYKFSDNIILNTEIEFEHGGVANNGGTAEGGEVIVEFMYLDFLINKHANIRVGNMLMPMGLINERHEPTLFTTVQRPNTSKNLIPSTWHESGAMVYGDIIDNLSYKFAAVSALQTGVTGSSWLRSGRGGSFKQTDANMAFVARVDYTGINGLLVGASAYTAPSVNGKSSTTNMYDVHLDYKNSGARVYGVYTQTDRSDAADIAANAVEKAQGGFVNASFDVLSLTSIKKQLPIFVQYESINPEEERADGTSGDRLDTTTVGINYFPHEQVVLKLDYAMASQGAVDSDTTSISMGFI

SEQ ID NO: 136 - protein, 937 aa, Escherichia coli K12
MHVHGALLHSSDWIMIVRCSLLRPSRLSQALCLSLCALCGHAAAQETQATTPAQGEMATLDKVTVAATRYNATDMQMAATNTVNVLSADDLKTTAVHNVAEALGLMPGVNVINTGQSYFGGIDGAARGEGMFSSVRGLNAEYNVNLINGINVAQGMPYSRGVQLSLLPPSGLQTIVLNKTSTADMDGDAIGGTIDYRTPSAFDSPDRQGGSVTLSGRLESRARDYGDSGLGSGAAGDWHARFGDAGQFGVSVSAYYDERHFVNSEVASASAARNDGAWKFARADASGNLAAGADPQEVLQSTGVNIGYSQGDTRRYGGNAAFDWRVDPSLHLYARMTYAFAKTEQNTGYTQFVPANVSFTQIGSSGAYQPQINRVAVRYWYETNPEEADLATVQFGAEKQLGHWTFAPNIFYGTGNNDRPDHVEISARNDQYSSTNFAYGANRFISYNGDGFPIPLLTPAMQAQALDVGSLYARRTGQISKQYSGQDKGGGKFDVAYDLDAGLLNRIAFGVKYVDSSRSFTDRDWTNAKYTDGTLLRDTGLIAQRYDAVYPGQYAFPTVRLSNAALNDLIARTLTPASFDSCGQLAINNLNCNTMRATEAVSAAYAMATLRSGNWEILPGVRFEHTAITNTFWAQPVAIHGAEQVGAFANNHTRYNVALPSVFVNYRPDGDGAVYRGSVWTSYTRPAFVQLGGGRSTDISSDGQTTITEGNPDLKPIKSLNVDLSGEWQNDSGGHAMLAGYYKRLTDYIYESGSNAANAGESESGNIRFVRPQNGGDGRVLGIEAAVRQTFQGLPAPLDGFGIGANITRQTTRVDLGEEGFAHERIQNAPNLLANAELFYEKGPWSVNLSYHYSGEYVSVYDYLNQGANWDNLWIKPITRVDLHLGYAPNDHLRVDLSVANLTKQHSYWAHVGHETDAISDIVDSGMTSLLTAKYAF

SEQ ID NO: 137 - protein, 1161 aa, Escherichia coli str. K-12
MKSVLHQIGKTSLAAALSGAVLLSAQTTHAAALSVSQQPLMLIQGVAPNMLVTLDDSGSMAFAYAPDSISGYGNYTFFASNSFNPMYFDPNTQYKLPKKLTLVNGQVQIQDYPAPNFSSAWRNGFTRSGSINLSNSYKVTIEYGRGYDKESTIKADAAYYYDFTGSSSCNRTNQACYTRRYVSTEQRQNFANWYSFYRTRALATQTAANLAFYSLPENARVSWQLLNDSNCNQMGSGSSSGNCFSNYLRDFTGQHRVNFFNWLEKLSVNGGTPLRQAMTRAGEFLKKTGVNGPYAYRPGTQTAPEYSCRGSYHILMTDGLWNNDSANVGNADSTARNLPDGKSYSSQTPYRDGTFDTLADQAFHYWATDARPDIDDNIKPYIPYPDQANPSAEYWNPRNDPATWQHMVTYTLGLGLTTSLTSPRWEGSTFSGGYNDIVAGNLSWPRASNNDSNNVYDLWHAAVNSRGEFFSADSPDQLVAAFQDILNRISGKDLPASRPAISSSLQEDDTGDKLTRFAYQTSFASDKNWAGDLTRYSLTTQDKATVQTKLWSAQSILDAMPNGGAGRKIMMAGSGTSGLKEFTWGSLSADQQRQLNRDPDRNDVADTKGQDRVAFLRGDRRKENSDNFRTRNSILGDIINSSPATVGKAQYLTYLAQPIEPSGNYSTFAEAQKTRAPRVYVGANDGMLHGFDTDGNETFAFIPSAVFEKLHKLTARGYQGGAHQFYVDGSPVVADAFFGGAWHTVLIGSLRAGGKGLFALDVTDPANIKLLWEIGVDQEPDLGYSFPKPTVARLHNGKWAVVTGNGYSSLNDKAALLIIDLETGAITRKLEVTGRTGVPNGLSSPRLADNNSDGVADYAYAGDLQGNLWRFDLIAGKVNQDDPFSRANDGPAVASSFRVSFGGQPLYSAVDSAGAAQAITAAPSLVRHPTRKGYIVIFGTGKYFENADARADTSRAQTLYGIWDQQTKGEAAGSTPRLTRGNLQQQTLDLQADSTFASTARTIRIASQNPVNWLNNDGSTKQSGWYLDFMVNGTLKGEMLIEDMIAIGQVVLLQTITPNDDPCADGASNWTYGLDPYTGGRTSFTVFDLARQGVVDSKSDYSYNKQNVAVSGTEQKGLGGLTLSTNEQGNPEVCSSGECLTVNPGPNTRGRQNWRPIEGKN

SEQ ID NO: 138 - protein, 968 aa, Escherichia coli str. K-12
MLVSGGWTGRAQAQDGTLTLDIPAQDARRALVDLCVAAGCELAFVASPGEARRSRPIRGRMTWRAAVSRMLDGAGLQYRFIGAHGVRVWAAPASPDRPQPIAPTELEEVTVVGRLSEQIEESLRRKRKADVISDSASSTRIGELPAANLAEALQRVPGVAIEREVGEGQFVSVRGLGPLFQSVTLNGAPVAFNENIRNSTQSGRQFRFRALSADLLAGAQLTKSATPDLIEGGIGSNINIETVGGLDGDSFLSLRVGGAAEARLRDPRLDLSVAGRLVSDDGDWGLVGGLSQEGRSVLYDRFQIQRYLPVALDGEQVVAPSDVRTTVEQEDRLRRSLFLGGEWRASPSVHLRFDSLVSTFDNAIREDRIVYGLGKLLEADDAQATIADGVVSAGAVQSGTIDNNTEFSDQAHLNIVVSGMARVMLGAWRFQPRVSLSRARSKLDTPLERLSFRARLSPSYSFDVGDAVSVRKAALLRTDFDLDDPSALKWKKLGVRAIESVDDDATALIDIGRAADVRIGGLSLFDFRFGGQVSDRSRDYQRRDREAVLGPGKTLSPDFFSSRVQNGVFDQVIDEHPGSWVVADFAPFQTAFILPGESDSIVVSPGDLKPTGADLQNSYKVGERVGAVYGRIDFEGEAGSAPFFGNLGLRLVATRTAVDGALLTADDKGVAAIRGVSHTGSDIRLLPSLNIAFDLDQGRRLRLAASRTMTRPSLADLRLATAPASSLVSSIYERGQAEIDDPSPGSLFVGVGGNPDLSPYMSTNLDASYEWTFPQGALSVAVFHKTIDDFIGLVAAPEMLVFETRAGPLVHAEVLMSRPANLGRAVSRGLEVGLHRRLPSGFGLWASGTWTDGHGPEGYSLAGVSRLAYSINPFFERGPIAIGLSWSWRSAFRSEADMQGGGVSDFTVADAGYLDAQASFDIGSGGELVIAASNLTDTTDLAYEHDTRRLLQLGRVGPSVTASLRWSL

SEQ ID NO: 139 - protein, 391 aa, Escherichia coli str. K-12
MEFTFAWRRPAAMMALAALSAPAIAAEDDRPVTATLGGRLHLDFATFDNDNRGTPNKDDTEIRRAWVDVSGKFFVVDYKLEADFSGDRVEAKDVYLARSFGKAGKLTVGQFKQYFSLDDRTSSNYGSFLERGNAGTTLAPLYRLGASWQANPGDFTWAVSLYSLESIDAWQVKGRAAGGRVTWAPSPSDGDVLHLGLSLAREAYDNPGANGVPGLRIRPRPAGHLSDNSRLTLVDFSAGRDTDVNKWSLEYAQVRGPLSWQGEFSGATFDDGAQRGDVMAAYGMLSWFVTGESRAYDRKTGRFARVKDIRHKAGAFEVALRYDQMWGAQHLDGAPDLRRGSTEAWTLGGNWYLRDNLRFMLNVIESRNRDRLAGVTVDRTRAVTGRLQYDF

SEQ ID NO: 140 - protein, 230 aa, Escherichia coli str. K-12
MARARIGVARAMTAAVVLIVAGQAGAADVGQAASVPQAEACVAEAPSPWQIRLRALGVITEDSGYVNAVPGSGLSYSNTVTPELDISYFFTDNIAAELILGTTYANIDGQGAIGGLGKVGKVWLLPPTLTLQYHFTDFGAFEPYIGAGVNYTIFYHQQVGSADDLKVKNTFGAALQVGFDYMVDQHWGVNFDVKKLFLKPDFDVTVAGAKLTGKAKLDPWVIGAGLTYRF

SEQ ID NO: 141 - protein, 894 aa, Escherichia coli str. K-12
MHRNRKALAAGVASGVIAFVLLGGAARAENAADGPAGDAVDEVVVTGFRGSLVAARELKRDAEIASDVIVAEDMAKFPDLNLAESLQRLPGVAINREGGEGRRVSLRGLGPDFTRVQLNGMEVLGNVDSPMDSRGQTSRDRAFDFNVFASELFTRVEVRKSFSAEQDEGGMAGTVGLYTAKPFNYDGTRAALSVQGGTNSATEDLQHRLAGMFSRNWDDRFGVLVSAAWSKRETEEQGYNTYSASAVTPGATDLSPLSASDRAKVQSGTLVFQRGNRLSVWGSDQERLGLTAAVQWRPIDTLTLTLDGLYGEFTNDRSELHLATRASQGSTVLGGAVRHSGITSPPPRLNAVRWDQHDSVLYADVDNTVFATETRRQETKNTFQQVVLAGEWALTERFRASGHLGHEQSDYDIPMSDKFYTEAFGGLVTDYSADGRDARNTYRWDTTDPNNFRAHEIDFSATYQKTRLDNAELNLAYEFSDAATLKVGGSFRGFRNSGYAQSADDLLKTAWETGALDDRVNDYFQVFDRHDDQSWVIVDWDKALARYGVTRTVGAPRSIYAVEEDTTAGYAQLDWRAELFGRTVRGNVGARAYETELTSSGVANVGPVTVSNNYSGVLPAFNAVMELTPQVQVRVSAAQNINRPSLTAYAMNGSVSRDANSGFVTVSIGNPELDPYTSDEFDAAAEWYFGGVGLLAAGVFHKRIDGFVVSERVTDVPYSSTGLPDNLLPGVAGSANVDEFTRPINLNDAELTGFELSLQTDFFFLPGFLQDMGVVANVTFIDSKTTYPNGQTGPIWGMSDVTHNVTLYYETAKWGARVSSNYRSDYPIDQGGFRSTTYVDAAAFYQLTDKIRLTVDAINLTDEREIQFNGAQAKRLWNETSSGRTVFVGANVQF

SEQ ID NO: 142 - protein, 895 aa, Escherichia coli str. K-12
MTQYPARRPPSHALTAVVLALSSLALPKDASADKDWFDPATWPNGTVPTSGDAANIGGGERVMLSGAGAVFSLSINDSVGNTNVSSLVVSGNSASLTGSYIQVGVNGGSGALTLNDQAWLNTASLTLANTLDSRGSATVDNSRVTANSISIAGSGTATFYAQKGSTVNVNQTVLGEWGKGNGTLVISDGSTWNNSARFSVGMLSSGTVKVLSAGVLSTTSGATLGGTSNGAASGSVLVHGNGSEWRSGGTVTVGEAATGKVWLLEGGSLSAPKILIANQASSKGQLLIGGEPGSPAQPGGRLDVGAIEFGAGAGTLIFNLSGSPMSYAGTLAGPGQVRVLAGNLVYTGNSAAAISVLGDPRIFVEGGTLDVRGQLRGQTSVLDGGRLSGNGAVGATQISAGGRLAPSGTLTVNGDLSLSPNAVYEVRAAPDGTASRVVVNGLASLAGSVLHVGPDGEFAPYQRYTIMQAQTLAGAFDSVSSNFAYLTPSISYSGQDVLLELRRSTVTNPNGPEPIRFSALARTPNQRSVAQALESLPVSNDIHQAVLTLPAGAPPAALAQLAGEPLATTASALGGLAVNARSLPMAQLRRNLNAAPSPGAPTASAGTSDAPISAAVLPDRGTSPMWAQLVGQWQTGGGEDGIARFRQHTGGVFAGADGALASGWRLGAAVGVSNSKMDVGSLSSRSDIDSYSATVYAGRRFDSGAGSFNVLLGVGYTWHDIASQRHVQFAGVDQKLSANYGASTGQVFAELGYGLPVGGRSVIEPYVGLAFNDQRVRAFSETGGSAALRSERQHDQTTTTTLGLRAGTTVDDLTLSGGAGWRHALGDLRPQSRLAFADSAVFTVAGAPIAANALVTELGLSWQASRSLALSLRYDGEYGGGNKLHTGMLRAAWAF

SEQ ID NO: 143 - protein, 847 aa, Escherichia coli str. K-12
MKKVLGIVGLIFITATGFAQTITELKDCNEEDFLNNKSTTYTPPKYVLPNSNMWKKWSRNRNNRHTFGFQKSSTSLGATIITAEDIALAPARNLLDLLEVYVPGAYWLNAESGKVIGMQGWIASRNLRYQVLVDGVNVNQQTHSGAMNELENWDLDDIAQIEVIRGAAAARYGTGAVAGVILISTKAANGSKKQTNINGAFMSSYNSMGGNFSHRVSNDDLDFSFFGSWRKTAGYSPKAFSNNLNGEHIEFGYLGQDFRVAPFDKTPLAFYNDYNNAPQLKLAAHLRFRKKWNLRLRYTSAGGTVGGTATQTLQQTGMVIDSVTTDVNGFPVYAYSREYANELVNLKAFQTRQFTVSLGRQWNYIDSSSNKGYIINSQVSWNTQDYENRRDTMFTFNTTVPENTRKRLSDIDDPIYKKHNFSETTLNLRLSGTYAFPIGQITLGTEYTHRTIGIGWGDFANELRVGEEGAFVNSNKSKVIGFSAQQGGFTPSTFSEGFIGNGWYSYQTEAFSELSLSPAKWVNFTAMSRLTNHAYSKTAWNHRFALSFPINHQHSLQLSRQIAHRLGTEEQLYATYSYDNLASPERFDGVSFNYQFTPTYHWRFAVQAYQNQVELSNLHTRQNLQYFRPIGKTTYRGIELEANYTSKSFNIGANYSKVMPIEAPTYFPGNYADSLHVQTTFFNNNPNQIAKLWIRYKFFNNRATVQANFRAMWDYAYAQKDLNERVYPAFDELETVAESPQELEEIRALKQVFLQQNPYNMDARLDISASLKISDNIVISAYVLNLWSNNKGRRYTYDDGLQAHEADPQLAQFGVAVDKVVSFIYSPQRLKFIEEPLVFGLKLNLTL

SEQ ID NO: 144 - protein, 833 aa, Escherichia coli str. K-12
MRYSKLFLCAGLTLATLPCWGRAYTFDSTMLDTNSGESIDVSLFNQGLQLPGNYFVNVFVNGRKVDSGNIDFRLEKHNGKELLWPCLSSLQLTKYGIDIDKYPDLIKSGTEQCVDLLAIPHSDVQFYFNQQKLSLIVPPQALLPRFDGIMPMQLWDDGIPALFMNYNTNMQTRKFREGGKSLDSYYAQLQPGLNIGAWRFRSSTSWWKQQGWQRSYIYAERGLNTIKSRLTLGETYSDSSIFDSIPIKGIKIASDESMVPYYQWNFAPVVRGIARTQARVEVLRDGYTVSNELVPSGPFELANLPLGGGSGELKVIIHESDGTKQVFTVPYDTPAVALRKGYFEYSMMGGEYRPANDLTQTSYVGALGMKYGLPRNLTLYGGLQGSQNYHAAALGIGAMLGDFGAISTDVTQADSQKNKQKKESGQRWRVRYNKYLQSGTSLNIASEEYATEGFNKLADTLNTYCKPNTRNDCRFDYAKPKNKVQFNLSQSIPGSGTLNFSGYRKNYWRDSRSTTSFSVGYNHFFRNGMSLTLNLSKTQNINKYGEKTSELLSNIWLSFPLSRWLGNNSINSNYQMTSDSHGNTTHEVGVYGEAFDRQLYWDVRERFNEKGRKYTSNALNLNYRGTYGEISGNYSYDQTQSQLGIGVNGNMVITQYGITAGQKTGDTIALVQAPDISGASVGYWPGMKTDFRGYTNYGYLTPYRENKVEINPVTLPNDAEITNNIVSVIPTKGAVVLAKFNARIGGRLFLHLKRSDNKPVPFGSIVTIEGQSSSSGIVGDNSGVYLTGLPKKSKILVKWGRDKNQSCSSNVVLPEKTDISGAYRLSTTCILNN

SEQ ID NO: 145 - protein, 409 aa, Escherichia coli str. K-12
MRRFFIVCCLALSGMFLSLPHTARAAGFAMYEFSARGNALGGAMVARKASPSSIAFNPALITQLKGTQMAAGMTLVDPSATVEVKGQETVSAKKNYWAIPHAYATRQVNDALYYGVGVFSRFGLGNEYSKDWFGKDQLYYVGIQSLSVNPVMGLKLTDKLSVAFGIEAMWFDYEQKNIVEAGAGGRLDGRVNGESIGYGINLGIHYQPVEWLALGASWRSGIKQNLKGTGYFSGSGPLFSNWGDTDARGSVNLPDMLFLGVCVMPTDRLSIEAGAVRTGWTSYDKLVIDYNNPSVATTDKTTEWKDVWRFNVGVEYALNEMLDLRAGYVYDNSPLNENYLDFLVPANDRHLFSGGVGIHQGPWTLDLSYTYLLIKERTGSVTTTMGGENRVRFKDGDAHLVGMTLGYRF

SEQ ID NO: 146 - protein, 451 aa, Escherichia coli K12
MMKKHILSLAVVAAIATPLSQVQAAGFQLAEYSATGLGRAFAGEAAMADNAAAQARNPAMLTYLEGRQLSLGGIYVMPNVDVEGDVTLASPVLGPQGVTMNADALDVADDALVPNFYYSNQLNDQWTWGLAVNSNYGLATEVPSTHPTAIFGKETSVTTVEFNPNLAYKVSEAVSVGAGLRIVYGEGKIGASTPAWVDGIKAIPTLPAEIAGALPPGGTSLKSMEGDDIGYGWQLGASWQINPAHRIGLAYHSGVELELDGHASGLIYNGGQDVEIEGYMPLELPAFAELASYHQLTDNWAMHASINWTQWSVFDQLVAYFPGEQKPVGGLESDLVKVENFKDNWRFALGTSYQLSDKWLVRGGVALDKTAVEDEYRTITIPDSDRLWFSAGAGYQASKNLTLDFAVTYIKAHGDAPINETMNLMNLAQVSFNGEAGGDVWLLGAQLSYKM

SEQ ID NO: 147 - protein, 348 aa, Escherichia coli str. K-12
MTKPRFIRTATAVATLAACSVAAHAQSSLTLYGALDAGVQYLTHADGRHSAVQLQNYGILPSQVGLKGHEDLGGGWRALFKLEQGLNLNNGTATVPGYAFFRGAYVGIAGPVGTVTLGRQFSVLFDKTLFYDPLWYASYSGQGVIVPMNANFIDNSVKYQSPTFAGFDVEALAATSGVAGNTRAGRVLELGGQYTSNGLSVSAVLHQSHGDVSAADNTSARRRELGTLAARYAFATLPLTVYAGVERLTGDLDAARTIVWGGARYQMSSEIGLNAGVYHTDSRTPAIGHPTLFIASTTYALSKRTVAYVNLGYARNSGQSSQTVYEYDPTPLAGASQFGAMVGMYHLF

SEQ ID NO: 148 - protein, 160 aa, Escherichia coli str. K-12
MESLPTTFRENIAQTWQQPEHYDLYIPAITWHARFAYDKEKTDRYNERPWGGGFGQSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 149 - protein, 387 aa, Escherichia coli str. K-12
MSEETDMKTRLFVAFASCAIAAPTFAQSSVTLYGVLDEGLNYTTNVGGHSQVAMASGFPHGSRWGVKGAEDLGGGAKTVFQLENGFDVDTGRAFQGGLLFGRQAYMGLSSNTVGTLTVGRQYDSVVDYLAQTSAGGSWGGYMFAHPYDNDNLINTFRANNTVKYTSPTLGGLKFGATYSFSNDAGFANNRLVSVGSQYTVGGLLLAAAYLQADHPSATAYGAINNSGDQNLLGSRLRIFGAGATYTFGQAIVGLTYADTNVADPQSSGYVGPITAPAGRLSSLRFRNIEVNAKYQVGASYWLGAMYTYTRANFSATPGARHPTYHSVGLMADYLLSKRTDVYLQGMYQHVGGDATGSILDAAYVAGAENVSSNRNQLLLRAGVRHFF

SEQ ID NO: 150 - protein, 798 aa, Escherichia coli str. K-12
MLLNLAIYAQSDTNRLNTIPLDVLKAQDIIAGRASTNVEVVSASRSSKRIKDLPVTIHVVTQEEIRKNGYITLVDVMKAVPGVRVSQPGSGLDGETFLFRGQIGNYYTKILINNIPIQPSVAGGIAIGAQLPIAQARQIEIIYGPASAVYGADAMTGVINIITDSPSSCSFAQANVTLGEYGYQHVNFMAGGKVGKNKNILKYTFYGNRGKRDDLNIRHNKEVELVGQLSSEFSYKGNVFSPLPHFFASKRMSSDQVNYLRLLNTNPDQVLDSIQATYPYYQGDANKGLVNALPQESSLFGIQLEYRDFTFSYNNLFRSNHSSLGRSPDIFSYAHPDNYIADRIERTTLSYNKAWQRFALTVNASYLKYRMDVGSTYGVNYASFASSRAYTYEASDDLFFEALGTYSINKYMEVTAGFSATLSGNLPPVNESDTPFNPNDYRAFSTTQRPPHAVFGHFGDNPILHTITGYFAQLLYQRDNLTLIAGVREDASSEFTTNVDSANVVGTFYPRVAVLYKFSDNLSVRASYGRAFKAPSARNTYSSLALPVIFNGTRVPNLVQYERVPNEDLSPEFVTSYEVGVRYTLNSNIDFDLTGYYSRIDQLITQSLIPLDTAIYGANAVSQFQAQNSFRTRSAVNDVNSRSDLYGLQLAVRLSNLWPLLKFNADVYLNYAEGSEVLPNEENEEISVPRMVPKFMGQLNFSIEPFKHTYFRFENVFMTDWVRRFVPRAQASDFKIAGYYNLDFIGRYQLSKNLGVFLKIRNVFDAEYAGIGSDGLDVDLVYNPQMKRNVQFGASFRL

SEQ ID NO: 151 - protein, 490 aa, Escherichia coli str. K-12
MDKETRFYNLFSLAILGILIFPVGLANFYFGYVLKDSPCIFCWAQRINMILIGAVALLVVRFGFKPKYIALLLLMASSGLYESFYHTGSHALEDVGQGFALAILGLHTQFWALFVFFSVVVLLAVLLFFAPNAQPFKDHSLNALQKIAFYVFFMVVGSNAVQAFISTGPFPYIGQSDPVRFSWNLKESVWSMENWDHLKFPRSVLGRRDVGEPLKLSALPKDNDYERSPLEITKTLKIGKKEELFLKLNGAITDLSFNEDKAILTTENQGLYLVSNDLKTIHSHMVLDSYYSATVGSFVGADFNEDENIVIMGNNKTSVEITPNKNANMLKNFPYFLEGVNSFDEVERSRLKTSRAKNYYVSVARRGAKFTYLISAPNKRYKDLIIISMRNSDKQVHGEFLLELGNAKLKEKRGLGELVISTLALKDNKLYAFSKEFNTLLVIDPTKEEILEVYGLPKEIKNISAGGFRNDELVLVSYENNKNILYTLNF

SEQ ID NO: 152 - protein, 683 aa, Escherichia coli str. K-12
MNTARIAMLVCTALASGTAFAAEAASADFEDRDQIVVTGYAGTKTDTALIELPQPVKVITADQYEAQGAISISDTVKYAAGVLANPYGRDTRVDGFNVRGIDALQFRDGMRDIFSFYASITSDPYNFDRVEIVRGPASVLFGQGSIGGLVNLVSKSPGFETQGEINLVYGSYDRKEVLADVNLALSDSFAVRAVGRARDADTYVKHVPDDRVMFAPSLRWQPTADTDVTLTGLYQEDDTGSTSQFLPIIGTFRPNPGAPGTLDRYTFVGKPGWDRYAGRSLQGMASVAHDFSDAVRLSLKARYIDSDLEYFTHYTNSYSNPTDPFAADRRTIGLYADASDARMNVFSTDNNLQFHFNTGAHVEHKLLVGLDYSWNRVGKRYAGGLETIDLYDIDYDALLTYDPSGPFFRESQKQLGVYVQDQIRFFDRVSVVLGARRDRVTGSSGQKDNATTFRAGIIGDVGAGFSPFFSYTESFLPIAGSLSDVDGNLGDPFRPQTGTQFEAGVKWQPGPGTLVTVTGFRVKERNRVIYGEGQSITQSGELTTRGIEVEASHSLPGNFDLLVNYGYNKLKSEVNTDLDYLPRHIASIWSTKTFGLTGEAQLRLGAGVVYTGKRRSTGPAWSLVTPSNTTVDALAEVSWNNWRLAINATNLLDNRYFASCLARGDCFMGAPRNVMATVGYRFR

SEQ ID NO: 153 - protein, 878 aa, Escherichia coli K12
MITMFKSNTPFLHITNKIGTVTTLSKLIGVILFLHIQTIAFGQNGPYTIQGTIVDSTTNEPVIGAIVKRADGYVGTQTNIDGFFLIEYSGTLPVTLVVNYTGYANQSFVVTEENVGQRLTIPIHVDVNASEVITISSRRRDETAQDVPIPISVVGGARVEDAGAFNVNRIKEIVPSVQLYSSNPRNTGLNIRGLGSPFGLTNDGLDPGVGYYVDGVYYARPAATTLDFIDVERVEVLRGPQGTLFGKNTSNGAFNIVSRAPSFKTGGVFESSFGNFGFIQTKLSVTGPINQKLAARLSFSGTQRDGLIYNQTADQYTNDINNLGFRASLLYNATKKVKITFIADATRQRPNGYAQVAAGVVTTKRSAYRQFNAIAADLNYSLPTLNAFDRTIDQNTNTRSGNDLGGASVNIDAKIGKGTLTSTTAWRYWNWDPSNDRDFTGLDALRLSQNPSKHQQVSQEFRYAGNFSERLSGVAGIFAIGQTITTTGTEQAGADQWRFSRTSNTPPQTLMTSDLIDGLTQHTKSTLNTFSGAIFGQLDWAVIKNRLHVLPGLRYNYDYKDADYNRTVDGGKQTADPAEISLKNSVYSAQYFHTKATNTNLSGNLTVSYVVRNNINVYATYSNAYKPVGVNIAGLPTTSTGEADLSLATVKPEYTTNYEFGIKTSPTKNSVLNFAAFDTEVKDYQANVQSPQLGVNRGYLANAEHVKVWGLELDGNTKVGKYLTLNAAVSYTEGIYKKFTNAPLPLEETGAAVSFKDISGGSLPGISKWASSIGAEIALPGKFFTNEGKYFFAVDNFNRSKFSSSPSPSQYLNIDGYSLFNARLGFRATKGLTVFVWSRNVFNKNYYEQLLPAAGNTGLYAGVLGDQRTFGTTLRYAF

SEQ ID NO: 154 - protein, 617 aa, Escherichia coli str. K-12
MKTCISNLRLAMLPLALATAFPSAAQTHPAPQLKETVVTATRSAQPLSDVVADVTIIDRERIERSGAAGLADVLKRVPGIEISRNGGPGATTSVFLRGAESRFTAVYIDGVRVDSQATGGAAWETIPLALIDRIEVLRGPAGAVYGSDALGGVIQIFTKRGEQGFAPFVGVGVGSHNTRKLDAGFSGASGGFDYALGVAREISHGFDSQPQRLSNSATPLSNPDQDGYRSTSANARLGFKINRAHSLDATLLYSDMKSHYDAFGYSPARPVDDLSLHKLHALGLNWQAQWTDAYSTRLSMTESEDRYETTPSPYQTTTRLRGYTLQNEFRLGAHLFTAALERKEDHLKNAPIDQGRSQNAVALGYGFTEKSHTVQLNVRHDKDSEFGGKTTGSAAYAYAFTPEWRASASAGTAFRAPTLYQRFSEYGVATLVPESSRNLELGLRWSQGASSAGLVAYRNKVDNLISFVGAGTCASPFGCYANTARAEYSGATLTASHAVGGVNLAASLDLQNPRDLNTGKQLARRARQHGLLSADMRVGSWLLGAEAQFSGKRFDDAANTRVLSGYSLLNLNASTPLAKDWTLLARVDNLADKQYELARSYATAGRSFYVGVKWAPL

SEQ ID NO: 155 - protein, 200 aa, Escherichia coli str. K-12
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACAPLAEIIPDASVTFNVNKLRLEISVPQIAIKSNARGYVPLNVGMKGSTRYYWDIHLAGLTVFIAAQTVILATVIF

SEQ ID NO: 156 - protein, 396 aa, Escherichia coli str. K-12
MQIGKLVQGFKPKRLTTALAMMAIAAGPAAVQAGPTIMYGDEGFLTLNYELQIWSQYRDFRSAENDGDSYDTFLRRNRITVLGQYNDYVGFYAQLEAGNDSRYGNDERPVYYRDAYITFDWDDSLRFIVGRFKNTFSRENLEACLEPLTLDRGIISYTPFGGTRDTGIAMWGNLADARVQYRLMVSDGREGDNVPSDTPRITARAHYSFFDPEFSYGYRGTYLGTQRVLTIGAAYDYQADAVYGNLPGRTDKQDYSAWTVDLFYEQPLEAGTLTLSGAYFDYSVNGALKGDELLVDNTVTPTAEMTGYYVKAGWLFPQRIGIGRLQVFARHEASDYDRNDDFFDQTINAVGANYYLDGQQLKLTFEYADVSFDAQHPTINSLRDHKQATLGFQLLF

SEQ ID NO: 157 - protein, 916 aa, Escherichia coli str. K-12
MKKKTALIVLFVACLGSLNSQNLLKGTVLSSVSENPISNVLVRIKNTTMTTRTDTHGRFVLEVLKEGTYMVEISDPEFETQNFKIVFSTGVVNLGTILLFEEYLQVQDLSIITITDDELNADSNAADNISGLLQATKDVFLRTAAFEFSASFFRIRGLDSRNGKVLMNGVEMNKIYDGRAQWGNWGGLNDVLRNQEFSNGLAVSDFTFGGLLGAMNMNTQASKQRPGTRVSYSSSNRSYVHRVMVTHTTGISKKGWVFTFSGSRRTGKEGFNEATTYNASGFFAAIGKKINDRHRLNFTGIFTPNRRGKSSPNTQEVFDLKGIAYNEYWGGLHGRKVNSRIKEVAEPLLMLSHYWDISKKTSLQTNIAYQFGKIGNSRLDFNGGASPSPTYYQKLPSYFLRNNKLSEAYTAQENFMDNGQIDWWRIFDANSTNATAALNSAYILYEDRNDDKQLTINTIYNTAINNNIALNAAIEYKQLNSHNFAEVIDLLGGVGYLDINNFAKTAAQMQNDVANPNRVVAVGDAFKYNFDLSSVLIKTFVQAQFKYHKTDFFLAAKFSKTTNQRTGLYQNGRFENSSLGPSEVLSFTDYGIKAGATYKLNGRNLINVKAGYLTQAPLLRNSFSNSRENNNIVENLQREKALSIDLSYIRRSPIITARVTGYYAKIREATEISFYFGDGVGGDNTAFVQEILTGIEKKHMGLEIGIEAQVTATIKLKAAAAVGSFTYANDPNLYLTSDRTNEGVFDENGRSGDYVSNLKNYKIAAGPHNAYSVGFGYRDPNYWWVGSTLNFFSNTFVDIAPLTRSSNFYTAEDGLTFPNYDLDLARELVQQEKFDAYKVVNMVGGKSWKIRGYYISFFGTINNLLNTAYKSGGFEQGRNANYTQLKEDKALKKPVFGNKYWYGRGTTYFLNASVSF

SEQ ID NO: 158 - protein, 676 aa, Escherichia coli K12
MRRRFPLLASAVALASASTASLAQAEPVELGEIVVTAAGFEQNISDAPASISVISGEELAKKSYKSIVDAVNNIPGVYVTGGGGAQDISIRGMDDSYTLYLVDGRPVSAGRSVNTNGQDGGKQIALPPISMIERVEVIRGPMSSLYGSEAMGGVINIITRKNRGEWAGTISSEYTKSLNDVSNDSRQTSLFAGGALVEDLLSAEVNAAWGGDDESDFAGADDSARSTPESKRKQGGAKLILTPDSRNEFALSYDSSRLEETSTPGKSVAEDETGSNYIYDKDVYVLSHAGNYGDWLTRSFIQHDLSERVQDQTKKEKVSMLDTQATRFWGDHVLTVGGQYKKEKLTDETNGLLTSNIPGAVRSVDRWIAAVYSEVEWGLTEQLSVTTGLRYNDDELFGGEFSPRVYALYDLTPELTLKGGVSTGYRQPGLADVTEGFGRGTGGGGSPAPHPRALIIGNPELDPESSISYEAGMVFDSRAMGLNASVMLFQTDFKDKIAEDRLCESPNGDRDDPATWTCSFQGNDYLFLSTRANIDEAEMRGVELTLDYRLTDAVTLNSSYTYTDSEQKTGEYKGEPLNKIPEHMANANLDWQANNRLNLWFQANYRGETSDYLGRRSMSDGTPGYTLMDAGLLYQLTDTARVTAGLYNLADKEITNDDYGVVLDGRRLNLGLAVDF

SEQ ID NO: 159 - protein, 1128 aa, Escherichia coli str. K-12
MESNHSIQKSNLLRALLVLIFMAIPLQWATAQLTLSTTRTNLGTVIKQIQSQSKYQFFYNDKLSATQVEAVNVKDASLEQVLNSLLSGTSISYKVEDNIVYLSEKNAQQTNQQQVGQEHTITGQVIDTKGEMLIGVSILQKGTSNGTITDMDGNYTLKVSGEQPVLVFSYIGYKTLEIPGNKPTLNVTMSDDTQVIDEVVVTALGIKREKKMLGYAVQEIKSDQLNKTGDPSVTSALQGKVAGLQMNTAGTGLGGSTKITIRGNSSLSDNNQPLWIIDGVPFSDNNSSDASYYGGVDRGGASVDINPDDIETISVLKGPNAAALYGSRAGNGVILITTKKGSKKEGFGVRYSGNFTWSTVAETLKMQERYGQGTDGVYNKAASSSWGSELDGHMVEAWNGEQRAYSKYGNKLEDYFNTGFAHNHNVSISNVTDKSHFRASFGSSNNKGLFPNEKLDKINIDLNAGAEMNQYLSMEGKVSLSRTKAEDRPYFGSYGVIAQLIGIPHNVSLDDLKNYSTENSAHVNWAGPNPGLENPYYVQDQRHNSDERWRAFGYYNAKINFTDWLHFSAKYAFDYYRTRVQSTDLSNGIGKTIENITDDRMSRSEENFFESNAEFILAGDNRIGENFRIGYTVGANFMYQKFETLSAETKDMVNKNQWIFNAANILNSAAEAGHERATNSVFASAQLAWKEYLSMDLTARNDWSSTLPSSNRSFFYPSANLSFIITDFLRSLDKTLPSWLTFAKVRLSAAQVSKDTEPYNLYNTLSYAFSNGVLNITKSDIKKNDQLKPEISSSYEAGLDMKFLNNRLGFDFTYYNSRTKNQIMKVPAPAPWSGGKMINSGLIVNQGFEFMLYSTPVQTKDFTFDLNINLSRNVSKVKELADGVDYLFFNGDANFPINVGTRVGHRLGEIYAKNLYKRDENGNMIVNKQGRPTKVSGEDAFQYTLDHPIGNIEPDLLMSVSPSFTYKGFTLSALFDMKFGGDIVSVSEAMATSTGLAARTANRGNAENGWKIVAPGVTADGTVNSTAMNAQRYYTSMSGMAEEFVYDASFIKLKELSLGYSFPKSILKKTPLTSLNVAFVARNLAYLMKHTPGTSPEGGYDTSMFSQAIDYMSVPYTRTFGLSINLGF

SEQ ID NO: 160 - protein, 926 aa, Escherichia coli K12
MTHWGRSFWGRLFPLWFALSLFSLQNGYAEQTGRIIGKVVDEEAKVPLPGATIDVVGTLIGTATNLSGDFSLVLPSTFEGKQEIKISYLGFETQTVEVDVKSGETVTLNVIMKSKLLQTGEVVVTGQLEGQAKALNQQRASETIKNIVAADQISRFPDPNAAEALQRIPGVNIERDEGEGRYVFVRGLSPQYTNVSINGEQIPSPEGDVRYIALDAVPADQLASLEVTKALTPDMDGDAIGGNVNLITRTAQSDVLKVNASLAGEYNDLVSKFGYQSSVNLGQRLNDGKFGYMFNLSYHPSHRGSQKNEMDDWALDNDEGLPELQTFELRDYDIERNRVGLSSTFDYRFDDNNMIYLRALYSDLREHENRRRVEFSYDEDDDEWTINKNMKSRPENQGVYSFNLGGTHASNNFNLDYEASYAYARQETPHDRQLYFEVSGLDIDLDVDDALVPKITSVKDEDGNTFCYCSETDAFEFDKYEESETMATDQNITGKVNMAYPFQFGKTPGKLKFGGKVRFKDKDYEYKYYNEWKLKDGIDDLTLSQFLGEYESDDFANGDYKTGKFPDVASFRRYLLAHPDYFENDEEAALEEKTLSEYDASENVYAGYVMSEFQFNKLMLLAGVRYEYTDVEYDAGEWDAENDAAVKVSGTNNYGLVLPMVHLKYNLNDFSILRAAATYSYARPNFGDMVQGAEFDLDDKEAELGNLDLEPVKSFNLDLFGEHYIGSVGVISAGFFYKSLSDFIYKKTYDGTFRGVEDVEITQSVNGDDATLWGLEVAWQQNLTFLPGVLSGLGVYANYTYTNSSATVKNLAGTDEAETEIDLPGQSKHVGNLALYYTRGGFNARVSANFNGEFISEIDGDDLYKIDDRLQIDVSASQRLSDNVSVYGEVINLTNERRVDFYNTLDTPATREYYGFWARLGFKYSL

SEQ ID NO: 161 - protein, 215 aa, Escherichia coli str. K-12
MKYQLTALEARVIGCLLEKQVTTPEQYPLSVNGVVTACNQKTNREPVMNLSESEVQEQLDNLVKRHYLRTVSGFGNRVTKYEQRFCNSEFGDLKLSAAEVALITTLLLRGAQTPGELRSRAARMYEFSDMAEVESTLEQLANREDGPFVVRLAREPGKRENRYMHLFSGEVEDQPAVTDMSNAVDGDLQARVEALEIEVAELKQRLDSLLAHLGD

SEQ ID NO: 162 - protein, 535 aa, Escherichia coli str. K-12
MYTRNLLWLVSLVSAAPLYAADVPANTPLAPQQVFRYNNHSDPGTLDPQKVEENTAAQIVLDLFEGLVWMDGEGQVQPAQAERWEILDGGKRYIFHLRSGLQWSDGQPLTAEDFVLGWQRAVDPKTASPFAGYLAQAHINNAAAIVAGKADVTSLGVKATDDRTLEVTLEQPVPWFTTMLAWPTLFPVPHHVIAKHGDSWSKPENMVYNGAFVLDQWVVNEKITARKNPKYRDAQHTVLQQVEYLALDNSVTGYNRYRAGEVDLTWVPAQQIPAIEKSLPGELRIIPRLNSEYYNFNLEKPPFNDVRVRRALYLTVDRQLIAQKVLGLRTPATTLTPPEVKGFSATTFDELQKPMSERVAMAKALLKQAGYDASHPLRFELFYNKYDLHEKTAIALSSEWKKWLGAQVTLRTMEWKTYLDARRAGDFMLSRQSWDATYNDASSFLNTLKSDSEENVGHWKNAQYDALLNQATQITDATKRNALYQQAEVIINQQAPLIPIYYQPLIKLLKPYVGGFPLHNPQDYVYSKELYIKAH

SEQ ID NO: 163 - protein, 544 aa, Escherichia coli str. K-12
MKTFVRTGLTLLALSACGQTAGFAQEIESNLQQEQRLNEVNNYMAHELDESVDQVTTVTGFSDVQPTDWAYQALKRLVEGYGCVAGYPDSGFRGNRSISRYEAAALLNACLERISAITDEIRRLIREFEPELAILKGKVDGLEANIGELEAMQFSTTTKLNVFAVWNLNANSFSGSGKSDDYNEANGGTTYAYTILPMLKTSFTGKDMFEVIFSASNFDLNSPSCGNPYLGSASAYCLASENKLEIYRMFYKFPIGEDIEITVSPRMQTFDYITVGTAALSPKSGNLVGLRNLYNDMITFTNVPAAYPYIIGGGAAIKYKKNGWAADFGYLTSNSNSSDSTLGMGGGKTQGNMAAQLSYSSQRAGFQLGWTRTQYGDSAAGSTFYYMQGTPLATNPFSENVFVSPAPMTVQTGGLAGYWYITEDFSISGGVNLGFYESDLTTQYSKRGDEAMSKAWLATLQWERFPTEETTIGFAFGQPSSIQWSDATLGEDHGDPWIAMANLTWQVNNYITVTPIIYWFQGMGGNQDQNGSSLGASLMTTFYF

SEQ ID NO: 164 - protein, 754 aa, Escherichia coli str. K-12
MSEQKSNQRSGGAQHSTHASRRRPILRHAPLALAIAALGAAQAQTASPQEDTLGITQMDTVVVTASGFEQEIKNAPASISVITREQLESKPFHNLADAVADVEGVSVERGGKAGGMNISIRGLPSDYTLVLVDGKRLSQNSSGARPNGFGDVDTNFIPPMSAIDRIEVVRGPMSTLYGSDAMGGVINIITRKVAREWTGQVTLDGTAQGDNRYGNNYGSSFYLSGPLQTDKLGLSLRGGLYRRLSAHGSYPANQAEYDSGDYSGDIASFSGLGDSLQRNVGLRLALTPNRNHDILFDVDANWQTFDNANGELGTLNADVAPNRQGGGYEPEMKFNRQRYALTHLGRYDGAISSDTSLLYDTTETIGRTNPMSTPRQPSDGEKRELEYENWVFDTKWTMPLFNDRHNLTMGGQWREQKFKDTLVSAPLNLRQYQWALFAEDEWRIVDDLALTMGARYDRNEQFGGKWSPRGYLVWNATPAWTVKGGVSKGYKTPDINLMTDGIIGLGAQGTMPLLGNSQLKPESSTSSELGVLFDDGEGLTGNLTGFHTKFKDKIDTQNVPNCLAAGGPVPGCLDLGVWERNGVPVANFSQRVNVDTATIQGFELGGRIPLFEGWSFSGNYTLTASEITSGAKQGQPLGSQPRHSLNLGLNWRVNERFNAWVRGEYRAKQFNDMNWEKEQVFYSPYWLASLGGSYVLNKNVTLSASVYNLFDKNFVDYGPTKVGTSAPTAATSWSNSYRQVLEGRRLWVSANITF

SEQ ID NO: 165 - protein, 819 aa, Escherichia coli str. K-12
MKKNIAIVSLLAVSIKSALAGPVSPENSLPKDTTKVIDIEEVVVIATPKENNRLRQQATSSTSFSQSAMRNNSVTSVKSLSALVPNLFIPEYGSKLTTSVYIRGIGSRINTPAVGLYVDNIPFIDKSAFDFNYSDIERIDVMRGPQGTLYGRNTMGGLIRVFTKSPFTYQGTDLRLGAATYNNYNASLTHYHRISNQFAFSVGLFYDHKGGFFKNDFNGKRIDTDNEFGGRIRAIYLPTENLKLDFTVNYEYTNQGGYPYEYTGKVKGEEDRAEYIGRISYDNACGYKRNLLNTGVNLEYQADNFILSSVTGFQYLRDHMDLDQDFTEQNIYTMMQKQNSKTLSEEIVLKSKPGRRWQWTTGVSGFYQWLDTEAPVTFQKDGVNWLNSTINTNANKYMPTISMGAMSMKLNFNDVINGEQLAIPGKFSTPILNGAIFHQSTFNDLFGLEGLSFTAGLRMDYESLKLDYYSGCQFTHTYSLSGTLTPANKVIEMIPAQEFNVNNGYDGKLSHDYIQLLPKFALQYDFDSRNNIYASVSKGYRSGGYNIQMFSDLLQNDMQASMMKHVADVTIPVVNNVPMLNEEQKQMIAGMLNGMAQSPQTDVKAATLYKPEYSWNYEIGSHLTLFNGKLQTDLSAFYMDTRDQQLSRFAESGLGRITVNAGKSRSLGAEASLRAQLTDQFSLNGNYGYTYATFTDYVISETENYNGNYVPFVPKHTFAVGGQYIFPLRKNAILDNITLDANYRAAGRIYWTEQNNASQALYGTLNGRLSLNKGNGQIGFWVNNALNKDYQAFYFETMSRGFAQKGRPVQVGIDIRCRF

SEQ ID NO: 166 - protein, 795 aa, Escherichia coli str. K-12
MKKNSILIALALFSASGTWAEELPKDTLKVIDVEEIVVIAAPKENRKLREQPTAVTMLSQQDMQANQVNSIKSLTALVPNIFIPDYGSKLTSAIYIRGIGSRINTPSVGLYVDNVPYIDKSAFDFNYADIERIDVLRGPQGTLYGRNTMGGLIKVHTKSPFSYQGTDLRLSAGTYDNYNASVTHYHRMSNQFAFSTGAFYEYGGGFFKNTYLNKKIDKSQAAGGRFRGIYLPSENMKLDLNVSYEYSDQGGYAYGAYDKHTGTYLKPAYNDPSSYYRNLLNAGLNLEYQGDHFTLSSVTGLQHLRDRMFIDQDFSPANIYVLEQKQKLTTISEEIVLKSKSGRRWEWTTGAFGFYQWLNTNGPVTFKEDGVTEMLEKGINSHFPDLSAMGMKMNLDITNPTLLVDGRFHTPILSGAVYHQSTFRDLLIEGLSATVGLRLDYEKNWMKYNSGSTIDYQFNMTSPFMPVRLEQTSSPRLNGKFSNDYLQLLPKFALQYEWKKGNNVYATVSRGYRSGGYNIQMFSDLIQGNMQNDMQGQIKAGTKQIFDRLVTQGMPQAIADRILSNIPDAGENADPKASTIYKPEYSWNYEVGSHLTLWEGKLWMDLAAFLMDTRDQQIAQFAKSGLGRITVNAGKSRSYGAEAALRANLTDALSMNASYGYTYATFTDYKTIDRGQNEISYDGNYVPFVPKHTLNVGGQYIFRIAPRHWLDRVQVNVNYNGAGRIYWTEQNDVSQSFYGTLNSRVSLAKGNGQIDFWVRNALDKKYATFYFESMGNGFMQKGRPVHFGVDIRCRF

SEQ ID NO: 167 - protein, 713 aa, Escherichia coli str. K-12
MNKLPFTLSVLALSIASAHAETDTQNEGVQEMETMVVTATRYTQTPDKIAGAVTVIDSEDIEEQSIISDDLTSILATLVPGITPSRQKMSNQGENLRGRQALIMIDGVPQVNPLRNGNRYGYTIDPSMVERIEVVNGASAVQGMGATGGIINYITKGAKPGDDWKQTVGTRVTSSFDNDSTGGKVFYNVSKYDDEFDLFFGGSWDQQGLYYDSNGNPIGMNDIQGETQDSTATDIFFKGGYNFNDGNQRIELTANTYTIEANGNYKGVKGDFENGIPGTVEPGSPSGEPVSNEAQLFNLQYTNYDLGNGMLTAQMFYQNYDAVFGEATWYPTETKVNDQGAISSQKTGFKVGYETYDLLDLDDTWVFGLDGLHDQTEQTLDQSGLNVTPLMEYYSLAPFVQGDFLVTDALRLSTGVRYESIRVKVSDGQTIYGYGVDGHNSEIIGGTQDSSKSVFNVGAVYTFTDEFSTFASFNQGFGLPDIGRILRGNWVGDANPGQNGTPIDFNTMPAVEPVVTDNYELGITYRGDKLFVSASTYMSIAKDGANLALNNNGTYDVERQRTDIMGYELTSTYQVLDSTKLSAMYAHVEGEVDTTGNGSVDSDMDLKNLTPDRLLLAVNHNFSDVLASRIQYNYLFDSKKSANNVGAEQNFDGYGLVDFSTHYDMRDKGRIAFGIENVMDEQYINYFSQIRNNSSYYFSGRGRTFSLSYELDF

SEQ ID NO: 168 - protein, 298 aa, Escherichia coli str. K-12
MRPLIGLATLGLAMLPEPAIAQPLAVADAPAGWLGLRNRPFSVARLIGEPRARRADAARARTLGPAPDGERLISFARSGTDAPSASLLLRDAPRFSRLPGKQTEDYEVGLRSALAGEAITLQAGLSYNKFRNLQTSLRQGGRLMTASAGKAKTYGVESMARWTASGHVSLFATAAYREGRLKNRVRDGRKFRLSPDRSASLGAVVLIPAGAGRIAFIPSLAYQSAMGLGRDDGGQGASALVNAQIGYAFSDGFEVEALAANLLDSRPARPAARSATAQIAGEPRVFGVRARLRFGAGL

SEQ ID NO: 169 - protein, 167 aa, Escherichia coli str. K-12
MPGNRPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERHNLNLRQHLARLGRKSLSFSKSVEQHDKVIGHYLNIKHYQ

SEQ ID NO: 170 - protein, 890 aa, Escherichia coli K12
MGFALAPLCLAVANTTLAQQGESVIEEVMVTGSYIRSTSQDEASPVEVLSNDYIVNSGAVDVGELTSKLSVSSGTENNPDSFTSGETQGTSNVNLRGLGLTSTLVLVNGKRQTITAATANDGSVFVDTSTIPMAALERVEILKEGATATYGSDAVAGVVNFILRKDFEGVEVSTGYEEISDGGAGKYDLNVLAGFGNDRTRVTLAGSFISQDPLSSSERPYTTENAVSTLGRSFLTLAPGGVGTGDYAGSYGFLETIPDAACTANGGAPGTPFVPEGAFGPGTGGGGKCGFAYGPRFNIVNKEEKQQLYGNVTHDFSDSLSLVAELGWTHHEVKDNPQSPSYPALTFPTLLPGTAGSPFSVPVRWYGRPLGAEAPSPLAPRDSDTLRASLQLDGEFDSGWSWMGSLTYSENDREVYQPDTISSRLSAALSGAGGPSGTESFSPFDPSANSPELIEWLSYQTFTNKKTDLTVADFVVSGDLFEMSAGPVGFAAGAQWREESYSANRNELYTQSIDPATGATIPVDLIFLGGGLPIDESRDSYAVFAEANFPLTSSLEANLAVRYEDLSSDSSIDPKLSLRWQAADWLVLRASASSAFREPSLVQVYNQETSLQGLVDPASGSSSALFVRVNSQGSTALEPETSTNFNMGAVFTPTDNLTFRVDYWRFEYEDVITVENAQGKLNDNPNGADIIRDSAGTLSGVNVAYLNAQEVTTDGIDVTADWMIPSNAGEFGLHLSATHFLSYEIPCTAANDRGCTGDSGVQDVAGYFNYDNFARSIPETKVNATADWRVGNHKIALLAFYTSEYETSRVVPDALLDRGYSQDIDSWMTLDLQYSYSFNLGNTEAIITLGGKNITDEDAPRLFDAANFSYDPKHHDPRGQIWYGRIKLAL

SEQ ID NO: 171 - protein, 403 aa, Escherichia coli str. K-12
MRVLKTLAQTTVLGCAVSMIPAAAFAGGWSTEGIADYDLLFADGKFVFETQATYADRNVDFKNAKTKQNTAFPVADDTNNSSANDIAPNIAVFSNSVKIGLLENLDLFARINQPYLIREQPGFDWNGRFAIGETNADALGVDAMLSYKHELSKGNYIRVFGGLRSVTVDYEQLSKTLVAPTVERDTEINVDSDREYGYRIGAAFEKPEIALRAMVAYESGIDVKLDGALAIQGAGSYGASAKATLPQSIEAKVQTGIAPKWLASFGVKWTDWSVLNELAVDVDSPGGAIPTNVVRDLGYSDGWIVEAGIGHQLTEKLSLGSSVTWDKGIGGPYSDTYSLSLGGSYDFAKNVKFTLGGRAIYKTSGEGSYDIVKTGAVNSDVSTEYEYDSSWNFAVSSKLRVAF

SEQ ID NO: 172 - protein, 770 aa, Escherichia coli str. K-12
MPHDPRKPGDRPATSFDNPAVGGRSPVFVGAAARDSLCVVPSGIHSFLTSSRNRMSRTSLLQHLASPSLCFTLLPCMAYPALALADQKTSLVLPETQVSGVSSAPQTSLDTPLPAGSRLNLTALETPASTSSLGNDAISNRNNLTVQDAVTRSPGITSIATPGNGNTALSARGFTGHSSVMTLFDGARLYTGAGSQTFPVDPWMVERIDVIRGPASVLYGEGATGAVINVIAKKPFDGEIHNRLRLGYGSHDRQQLGLDSGGSLTDTLSYRLTLNQQQSNGWVDQGQSRSLALSAALRWQATDDLGFTLAHERGESEPASYFGTPLIAGQYRDSLRDKNYNLRNAVQRYNDEWTRLNTDWTLSDNLSASNQLYYIKSRRHWRNAEAYNWVSSREQLLRGDYLEIKHDQEQIGDRQSFTFNHSLFGLDSRTVIGLEYNRIRFGVANNSPYKDIGSDYIDPWNPAPGYFQSRSPFLPQTDSSTRTFALFAENRLQLSERWSLVTGIRRDQNHIDRSDLRAGTRTDRSLTGGNWRAGLVFAVTDQLSLYGQYSTSEDGVSNLISLNPSQLQMDLTEAKQTEFGLKQQFWNGRGEWTLAAYHIVKKKLLTTDPVTRLAQQVGQQSADGLETSLELALDHGWQVSANASLVRAEYDDFDEVVSGKAVSRAGNRPTNVPRRTANLWLNKALAPSLEAGMGLRYVDARYANTANSVDVPGYTVLDANLGWQALPDVRLGLQVNNLLDRRYAAAQQNSGQQWLMGEPRSLFVTADYSF

SEQ ID NO: 173 - protein, 281 aa, Escherichia coli str. K-12
MGSMKRSLSGIFAALLIATNAYSADLAPAEPIPEQPPEVTVTEATGWYLRGDVGYAFTDLRGARYFQGSNATEVDFDDADLDDTWTVGGGVGYQINSYLRTDLTFDYMTEADFNGSTVGQCGFPLVDCTSSDRSSLTAYTLLANAYVDLGTYGYVTPYVGAGIGGSYVKWKNLSNVACADDGSFCDDEVSHGGKGNWRFTYALMAGASIDVTCNIKADVGYRYLHIDGGNMFGYADNGGPGRDKGLSAHEARVGARYLFGGCAQASYEPPPEIPLQQPVYK

SEQ ID NO: 174 - protein, 955 aa, Escherichia coli str. K-12
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGSPGVIFGNDLTIRTQSANAANNGRDVDGIRTHGANTPDNPVFIITGDRTRIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVSLGENATISVNSASKAASYSKAPAGLYALSRGAINLAGGAAITMAGDNSNESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVIPDPVDPDPVDPVIPDPVIPDPVDPDPVDPEPVDPVIPDPTIPDIGQSDTPPITEHQFRPEVGSYLANNYAANTLFMTRLHDRLGETQYTDMLTGEKKVTSLWMRNVGAHTRFNDGSGQLKTRINSYVLQLGGDLAQWSTDGLDRWHIGAMAGYANSQNRTQSSVSDYHSRGQVTGYSVGLYGTWYANNIDRSGAYVDTWMLYNWFDNKVMGQDQAAEKYKSKGITASVEAGYSFRLSESAHQSYWLQPKAQVVWMGVQADDNREANGTLVKDDTAGNLLTRMGVKAYINGHNAIDNDKSREFQPFVEANWIHNTQPASVKMDDVSSDMRGTKNIGELKVGIEGQITPRLNVWGNVAQQVGDQGYSNTQGLLGVKYSF

SEQ ID NO: 175 - protein, 776 aa, Escherichia coli K12
MISGRVISTEKEVVDFATVYLKGTNYGSYTDEKGIYHLKTVEGEYILVVSAVGYQTVEKKVKLAKGERIKVNVTIAPKVKELGEVVVTTSGVGRVNKSAFNAVAVDAKKLHNSTQTLAGALTKVPGVKLRESGGVGSDMQLYIDGFCGRHVKIFIDGIPQEGAGAAFDLNNVPINYADRIEVYKGVVPVGFGTDAIGGVINIVTNKQPGKWFLDASYSYGSFNTHKSYVRFGQIFKNGFMYEVNAFQNFSDNDYYVDTYVRDFEIREDGSVRFPPLDKSKIYHLKRFNDQYHNEAVIGKIGVVGKKWADRLALSFNYSYFYKEIQTGVYQDVVFGEKFRKGHSLAPSLEYYKKNLFVKNLDLLLTANYNHNLTNNVDTASRAYNWRGEFYERGSRGEQSYQNSESKNKNWNGTLRMNYHIGEAHTFTFSHVVSDFERTSRSIIGASSKFTDFSIPKITRKNVSGLSYRLMPSDKWNISAFAKHYRQYNKGPVSQSTDGIGNYINLSNTVSAFGYGAAGTYFLWKDFQVKLSYEKAFRLPTTDELFGDEDLEAGKVNLKPEKSDNLNLSFSYNYQFGKHGVYAEAGLIYRDTKDYIKRGLDVLGGTSYGYYENHGHVRTKGYNLSLLYSFSHWFDVGGTFNCIDTRDYEKYLAGTSLQESMHYKVRMPNLPYRYANINANFHWNDLFIKGNVLTIGYDSYWQHDFPLYWENIGDKDSKNMVPEQFSHNLSLSYTMKNGRYNVSFECQNFTDAQLFDNFSLQKAGRAFYGKFRVFFGR

SEQ ID NO: 176 - protein, 746 aa, Escherichia coli str. K-12
MYSSQYAGNEKKTKKSNQETLFLKHHAAKNALYAGIAAGTVFLYSQSAYAETQTTTKENNAVSAVALPEITVEDSREKKPVYSGSNGQVLETSHTGFLGDKDALDNPFNAISYTDKYIQDQQSNDISDVISATDPSVHSTNTSGESRESYSIRGFSFDSNDATVNGLAGMAPYYRSATEMYESVDVQKGPSAMLNGMPPSGSIGGSINLVTKRAGNDPLTRLTTKYLSDSQVGASVDVSRRFGQDKQFGIRVNGAYLSGDGTIDHQENESQLGAIALDWRSSRIRLSADIYHTKENVDAPTRGINLAKGLDIPRPPSNDTLLNPSWNFFESETKGAMARGEFDINDQLTAYASVGITKWDYHGLSADKAEIYNSAGDIKTTLGATGDDNQRKSLEIGLNGRFQTGAVKHQVATNITRYEEEYNLYAARFKGVTIDSNIYNPVWGTRPDLDLNLPLLTTTETTLSSFGLADTLSFADDKYQLTLGARHQQIKTKETGGILSTGADYNKSAISPSAALIIKLADQVSAYANYIEGLSKGPIAPTTADNAGKKFAPYKTKQKEVGLKLDLGDFSHTVSLYEIEKPNSYTDPNTKLFGIYGEQRNRGVEWSFFGTPVDHIRLMGGLTHIEADLRSTSNGDNNGKQSAGVPKWQAKLGAEWDTPYIQNLTLIVNANSISKQYLEDDNKRSIPGYTIFGLGARYVTSVNQQPLTIRANINNLTDKDAWTTASYNALGLVEGRSLTVSATMDF

SEQ ID NO: 177 - protein, 842 aa, Escherichia coli str. K-12
MQRLCLVNRYAVGWAGAALLWLARAAGAEPTPVARLDELAHPLTRADALLAQSAIDFPPAAADAAVQITGVQLTPTDGGIEILLETNGKRPLRGQKAGEGNRLSVDVPNAQLRLPDGRIERRADPAPGVTAVTVAPFGAVGVRIIVETEGPLPLSELRQTERGLLLSLLGGLEEEVVVTAQKTPQKPQDVPISLTVLPRQLIEDADITSLRGIAQNTPNFTIFDPGGTRSFFFYSIRGLSNFNFASQDGAAFYIDDVPYDYGSFITQELTDLERVEVLRGPQNTLYGRSSQAGVVNIVTRKPANRYAFTGLAGYGSNNNLDLRASVNVPAVADQLFLRLSGNYGRRDGFFTNTFLGTNLGGVAGGTGRGQLLWTPSPNWEVSFHANVDDYRDRGYAGLIRINPDPFRLEQNFDGFNQLNANTQALRVFYRDENLRVSSITARRFSRQESATDADFSILDGATFTNVFSSTVWSQEIRLQSPESAKDFQWLFGAYYESREFQTAKDGFNFNSQAPLVFGEAGIAGASLLRSADTGAQTYAVFGQASYKPGAAWTLTAGLRYETNRSLLRAAEQVFAIPGFPATALTAFSNVEKNGDALLPRFTAEYRFAANAMIYGSIARGYKPPGVNIRPETADNTAFEAEFSWNYEIGLKSAWFDDRLGVNLALFHNPVSNYQVNPLDAFGIPRGVTNADVAITGGELEVRAKLSQGLDLVAGFGLADAWFADYTDRATGQSFNGKRLPFAPALTYNVAVQYRGWGGVFARAELVGRGSTYFDEGNRFRQDPYALVNARLGYEFGDYGIYLYGNNLFDTRYVTLAADGPSGSILGTVGSPATFGAQFKFKL

SEQ ID NO: 178 - protein, 1543 aa, Escherichia coli str. K-12
MRVKAYILSGILLSVSHCVYAGDIQGDIYNLNSKNDSSSDTFYSNNMGTTYTGLAWGRDFTQSYENGTLIIGNTSKSPTSNGHWFGRGGDVGFINGTFNAKEVYITGTLGSGNAARTGGGANLTFNASNNLTLDGANISVNRAGTQNSTTALNGKEIDIKNSQFNIENINGGGINIGNEKTENLTIDNTNISMSGGQINITAKNSKLNFGSVNITNGTLDLTKANYTELTTHSLNITNSSFRSNELNMSGDIVNGRFTPTQTLAHGAGFRQSLGNGGDFTADSITIDDGSSTLNATNATIKELNFKGPSTIFGSTQKKLTATISGKLNITTLTNPYQPFGKGFAAELEVKQASEVNIDNIHHQNYTGGSWIHVNVDNKLVVGNIQFATDGILGSQGHVELKSSNGDVIVKNAAGCGNACTGGLGIRPLNFLKISGKNFYGGNIEAIGLPTAGSNSTLDLTGVSGTKFIDTFSIRTGTLQAKDFHVNNFIVYKSNSYSVVDQNIGKSFINYLSMEIGTSDFADGADIRFNGGGEILNFNFIDARPTSFVRMGEIKHVNVNEMKIKEAEVNIKNGIFNTIVSQKGQTAITNGASKITANALNVNELLHLKDSSKHSGVMKIELNANGENIDQKFDKYLNVSVDSKDLKNMSGDEIAKLIESNKNTNGNNEKTESDYKNASGTYITTSDGKHYLVLPDIMTNDNITNSTGQVANGGNILIEQTELTKGALNNYGKILIDDGFVSGDKPTLYLTGNLNNYNTIDLGANGHIEVTGNFNNKGKILFSIQANPNDSSNNEIKNASMNIKGKATLDISPGSTGALQADIADSKTLSSISSQLNTNGSKGVEYNLIKAESISYTYTQGDYTTTFDKSNGNTTIKTEHTNGGQCTNKDCQTGSNGNTKQETDFTTNGKDNPWDMDKAQTDSNGNVVENGIGSTDNEGNLIQKPSQQDKQEECKQDGKYCGFGSNANATEANRGYDYAQQKMKNSFSLTYKGGSIDGKYIDIEKVVNDTTIGFKINKVDINNFIEGNTEKPLCNAESSTFDCALYMEAGGNNSWINAIKKESANSYEILKNLFYDDKSSLVFLINLDQTLAASRNLEYFLEVGRTLDTAIDHVSNLENKASTLHTLTLSMESAKLNRLARVASIHGSASSYIAMQNYQKNLEAALREAEKLKLASLDSNTNTRIAAINNIVSGNTNSNAVYRSSVATLASSSNTNTQNANNGVTDIQSDVTTDNNSNEVWFDTLADLIMRFNNREEYPNHAWVNMLGNLNFSKTGSAQLYGFNAGYDYFVDKLQTAFGAYGGYGYGTFNGNNNGFTSNNSNNMFAGIYTRTFIENHEIDVTLNTAFSFTNEKQNSQINNFDLLALFKDEYSYTLSNVDLNATYGYAFLMKKGYIVKPFAGLSYYVLGSSGFKRKSDNTPIFAMNTDDNIRQTISVNIGIDGRKYFANQSYIFIVAQLKQDAIILQNNVDSSGTTTTSIGNIGDSVNNFNMRYKAQGYKSYVFLTGGGEYSFGRWYLNGSLSLQSSVFDKNFGLGFNIGGRVVF

SEQ ID NO: 179 - protein, 367 aa, Escherichia coli str. K-12
MKRYLATTAALALVSGPAVASGLDRTGQPIGIIFEKGNYAEFSFATTSVDLSGIDRAGGSASGDVGERFNMFGAGYKRDLNEQLSFALIFDQPWGVDVDYPADGSTGLRGTTAQADSNSITALLRYKFNERFSVHGGIRYQEIDGQINLAGLAYGAIPGGTYNVNVNKDGAFGWVAGVAYEIPEIALRAALTYSSEIEHDFDLNETFAGAPVLNANTSTTTKTPQSVNLDFQTGIAQDTLLFGGIRWAEHSVTDLVPARLGRDLIDLDDSFTYTLGIGRSFNENWSGSLALIYADVDGDDLVSPLAPTHGYEAIRLGVRYKQDNMTISAGIRYTQLGDAVASPGGNPVTNFQDNDAVSFGLKIGYNF

SEQ ID NO: 180 - protein, 377 aa, Escherichia coli str. K-12
MKNKLIVAAVLSAVAATSHAQSSVTLYGLIDTGIVYTNNQGGSSAWQMQSSMLSNEVWGLRGSEDLGGNLHAIFRLENGFNIQSGRNTYSGSMFGRQAYVGLKSNTYGTLTLGRQYDAVVDMLGPISFANNGDGNNLGAHPFDNDNLDDSFYINNSVKYVSPTYRGLQAEAQYGFSNAAGGFSNNRAYSFGLTYSIGTFNLAAAYLQLNNGGLTGGGALSNNDFVSFPSARQRVFGVGGNYTYGPATVGLIWTRSLFDDTAPGANSTILQSFDSLHFNNYEINVHYTLTPAITLAGAYTFTEGSFSGASGSGDPKWHQVTVMADYSLSKRTDVYVEGVYQHAYGAAGSAFEGAMINGLGQSSTGNQVAATIGMRTRF

SEQ ID NO: 181 - protein, 252 aa, Escherichia coli str. K-12
MKLLKTVPAIVMLAGGMFASLNAAADDSVFTVMDDPASAKKPFEGNLNAGYLAQSGNTKSSSLTADTTMTWYGQTTAWSLWGNASNTSSNDERSSEKYAAGGRSRFNLTDYDYLFGQASWLTDRYNGYRERDVLTAGYGRQFLNGPVHSFRFEFGPGVRYDKYTDNASETQPLGYASGAYAWQLTDNAKFTQGVSVFGAEDTTLNSESALNVAINEHFGLKVAYNVTWNSEPPESAPEHTDRRTTLSLGYSM

SEQ ID NO: 182 - protein, 745 aa, Escherichia coli str. K-12
MFRNTPLAAAVLVAFATPLYAQTTTTPATGAQPASSSSTPTPTSTSTPTQTADSATLPAVKVTGQNGASAEFAADVSSVGAKVPTALRDIPQAAVVVPKSVLQSQAASSFTDALRNVPGITIGAAEGGQIGNNINLRGFSARTDIYLDGFRDRGQYYRDTFNLESIDVLYGPSSLYFGRGSTGGVINQVSKQPTLKPRADVSVQAGTHDRYRTTVDLNTPITSTSAFRINAFGQDLGSSRDVMKSKDYGVAPEVKFGIGTPTEITLSALIQHNRDQPDYGIPALNGHPAPVNRGTFYGFTDDRTMQDVQTLNARIEHRFNDNLKVRNQTQFSHYSTEARATNAASVLTGPLPTSTALTNGNFTSIDPSKLFVKLQGKDRNINDHSVYNSTDVEAKFNTGFIKHEVVAGVDLSHETYSNQSFTTTTPGLPSNTIAIVPLVDPSYTKRPSNAKTVATNLAESSANGVGVYANDTVSIGEHWKVVGGLRWDRYEASIHNSINVPSYATQTNYFTSVRGGVIWQPTDWQSYYVSYGTSFNPSLEALTLTNQQQNLPPEHNKSYEVGAKWDLLGGGLSVTQSLFNIEKTNARTLNSDGSYTLDGDVRVRGYQLGVAGHITNKWQVFGGYTYMDATILKALDGTAGKTPANTPRNMLTLWTTYAFTPHWEIGGGPIYTSSRYAANNNFVKVGGYTRWDAMAAYHAKKYDVQFNVLNLTDKNYYDALIPSDGGRAVPGNGRTFLATLNYRFF

SEQ ID NO: 183 - protein, 419 aa, Escherichia coli str. K-12
MMKMKTKFLILVTLNVMSFNTEGLAQSEALTSSPYSLYGLGIINQTSIGKSNGIGYTGIGLKTETEINNLNPANFSLIPKNSFFYDMGISYEHNNYSNTGNNETRKTFNFSNLALAFRITDGLGAGFVMVPYSDVGYSLVGIQTNIEGTNETFESNVTGLGGLNDLKFNLGYEVTQGLRLGASASFLFGNIEEDESFLISNSSFQLNETTNYSGVRLGLGMQYDINKDFTFGSTIQFPTSLSGNLKRSVLKNLDGSNITVEDNETDNTADFNIPLELGFGLSAKFLESLTLSADYKKNFWETTGQTENLGEYTDQNIYAFGLEYLKNPYGFKYGERIRYRAGFNYDNGYLSLNKVKIDGFNITAGVGFPINRKTNSIINLSYGYGSKGQIQNILVKEDYHLITINFSLEDIWFKKRKIY

SEQ ID NO: 184 - protein, 170 aa, Escherichia coli str. K-12
MKKSLLAVIVGAFAFASVANTNIYAEGDIGLSQTKANGSNNTRVEPRVSVGYKVGNTRVAGDYTHHGKVDGTKIQGLGASVLYDFDTNSKVQPYVGARVATNQFKYTNRTEQKFKSSSDIKLGYGVVAGAKYKLDGNWYANGGVEYNRLGNFDSTKVNNYGAKVGVGYGF

SEQ ID NO: 185 - protein, 778 aa, Escherichia coli str. K-12
MRIDARRGNGIQHQQHDNDDNSEGRTLAASRVPIGPNRPSARQGIESMGKGTNAVRHVIAIAAGGALCAASGGAHAQTTPSAGEAATPADARAATLPKIDVTAGAGKASVGLVGRRTAIGTKTDTPVADIPQTVNIVTAQQIEMTGATDLNQALRYVPGFATFGADSRTDWYAALRGFTPTLYVDGVPAPNTAVIANWRVDPYMIDGIGVLRGPSSVLYGAGEPGATVDVQTKRADGERVREAGVQIGNYARKQTMLDVGDTLDPDGRYAYRFVGVARDGNAWTGPHADRRVALAPSFRWRPSADTSLTFSATFLQDHGDISSNFLPASGTVLPNPNGRLSQDIYMGDPAFNDYRKKQWSLGYTLEHRVNAIWSLRQELRWSRLLLDDATVFGNGLVPRSTTNMMRFAGLFQLDYSRLDVDHRAQARFGTGPLEHTLLLGVQYDRQTTTNSVWLALAPSLDLYRPVYRPVSAAIFSGPTSLGHIEQFTAMNTFGAYAQDQIRWHRWTLTFGGREDFVNAHFDDRTAGMRTQQDVSAFSSRVGFTYEADGGWTPYVGYSTSFDPVIGVRMFGGGLPQPTRGKQIEAGLRWQPPGKNLMLSAAVYRIDQTHVVTPAPSNLDPTGTSSVQTGEVRSRGIELNAVGKVTRELSVVASYVYQDVKNVRANDASLNHWPVAVPLPRQMASLWADWTWRDGTFAGFGIGAGVRYQSALAGAPDNSLKVPGYTLYDLAMHYDTRHWRFALNVANLFDRREVSGCQSYTVCVFGNERTVTASAKYNW

SEQ ID NO: 186 - protein, 1119 aa, Escherichia coli str. K-12
MKYQKLKRNLYTACVVANLFLIPSPVLWAEQSYAQSTRLSLELSNATISDVFASVEKNSEYRFFYSDAVRAELYRNVDVNIKNKTIDRILSEVLDGTNLTYFLNDRQVMIIRKEEKTQQEKKISINGTVRDAQQEPLPGVNVLVKGTTIGTTTDIDGNYFISVPDKNAVLVFSYIGFESQEVKVGGQININVNMSEESNSLDEVVVVGYGSQKRASVVGSITAIEPAQLQQGTTRAVSNNLAGQLAGVIAVQRNGEPGSDGSDFWIRGISSFKGTGVSPLVLVDGIERTLDDLSAAEIESFSVLKDAAASAVYGVRGANGVILVKTKRGQLGKPKVNFHLEQGFTKPTQLPDYIGSVDYLSLMDELYMDAGNPNPLYGEEMINNYRNNVDPELYPNVNWLDAVSKDMASNTRGDLTITGGSDILRYALVASYYGERGIFVRDESKDWDSSTRLNKYNIRSNVDINVTKTTVVGISIGGYLQEQNGMAVSGQDVWNHAFETPPFVHPIQYSEGRDVRVRERTNPWAEATQHGYQTTSSSKVESLFSVEQDLKFITPGLKFKGLFSFDRYSKSWVKRHRTPTYYNPATGRDEEGNLLLSVGTDGQEFLDTENKGEWGNKATYLEGNITYDRTFDGKHAVNAMFLYNQRDYQDGNVVPFRRMGIAGRASYTYDNRYIAEFNFGYNGSENFTKGNRFGFFPSVAVGYMLSEEKFMEKYKDTFSKIKFRASWGLTGNDQLDGRRFAFLPTIDTDGSYKWGVNNDYNRASRFEGEFGVMNLTWETVEKLNVGTEIGLWNALDLQVDWFKEQRRDIFMQRNNIPSAAGFRKTPWANYGKVDNIGVDLSLTYNQQITKDLHIGFRGTFTYAHNTIVEMDEALGVMGTNRQRTGHSVNELFGLVADGLFTEDDFVTNDKGDLVLKEGIPSHTFNSVRPGDIKYVDIDGDGSITNKDEVAMGGTVNPEIVYGFGATARYKQVDFNVFFQGNGKTHRFIGGVASNFLPGSSQGAMGNVLTNYNDRWTPENPSEDVFYPRLSYGANTNNSQNSTWWLRNMSMLRMKDIEVGYTLPKRWMSRIGLENIRLYAKGSNLLTFSAFDLWDPELDTQNGAKYPIMKSVSFGIDVNF

SEQ ID NO: 187 - protein, 759 aa, Escherichia coli str. K-12
MTRKTVLSILAGVSLAALANGASAQTVPDQADDQRQGLEEIVVTARRQAENLQTTPVSVSAVSEKMLARANVTQIDRITTMVPNVSIQQQSGFLGGNTAFIRGIGTQEPLLTVDSPVGIYIDGIYVGRSNAANFALVDLQRVEVLRGPQGTLFGRNTTGGAISMTTKDPSEEMGGAIKLGLANYRERQAAARFDTGKLGNSGIAATLSYQHMQHAGFTKNPFSSSRATTPGSLNSDAVWAKVKGEWGDFSATYIFDWNDLRGLPLAQQPRFISNNVRGYYTNATNGGLFLSNVSESYKKSLNLAIAGQQKVKIWGHGLTLEYHVSDALNFKSITGFRSYRANPLGTYYGPPGVFGPTTTGIQEVYPFLSLKKVEETDQVSQEFQVLGDTGQFKYVAGLYYFKEDGSTTNPSNSTFVISPTLASNTASVLQFGFKAKSYAAFGQASYRPAAFDDKLELTAGVRYTKDKKEVSQTLPSIRNGKNTFNNTSFNAIVSYQFTDRVMTYARYGTGYRSGGFNTRASATQNFVFLPEKAKTVEAGIKTEFFDRRLRWNAAVFNTDYSNLQVTQFVTTSVGNSGGFTSNAKATFKGFEGELQAVPVKGLTLSSSLGYVDPKYKVFIAPNPAVPGTFFNAADQSEFPYVPKWTANASIQYEGDDVGFGRPLARLAYSYMSNRFFHANQFSGNVFYRNIRSGANKRLDGRIGLTDIALGATTVDLSFYVDNITNRHNIISGIDFGALGFAINSYAAPRRFGLDLKVSF

SEQ ID NO: 188 - protein, 260 aa, Escherichia coli str. K-12
MSIDFTPGIINTYHGDIYNCTTNTDNAKTPDTPKWPCDNWEEQQPINSTFSGEGYISDQYDLAQHQLQQINACHTNTTYTNADYSKVVAQLVSLITNIETISSTQLTQQTQSILNQINNIRYEKNKSAECRIIVIANPKPDKAIITKISVEEGIPITFSVQTMFSDTNFIAEQRADLPTNIKDIQSLYQKMTKLYIEHSENKNRMKVFAGTNFIDFNMTGQNLSGFVLTLSRFYFEDLLNINFTDANLGKVRISGEILLG

SEQ ID NO: 189 - protein, 274 aa, Escherichia coli str. K-12
MLIIALPRVTLISIMKLKKLLPALCLSALSTSAIAANWSSTALHINYGEQTNPFTEQESDTAVYSIQHASGYDYGDNFFFIDYSKDDLEDGFQDRDFYGEWYSTVSLSAITGQQIGSGALIDVGLTAGINVAGDAKVMKYLPGVKLSWDVPGFNFFQTLVTAYIDDSEGVAKGGAPIETNSWMFDVAFDYPFMIGTQKFNVKGHVEYIAERENEFGQDVRAWFLAQPIITWDLGHALEMKENTLLLGMEWQYWHNKFGTDVTESVPQLHVEWTF

SEQ ID NO: 190 - protein, 1008 aa, Escherichia coli str. K-12
MLDKAFKRNRLSATLAAILGVGAIPLAWAADDATPEADGVVAAQNASEEAIEVIEIRGIRGSLYRSMDLKRGANGVVDAISAEELGKFPDTNLAESLQRITGVTVSRANGEGSQITVRGFGPEFNLITLNGRQMPGTGYTRSYNLENLSSEGVKTLEVVKTARADVPTGGLGGTVNIVTHKPLDNPGQAFTFSGKGIYDESNVLGDDVTPELAAIYSNTLFDDRFGVLVSVSHQERDFQQQTANSQGWIAQTDNGRLPTLAGDKGIDGRETDADGNPVARFRDAEGNAVAPFFFPRDMNFSINDVERERTNGMVTLQFVATDNLVLTADYVATRALTASNGFGWGIWNSSTDGSPVIGYELDANGTALYSDIRGGDGSFTANRNTTEVNAESVGLNIDWSPNEAWRFTLDYHNSSNEIDNGADTGLGSDGQVILGSDKLISKVYDYRTGEVPHFLINWNNGTHVLDAGDIDSNFSQFIHSPGESEIEQVQFNTNWYPEFSEHLVKMDFGAAYTKQTMSGTSAWSGLRGGPGFNPSYAEIFPDAMFVLQDASGLLDALGGGGSALMPDYYYTFNFDEAVARQLAFITPEIAGDNYYSIDPYFDGIDSATLVEEKTLALYLTTQWGFDIGNVPVNVNLGLRYEQTDASSTVKQRVENQVVWASPTEWIMQYAPGGDDNYFTQGGDYDVWLPMLDISAEPLEDVVVRFSAGKTIARPLLGDMVAGRNLSGSPKIGARRGSLGNPGLLPLESVNLDLSFEYYYGDASYASVGLFKKYADNYVSQKTTQLTIEGLHDVYNSPRYQEAISQLEAAGTPVSENSIFAQMIANGHGNADGQIVPLASDPLIVWDITSPFNSDSKTVQGIELALQHVFGETGFGVGVNGTFVEGDVTYDPYSLAPQNPLSGIGDSANFQAFYEKDGLSVKLTYAWRDSYLIGVGQSQGSADAPPQFAKTFGQLDASINYDVNEHLTVFFEGINLNNETEEGYGRFEEQFLFARQYGSRYSLGARVRF

SEQ ID NO: 191 - protein, 664 aa, Escherichia coli str. K-12
MALLLPGVLPAATLRIIPPSNTTLAEGSGTTELTAELTLTENTSNCRFTADIATSGTATQGTDYSISPTSISIDVPSAQSESSGGATATQALTITVNDDTEIEPTEEITLELTNLNTGPASTINDDTSSFCPGTFDAGDAVTLSIDDDDDTTEPTASDISLQGQPAQTVESTFTVTDDSPPITVSTDIGEVAPTTVNASSGEVTFRFTVPADAQTGETFTGEITLEDARGNASTVSVTIGTELDLTGISGLNPNQASVANALQGACEAIAATPEDGRSAGQEDLLASCTSVQNSDNPGAALDQLAPEEVAIQGRTALGLLHQHQTSIYRRLTMLPRDGGGVDISGINLTVAGQNLPGSVLQQAAERLLGGGAGDILDLGRFSAFVTGNFSILERDGTGNEQGFESNAWDITVGADYRFWDNLVLGGALGYADSAADVNGNAGESDATALTTTLYGKYYFPERYYVSGALTYSHNQYDSTRDVTLGAARQLARGDTNGNQFGANLNGGYDLTYQALTVALQGRITYLNTGIDGYKEKASDSGAPGSGTLLRIGNQTIDSLVTELATQLTYAISTGTGVISPTFRVGWAHEFLNDQRFIDARFLNDPTGQHFSVRTDEPDRNYFNLGFGASAVFPHGLSAFLFTEWFEGRSDTRYYAFTAGARLEF

SEQ ID NO: 192 - protein, 668 aa, Escherichia coli str. K-12
MSIASSPASHRRHRYRRLAAFGLGAALLLPLPPTAAAETSTTLQDYVVTGTRTPHLIDETPVETLVISREDIERAPVASLPQLLRTLPGISAALLDDNLASDNLRLTMRGLQLHDGYGLILIDGRRSHSGLGGHGEYGVSLNQLPLSMIERIEVVRGGSSALYGADAMAGVINIITRPVPKQAEGTAAINYGTYKVMARDGQSVNSPDRSQARLHVGGGAPVGENSGFYLNLAHESDEGAGTDAQTARRETVLGKWHTRLNPAWSVDLGVDLAKSRQDTAPGTAARYNRQHDEYRLSAGANYREGLHGWKFSTYHYNNDLETGYAGNQHGYRFGDVGYSQAESVYQFFGDRHWLTMGVEAQRQKIDYTFINYPGGVAGDPVPVKENVDIYSVFVQDEIWLLDERLVVVPGVRYEDHSKFGGELNPKLAASLRTGKSTTWRASVGRSFKSPTMRQLYYGDLYQHGNRFERSNPDLDPETAISYHLSVEQQLLNGALWGSLGLFRTDVKDMVVRAYSGADEPATGLPIHSYYNVDRARVEGLELSFRTQRFQGFGLRGGATLTRTENRETGNELPFTPGYTFSLTPGYQWAGGKTGVEATLIANGRQYRDTANTQEVKSHQVVDLHLWRQLGDQLTASLDLSNIFASHKGDKEFSHRQGRSISAGLSTRF

SEQ ID NO: 193 - protein, 311 aa, Escherichia coli str. K-12
MAFSITAFSLSQQAFAGGTANDNQSTMGIATAGAGQAAEASDASVIFFNPAALTRFKRIEVLNVASIATFDNDYTSTQNNDGPPTDDGREGSAGEFFSRKDGYDSALFIPGLFVAIPVSPKLVVGFSASGSHGLLTRYREDYPGRGSGRESDLKVTRLNLGFGYKLTPTLSIGANGSYERYFQSIKLRVNFRDAVSKLGPPGTTALLDGLNTLGQAPPIPGETDGKLRIFGWAFNAQAGLLWEPTDRTRIGASYRPKTRFNGNQGELTINENADTAAFRNFWRQPLIGVGGPILGVTSQRLAIASHTARQA

SEQ ID NO: 194 - protein, 1242 aa, Escherichia coli str. K-12
MDGTLTNSGNVRAESRADSAGGSSYSFTDSESVRIRGSLNGALANSGAIEAHAQSAEGSSNYNDYVRAYGVSIGEDLTGSLENTGTIHATATRSSEGGYSSYSDYMWAVGVHVGDDLTGELLNSGEILARTEVSGGDQYGYANAYGVRAYGSMSGTIDNAGTIRAESVRTAGEGGSSTYTKAYGVVTGDLVGKLANSGSIGARSEAEEGYAHAYGVSTYSGDLIGTIQNDGEIAAEAVSKDGYAGAYGVGVGYNVSGTLQNNGEISARAEASTARSRGVSIRYGDLSGTIGNDGTIDATSITQDGYANAVGVGFGTGEDYDGEDSYGKVSGTLRNAGTVTATALAQGRDYEAGYSLLAMEEEPAPSTSVAVRAGGTYAIGVGTGLVSSQGRIENSGTVVAEARSEAVAEAEDEAYAGAYGADAAGIGSAVVDGKVSNTGSVSASAIVSASATGDAAAAMASEAWTSGVSFGGAGGDFDNGGSIVSRATVTALANGGASASAYAGGAEAAGVEIWVSDPGVYTGNFTNSGTIQAEATLSAVATGEEAEARSYDGASAYGVVVDGFDGRFTNTGTIHASASATVTANGENVEEAAGAGAVGVLVVHGIGADGVLDNRGTISAVAEAAATGMSGVAGVLIGADEIMSEPTLAVMVGEDVPEDGFYGTLNNSGTITAEGRGGIESAGVFSVIASGGTGTVNNLQGGLMSGRLFLGGEVAMNNAGTLDIRDSGRLLSDQSEESAEGEVEMAAMAASPLERGGSHVGGNFTQSATGVLKIDVVPVRDEAGAVVDNAYGALHVGGTAQLADGTGVRVMVDPASTLASGDVLQDVVYAEGGITRGAVKVTDNVLPLNFMATSDASPNDLDLSVVGTGLTTISNAVNTAGLSSATGVAGVLDGLLGSADSQPGALGDFLFDVAGSGNAREVADKVATLLPLASGGVTTATLGALHGANRVVQARVDSNLGRSSGDGFLGDKRMWLKGFGSWAEQDARSGASGYDADTAGLAVGVDAIVTDTNRVGVLFAYSETDVDSTGAAKQSADVDTYQLGLYGSHTLDERTDINGMIGFGRHSTDGTRHTTGGVAASSYDSSSIVAGVGIARTYPMSEKTTLTPSVRLDYARIKDDAYQEQGAGALDLSVGKNTVSELILSLDGKITHELSDTLTFVGHAGVGYDFENEQSSITSTLAGAPGASFVTRGVDPSPWLVRAGLGLVNTPIESWEFSARYEVEGRSDFLNHTAWLRARKAF

SEQ ID NO: 195 - protein, 445 aa, Escherichia coli str. K-12
MISRSRRAGALGFAASAFALAAANPALAETSEVELTTETFELAASGKASPDLLEIDETVELAPQTGPATPVAAPPSRPAPKPVDLRVVASQFVDVPVAGDARSLARYSGRVDGYLEVRGSYYGGPSNLKLKIRPEYTWGKTSNGEIGLIPNNTALFRPESKGDFDLSASLEYQWPSGATFEIGKMNVLDISGALPIVASDGHYGFQNLGIALPPTAVVPNTLTGAMLTVPKGKMIYRAWVFDPDSQYQRTGFETAFESGIAFMVAAARRTTINRLPGIVNLAIVGSTRDSFAQDILPRALTPPPQPFGTFGNESGEVAMQLSFYQFLKMHPQARGKGWGILARFQASNGDPTFLDYSGYFGISGNPGYRPQDRFGIAYFHYSLTDELVDDIAFRLPIEDENGVEAFYTYQFAEGLGLTANVQVVDSAVAFRDTGVIVGARLTAGF

SEQ ID NO: 196 - protein, 794 aa, Escherichia coli str. K-12
MQKLSTPAVAGVRSQVRRALGAAAVAGVAGLALAPVAFAAAPDAEAPLATAPADTLADNQVSGVQVDGKRAAAVESPKLTAALVDTPKAITVIPQRIIEQTGATSLQDILRTSPGITFGAGEGGQPLADRPFIRGQSSANNIFVDGVRDTGGQTREVFDLEQVEVVKGPDSAYSGRGSGGGSINLSSKSPKADDFARGALGVGTDAYVRATVDLNHQLNDNVAVRLNLLGTQGNTPGRKAVDFDRWGIAPSIAFGLNGPTKAVLSYYHLDGDQMPDYGVPLFTKVPSLPRDASGVLQVDRDTFYGLKARDYQKTKADIVTLAVDHQINDNLGVRQVVRYSKTLNDYILTNPGDAGAAQFIDGVWWMKRGTKTRWNPTTTMAAVTDLHGKFTTGAIEHSFDLGLELSHEKNLNAAYSTFATSGAACPAGYKYGVSGAVTTKEVLGAGDCTNVFAPNAADPWTGITNRGPANYNLAKTAAIYGFDTLKFGDKWLLNLGVRRDSYQSVGHDYTSTNAGGVFTITGITYRKAEWNFTNYQAGLVYKPTEESSVYVSYGTASTPPGVAGGDQNGNGTNGAGNLAGQVLEPEESKSFEAGAKANVFHDTLALSAALFKTTRKNAAILIDNGVYAQVGETQVKGFELGVSGNITPKWQAFGGYTYMDSELVRGAVTIPTGGGAPVPSVNQGDPLANTPKHTFSLFTTYRVVRGVSLGGGAYYVSDSFGGNQGGAGGGANKVYAPAYWRYDAFASYAINDKMDLQLNVQNLTDERYISKTNGVHHADPAPGRQAILTLNVKY

SEQ ID NO: 197 - protein, 941 aa, Escherichia coli str. K-12
MISDLCYPSMHPYAYPLVCLISLSICAQPLDCFAKEKKPYSFHKIPESGSACTESNFYTGELHNQNADVDITGRKYLCINNQYYRENGGAFTVRSLNITKNLGPIVFRENVSNDNGGAIFSTNCNITYNKQDCCFVNNMANVIIDLLASRSGGAIKSANLVISNNVGRCQFLNNTASLSGGAILADNDINITHNYGDIILRNNKCLKDRSLGGALHSTNCSITSNHAPINFISNQSGGGGAIYATRTCTISYNSETITFLNNCSLDQLYDSSSNWRAGGGVIYCSSCSITNNPKGLIFQNNSAKRDAGVIFAQNLTIKDNGPILFINNSATWGGALQNHDRGQFYLSADYGDIVFKRNFCIKSWGYTRNALHSTPNLNLQIGARQGYSIKFYDPIENEHPLSSVLTFNPESYHLGTVLFSGADVSTNNTDINNLRSKMRNVSKIAHGVLAVEDRAVLAIYKITQDEGTLRLGNGAVITTIQNASSPQTTAGCTLALSKLALNLPSILAKGAEAPKIWVYPTESGNNYTEDPNPTITLSGNLSLLNDDNEDPYDSLNLSRGITRVPFLYLCDNATKKINIDALNIEAINQNAHYGYQGIWSPYWEEYTTITNPTSVLTANTSHRLLYADWTPTGYIPNPEYRGDLVANALWQAAYNTITGLHSTPPPRTSLGVAGRGSVAYVLQKTRNAKPGFELFSRGYSTQASRSTETNHHFALSFSQFYSEIKEAKSQDKVSANTYFAGAQIHIPWFDENLLTSASLGYAYSHNHVKTKHHTTNALSEGDFHSHTLGSELFCRFPEGTVSNVQFRPFIKALGIHAIQESFTETGKNSRYFQAKDPFINVTLPVGVYGYTEHEMHLKTCWEMQLAYTPTIYRKKPKIITTRLVSKGRWITSGTPVDHHAVSISAKNTTTLNRMSLSINYRGDFSKSTLCNFLNITSEINF

SEQ ID NO: 198 - protein, 417 aa, Escherichia coli str. K-12
MSSLILRGAACGLLCAWLSAAGAAGFIEESRLRLQLRNVYFNENFRDEHGMSPRAAANARSERVEWAQGLLFDYQSGYTEGSLGLGIDTLGLLGVHLDSGRGRAGTGLLPVHDDGRAADEFGSLGATLKARLGQTVLRHGTLLPKNPLLIYNDARLLPQTYRGTQLTSSPIDGLSLDVGYLDRFKLRDSTDSTGLYADAHAGRGFGGFAYAGMERSVGERLRLSYFHGQLEHFYRQDFVGMQHDLALAGGLLTTDLRYFRSHDMGAAHAGGIDNDMFSGQLGFRHSGHVFGAGYQWLDGEAGLPYVSGATVYSFSNVGIGKFIGEEEKTWMARYSYDFVAAAVPGLTFMVRYLGGSNGRSGERGEKEWERDAELAYVVQSGPVKGLGVKLRNYVYRSDFSRGRDSNRIYLTYDIALW

SEQ ID NO: 199 - protein, 793 aa, Escherichia coli str. K-12
MRFSSSCYALSLAVAAVLLAPDGRTQTVTPASGNQDATTLDAVIVSGTARFKGLAKRDASFSITTASPEQIQQAVPQSTADLLKIVPGVWAEPSGGGTGANIFVRGMPSEGDAPFVTMQLDGSPLFPPPTLSFLENSTLLRVDDTVERMEVLRGGSSPIFSNGQPGLTVNFIQKKGQDAPEGSVRLTGGNTALRRIDVFNSGPMGNGWYYSVGGFFRDTDGVRDPQFSADKGGQFSATLSKRWDSGELSLYARHTDDNNAFYTAIPLLSRNNGNALSSFPGLNAQTGTLLGRDFRTVDLLVGPNGQTLRRDLADGRGVDIDVFGGEWNWERGGWTVADRFNVMNGSAPTYALFTGDAPQRLGDFIAGYGSSGSASYTNGGGAVDANQQVLEAGWWSVDKRLNSLTNDLRLSRELFAGNTLTVGAYDAKYSSADTWYLGNTLLLTAQNNARRIDVALDDGRQPTRQGFTSTAFFNLRAKYNGENIAAFVADEWELSERLRLDLGARYECQSVTGDVHDTATVDLDGNPATLYDNATSLALATTRRIDQDDEAFSWTAGVNFTLDRNNSLFVRVNSGVKFPGFDNLRDGQNRVQDVDQYELGVKSGTSAYDLYLTAFYNTFKNSPFQAFLANGQNFTAVGDSRARGLEVEGAIRPLGGFELAGTGVWLDAKYRNYREFTGNQVMRQPKRQFRITPSYYWMLPFGDLKVFATYSYIGERFADLANSQRLPSYDMLELGANLHVGEHWEVTASGSNVTDTLGLTEGNVRVPGAATGGLFMGRPIAGRQYQMSVAYRW

SEQ ID NO: 200 - protein, 1579 aa, Escherichia coli str. K-12
MNEVNYSKIKDYVQKVSANSFAKVFSLLLISLPISFEAKSSSCNTSDGTNGGTTVTSGDTCSIPADYNPSGNDTLVGAAAVTGGDAITLTGTGTGIQAGNRGIQANTLGSLNPEANGLERLLIGAQTLGVNTLDPVTGSNIVVAAYNSSAFNTSDWGQFNGLNTQTPTNVGDNQYINARFGTVQNGTLRVNIGDVGQLPSADVNTINMAAKQTMLTMAQGAGSTLIWESKNKILMGDALVASPGTTTQSTTIDIPVYAGTFTGFNGQTWTVSNATDLQQYNNALIDALQNGQLSSQAAYDQAFSQAVSFTSRIINYSYTINSGDDITQSAGNNYSMYASGTGAQAIIQTGGQIDQRGASVAAVNGASAEIQAGAQLSGHFNSLFIGSGSTGVNNGVISGGYFAENGWDTTGPGNYSNEYGEAYTVTVDGIGSNFSNDGIINVAGWTQFQGYSPDSWGIRVQSGSTASNAGIINTGVNNGSFSNSISGVIVANGGASNFTNMATGTIYLGRAAQYDVANPESVIDIANTIPQYGILLSDGQAVNNGIIEIGTLTENATAMAAVASSPTGLLVNNGAIHIRGAAGDNPLQNTGILAQNNGQTVVQNAGNITIAGVNGVGLKVISTTGTASASSVSGSLIEVAGGIDPTSGTRNYGVWAQGVNSSASLAGDIILSGQGGIGVLAREGATVNVGVGSAVEFNEAVDPLGCPNNCSNQIGYLIYGAGSSITNQSQQLDVASSGSTLFRIEDGASFSGNGQSLTASGRNSNIITGSGLNTTINTDAGVLTVNGEGATGIRIDGGASGNIQSGTIINLNGTGAIAGQVDGRKINISGVPGSTVYPSTLTNNAVIQSAARDAVGFITQYQGELTNNSSISLTSIGENTGVIVRDGGILNNNNMILVANGTGVLVEGSTALSALNNQGSITAENGVAGIHLRKGANLNMTGSGDVHSSGTADGILMGTDAVGISLASVNVNVTGSGSGVHNVQQGTTSNLTGMTITTASGAAILNEQSSSWSLSGTRLNSSSGWAVQNSGGDAVFMVANTVLTGAEGALLTENNASTQLNASSSTLNGRILTTSGKSNLALVDGTLWNMSADSNVTNLINASSTVNYTSDNVFKLLTVNQNYIGDDGFLNMNTALGDDNSPTDRLLVQGNTSGTTLVSVNNVGGAGAETVNGIELITVNGDSAGIFSQSGRIVAGAYDYSLARGAGGNNSNWYLTNRKTQEIPVTPGLPVDPGGPDTPKPAGPQVDPGGKLVLRPEGGSYAANIAAANTMFVMRLHDRLGETQYTDVLSGEEKVTSMWMRNVGGHTRFRDSSEQLKTQANRYVVQIGGDIAQWSSDGADRIHLGVMGGYANQHSNTRSHLSGYDSNGTVKGYNTGVYATWYQNAEEHTGFHIDSWLMYSWFDNTVKGEGLPSESYNSQGMTASLESGYTYHLADYFGSQGSINRWYMQPKVQIILMDVKADDHHEVNGTKVQGEGDGNIQTRLGLKTYVNGHHEMDNGNQRVFQPFIETNWIHNTRDFGASMNSVAIIQEGSRNIGELKMGVEGQINLRLQVWGNVAAQVGDAGYSDTSAMMGIKYSW

SEQ ID NO: 201 - protein, 420 aa, Escherichia coli str. K-12
MSTHCCAASSPPPRVGRPRAPRRGGPRDSPRVSLTVHLDGFAATLPLPTLRMPLVKNNDHPVWRNDAMKTTRFRNARRPRALAATATLAALSGPTHAQSTLTLYGVTDAGVQYLSHADGRHDAWRLQNYGILPSQIGVKGDEDLGGGWHALFKLEQGVNLNDGAASTPGYAFFRGAYVGVGGPAGAVTLGRQFSTLFDKTLFYDPLWYASYSGQGVLVPLSANFVDHSIKFQSATFAGFDVEALAATAGIAGNARAGRVLELGGQFTSNGLSASVVLHRSHGAVDGGVDRAAQRRDLGTVAARYTFASLPLTVYAGVERLTGDLDPARTIVWGGARYQTSGRFGFAGGIYRTDSPTPQIGHPTLFIASATCSLSKRTVAYLNLGYAKNSGRSSQTVYEYDPTPLAGASQFGAMLGMYHVF

SEQ ID NO: 202 - protein, 752 aa, Escherichia coli str. K-12
MRKFTSAAVLRCGVSICSVTLLVAGAHEAWARDDIAYSFSISAKPRLSALADFTAATGIQVVRPDAGAIRGISRAVSGRYSAETALREILAGSNLGYHFTGPRTVAIEAPGAPAGYGADVVTLDTISVTGGAQDIGRGGVSEINITRADIERRNATDVKGLFRGEAGITVGSPLPMSQKVYVHGIEETNLAVSIDGARQNNKVFHHNATTMIDPNLLKAVRIDAGVAPVDSGAGALAGAIAYVTKDARDFLSEDGFGGSLKSIFNFNGHVSTNNLTGYSRQGGFETLGSLTYGRGNEFRAGNGQEVLGTATNFLSGIGKVAYQGIEGQRFAISHEQMRDDAIRPFRANAAQIVDNRSTPLLRPYTLDRQNTVFTYTDASPEGWWDPKFVLAYTRSKVAVDQYSGATIDTYSYTSEGITDSFNGKLENKFALPIGNIVAGLDFYRDRAEYLDKSYRSAERASNFGAYAQARLRPWVRTRLSFGLRGEHQNFEGVNGFRSSGQGLSGNVSGEYDLTSFLIAKAGFSHVWAGIPLAENYAQNPAWNYGAGPKSVTSNNYTTGLVAHYGSLQVEGGVFRTQINDARVPLWAPDMALRAFNLQTQGFQAGGTYNWADGFVRVRFIRIDAEIDGRPADSYVGRYLTAPIGDVLTFQAVHTIAPWKLTVGGDVEIVFDNNTLFNPATGIGRLEGYQVLNAFIEHRSFYLPTLTMRGEIRNLFNATYTARGTYGLEFGTGLVRPLYESGRSFLASLRLDF

SEQ ID NO: 203 - protein, 228 aa, Escherichia coli str. K-12
MTKMNRKTALLASVAAMMMVNGALAADLAPLATAPTAEQAIAAASPWMLRVRGLGVITNDSGSVDGLPGAGLSYSDTVIPELDISYFFTDNFAAELILGTTYAKINGEGVLAGTPVGKTWLLPPTLTLQYHFTDFGAFKPYIGAGVNYSLFYNQSEKPGFSNLDVKNKLGAAVQVGFDYMLDEHWGVNFDVKKIFLKTDWTAELGGTPISGKAKLDPWLIGAGITYRF

SEQ ID NO: 204 - protein, 179 aa, Escherichia coli str. K-12
MNKSMIQSGGYVLLAGLILAMSSTLFAADNNLHFSGNLLSKSCALVVDGQYLAEVRFPTVSRQDLNVAGQSARVPVVFKLKDCKGPAGYNVKVTLTGVEDSEQPGFLALDTSSTAQGVGIGMEKTDGMQVAINNTNGATFALTNGNNDINFRAWLQAKSGRDVTIGEFTASLTATFEYI

SEQ ID NO: 205 - protein, 424 aa, Escherichia coli str. K-12
MAKNIQAIRGMNDYLPGETAIWQRIEGTLKNVLGSYGYSEIRLPIVEQTPLFKRAIGEVTDVVEKEMYTFEDRNGDSLTLRPEGTAGCVRAGIEHGLLYNQEQRLWYIGPMFRHERPQKGRYRQFHQLGCEVFGLQGPDIDAELIMLTARWWRALGISEHVTLELNSIGSLEARANYRDALVAFLEQHKEKLDEDCKRRMYTNPLRVLDSKNPEVQALLNDAPALGDYLDEESREHFAGLCKLLESAGIAYTVNQRLVRGLDYYNRTVFEWVTNSLGSQGTVCAGGRYDGLVEQLGGRATPAVGFAMGLERLVLLVQAVNPEFKADPVVDIYLVASGADTQSAAMALAERLRDELPGVKLMTNHGGGNFKKQFARADKWGARVAVVLGESEVANGTAVVKDLRSGEQTAVAQDSVAAHLRTLLG

SEQ ID NO: 206 - protein, 382 aa, Escherichia coli K12
MQKTPSPLTLAAAAVLGLAGSGASFGAFAQGTSSVTLYGIVDVGVEHVNNVAAGGGLSRMPSTTSLVPSRWGLRGSEDLGGGLKAIYTLESGFAPDQGTFNQGGRGFGRQSWVGLGGNWGSLTMGRQNSMLFWSLLDSDIIGPAVFAMGSLDAYIPNSRADNMLAWRGNFGGLALGAGYSFGRDAVNAGPSPAGTNCPGESGSDTQACRQWSLYAKYDTPVWGLALGYEQQNGRTPASSTDPVFGGMTSSAKHDERLHLGGYFKLAGVKVGGGLLRRDNDGDAVKPRSNLWYVGASYPVTEALVLETQWLTLRYRGVSGYDSDLLVARAIYNLSKRTAVYTQLGHIRNDRLATVSVSGGAPGSNTAPGRSQTGINVGIRHMF

SEQ ID NO: 207 - protein, 466 aa, Escherichia coli str. K-12
MAARERRRMAPDRARREPDASRGRPGGSGASRAVAGFGGGRVHHRCRYSGRRRRASVNHLHRIAVSPRRFCGGKLFASLISTTEGKRKMKMKRLAFCMCALGVAGSTHAQSSVTLSGIIDGGFEVSRVGALKSDPSNHPTLYRFQNGNLQANRIMLTGNEDLGGGLSAQFHLENQFNVSDGTIAGSGLFTREAWVALTGRQGTVTLGRYRAPTFWVYLFEDANTYRLDSYTAPNIQHQAVLSQIFGAQRSSTTLGGAFSGLGGFSNNSVSYRTPVLFGGLTSEITYSTGANGVQDNTQDGKNLGANLIYARNGLKIGYGFNNSHYYIDGALTSLKTHIVGATYSLSFATVGADYVYASDSLNRFASSWTTTAVAPIGPGQLNLGVGHINSSQVGGVGSATSFDVGYVYFISKRTQLYTLYTRLFNSANSTIGLGTLNAAPGNQTSFAKVTPGFDPWAFTIGLRTAF

SEQ ID NO: 208 - protein, 763 aa, Escherichia coli str. K-12
MHRHRFLGRVLAGTALSSLGIGLPAQAQTQVAETPALEEIVIYGRGETRQVQSVTAATLQLTAPGTSPLKAIEKLPGVSFQSADPFGAYEWSARISIRGFNQNQLGFTLDEVPLGDMSYGAHNGLHVSRAVISENLDRVVVAQGAGAIGTASTSNLGGTLQFVSRDPSEEAGISTALTAGGDSTRRAYVRLETGALATGTRAYASYAGQWSDKWKGDGIQKQQQMNAKIVQPVGEGTITGWINWSDRRENDYQDLSRSMIGRLGYDWDNFAKNWNLALQVADIGNNRGDSGAPVSNPAAGTVYPAPVRTLDDAYYDAAGLRKDTLGAVTLDYPLGSILSVSATGYGHRNEGQGVWFTPYVPTPGGGPISIRTTEYDIERYGVIGRLTADLGDHRIEAGGWYEDNDFSQARRFYGLDRAAPQRSSTQFQSSPFYTQWDYDFTTTTRQLYIADTWAVTDMLTLNGGFKAVKVENEADTVTGPQRSGTIEAKDSFLPQVSARLALTEDQELFASYTENIRAFVSAATSGPFSTTPEGFAAIRDSLEPETSQTVELGWRFRIDTLQGSVTGYYVKFDDRLLTLSLGAGIVGNPTALQNVGSVTTKGVEAAATWEFVENWSVFGSLTYNDSTYDDNVLDANGVITAATKDKKATDTPEFMAKGELAYDDGDLFGTVGVSHTGKRYYTYLNNGSVPSYTLVDLSLGYRFSGSGWLDGLEVQANVTNLFDKEYVSTIGSNGFTNADPDGTFQTLLAGAPQQFFVTLRKSF

SEQ ID NO: 209 - protein, 727 aa, Escherichia coli K12
MMNVTLRKAILLAFALPQVTFFAVAESSTNDDTEVMDVYGTGYTRPLTIDKPGETLVTQEKIEIEQPTNIAELFEDIPGVSFDGGARAGGERISIWGFSDPSDLGVYVDGAPIGFEQYRYGSFFFDPYLIGEAEVTKGAHDVQAGSKFGGTIRIRTKSVDELLKAGRKVGARVHLGYNDNDDQTHIGVTAFGKADNGIYALASGTWKDANDIRVGGGDSLEYSAYSQNNGLFKIGYENAVHLFEISHTFYSDEGRQPWATRRGAFAKISDYNIRKYGSLEAAKYAYTVQNEYKDKTTSARYSYNPSSPLVNLKITAAHSDNERHWRRPDVAWKKMFVSIGAYGHESWASYQRDYVDINNEMKIGRHTITAGLQYERNNRDTLVHNATKIYNKPKKNYGIFIPYYDPSGTQTTYSAYLADKIEVTDRFRVTPSLRYDYVTSKGKENPAPDYNDSAAGHDYSKVSHAGFSPRIQLDYDLTDQTLLNFAYAYQMKAPSVDDIYAVQYARAKASATARELEAQRIHAYRASMINSLSGLFANKDMLSTEITGFYNDVTNNVMNRTGVNLDSDPNTLQSWKVNLDGYRNYGVDVQAQYRVAEFFADISASYIAGKHKGSLTDSSGEDQYMYGIPPMSVKLGLGYEWIKGLTTGYKLRWYDAQENVEDSIYFAQASEQYTLQDIYVSWQPQAHKDLMLRATVKNIADVYYEPYLSNGVPGPGREVRLSMTYDF

SEQ ID NO: 210 - protein, 150 aa, Escherichia coli str. K-12
MHQNNKTFLPSQSAHLSKIILFLNTGFLAYLLSACGANVPIEEVLVKDPKETKAQEVAREEKAIQQENATIDARTTPLINRFTNYSAYGSLNGFYNSVDNLNSPMQNGMYGGYYMPYYYMPYGFMPYGSGLMPYGPYGYGAPGYFPYAFY

SEQ ID NO: 211 - protein, 670 aa, Escherichia coli str. K-12
MKTSCLAIAGFVLLLMCFSVHGQEQNPADTLKRANELKEVQIRRIKISRRQTSSTPLQILSGEELQRMNSLSVADAVRFFSGVQLKDYGGIGGLKTINVRSMGTNHTAVFYDGVQLGNAQNGQVDLGKFSLDNIGEIELYNGQKSTIFQSAKGFSAGSSLYLNTKTPEFKDGQTDHLRAAVRGGSFGLFNPSLTWQKKLSDQIYGSISTEYKHAHGRYKFRLTNGVYDSTLVRKNADIETMRVEGGIYGRLPDSSSWNAKFYFYNDEQGLPGAIVNNVYDFPQRLWSRNFFFQSHYKKETGRYQLMASFKYAHDYSRFLDPNIVKDDGLTNNIYKQDELYFSVANRYQLSPIWDVALSADYQRSTMDANLYRFPYPTRHTGLVALATELHMERLNIQANLLGTLVNDQVEQYYSAGKKQELTPTIMASWQPFSAKEFRLRAFYKNIFRMPTFNDLYYTLIGSTFLRPEYTQQYDVGFTYLRMFEGQLLSQVSLQSDVYFNKVKDKIVAVPGASLFRWSMQNLGRVEIKGMDLNVQTAWTLGPQLHAAAGLTYTYQQAINVTSRDLNYRNQIPYIPLHSGSVIASVDWKNMGFNYSYIYTAERYDQSANIPENYVQPFYTHDLALHYNQQLSNKNIRLSAEVNNVFNQYYDVVTNFPMPGRSYRFTIAYAY

SEQ ID NO: 212 - protein, 205 aa, Escherichia coli str. K-12
MLEARELLCERDERTLFSGLSFTLNAGEWVQITGSNGAGKTTLLRLLTGLSRPDAGEVLWQGQPLHQVRDSYHQNLLWIGHQPGIKTRLTALENLHFYHRDGDTAQCLEALAQAGLAGFEDIPVNQLSAGQQRRVALARLWLTRATLWILDEPFTAIDVNGVDRLTQRMAQHTEQGGIVILTTHQPLNVAESKIRRISLTQTRAA

SEQ ID NO: 213 - protein, 782 aa, Escherichia coli K12
MRKDRSGRRRRRPSLNSIFPAARGLCRNARCRGDAQGLLMIRLHPLVVALSLALPAISLCAHAAERDAGAEGAREVHDFDRLQVTATRTQRALVDVPSTVDVIDREQLDNQLVRELKDLFRYTPGVSVTSTSGRFTGANGIRIRGLDGNRVAILVDNVPVSDTFSFGSYLNANRNFVDLETLKRVEVVRGPASSLYGSDALGGVVAFVTKDPSDYLSADKHSYVGLKFGYEGDWNGLFAGATGAFGGERWSGMVAVSHRQGQETQNQGDHRSRDFARTAANPQRIDGRSVLAKLVYAPSAQQRFKLTVEGNEDYGSIEALTGIDPRVTTPSLRILSQDGRDHQTRARVSLRHELDALDWALADDLQWQLYRQDSESLQRTDELRGNNTRRHNEHTFDQRVYGVLFNAHRAIDTGTLSHDITYGLDGTWTDTRAKRDGYSVNLANGAITNRVGQDVFPVRDFPKSETTKLGLYAQDEIRLFDGQLSLTPGVRVDYFRLSPQVDAIFREDNPGVAAETIDQTQVSPKFGVVWRFSDAWSAYANYAHGFRAPPYNDVNIGFTNLQARYTAIANPDLKSETSRGGELGLRFNDAVGYLGVSVYYTDYRNFIESYAPAGFNAEGLMLFQSRNVDDVVIKGAEARGGIDLGALAGWQGWSLNSALAYAEGDNLTDDTPLNSVDPLRGTLGVAFDGDAWGAELIGTFVARKRRPQLDSYYTPAGYATLDLMGHWEFAPGAKVTAGIFNLADRRYVDWNALPNGTLASSTVLDRFTGAGRTASVSLAVSW

SEQ ID NO: 214 - protein, 520 aa, Escherichia coli str. K-12
MKIKQNFLTAVILLGFSSPVLANSLENLSSNPMAQVTSVNQLRDVSPTAWAFEALRSLVERYGCIVGYPDRTFRGERALTRWEFAAGLNSCLNTLERLIQEGVAVLKEDLDRIKRLVREFETELAALGARVNNLENRVAFLENNQFSTTTKLTGEVVMALYGVATGEKNGDEGIPQVPAFGYRARLELNTSFTGKDLLYTRLATGNIADLADTTGTFQSTLAFTQPDGNDLLLEVLNYSFPVTENIHLWLEATGGAKDDFTNTLNFLDGDGASGALSAFGTRNPLYFAPGQTGLGLQGNYGSFQFSAGYLAGDANDPNPGGGLFNGSYTALGQLGYVPNDNFGIALSYFHGYNQLDTGTGSQRSNFQFFTEELFGEAVPTINNSLGLQFSWRIVDGFVLGGWGGYTKAITLSTLDGQLERGDLDIWNWAVTLAFPDLFKEGNTAGIIVGMQPWVSSSSIRLNDGSSTNDPDTSFHIEGFYEWKLTDNIALTPGVIVITSPNSNNNNSTLVIGTIRTTFTF

SEQ ID NO: 215 - protein, 616 aa, Escherichia coli K12
MIMSTLFWKTVKASPVLLVASLFVATGASAAESNSHQTAANLSTAAINLDAEPTASISPTLDDAALTEPIPATETPKPTVTVSPAFQLADSTFPEPVPAAGDTSVNSNQEILQQIQRYGNEGSASLDQVTSVGQLRDVSPGDWAYEALRSLVERYGCIAGYPDGTYRGNRALTRYEFAAGLNACLQQIERLIGDGGEIPDLETLRRLIQEFEAELATLGARVDNLEGRVAFLEDNQFSTTTKLKGEVIFALADTFGDSTEAVGSDDETNLIFADRVRLNLETSFTGRDRLRTRLQARNISSFSGDLTGTNMTRLGFDGDNGNDVDIDELWYRFPLGEKISVQIDATGVEYQDTVIDPINPYFASSGSGAISRFGRFNPIYRAETGGPGITATFNVSDALSLSAGYVVDGGGSDPADGGGSDPSAKNGIFDGNYAALGQIAFTPTENISLAATYLHSFYNGGTVNVTGSTGSSFASNPFGNNDTATSVDAYGIQANALFGKFSVGGWIGYQDAEAESGANEGSDADIWNWAVNLALLDVGGEGNKLGFIFGMPPKTTDNDIAAREDNDTSYHLEAFYRYQLTDNIAITPGAFVIFNPEHDDDNDTQFVGTLRTVFSF

SEQ ID NO: 216 - protein, 731 aa, Escherichia coli str. K-12
MPDLTLRSRAVLAVLMSTVATPALAQAVDEPANDGGLEAIVVTAERREQSLQAVPISATVLSGEELQRKGVSNLNDIQQVAPSVAINTFNRSTFINIRGVGIAQSAPTSNPGVAYYIDGQLIPHEQFIGHSFFDIGTIEVLRGPQGTLTGQNSTGGAIYVRTPEPEFDSTFAIGDVTVANYDRYRAVAALNLGGEDVALRIAGVHEERDSFTRNIAANAQSQPGNLNMDAIRANLRLRDMDGRLTVNVRGEYFDVRSDNNAVKNRNDKVSSNPFEIEEDALSFQNQAGYRISTEARYDVSDSVQARGLVSWQDGYTHDQTDGDRTATAQAVPANLSTSSANTRTYPGRVSNGDTRFKTLIGEFNLLSTDKGPLQWVVGGFVMDETVPVTLLRDNRNTLDLLQSNSSIITEAKNTSQSVFGQVNYYVTPAIEVLAGARYSFDKQVYTRLAVPGAGFTLPFTSEAKSEQLTGKIGLNYHFGADNLLYVTASKGYKAGGVNLTPNTPDFKPERNFVYEAGFKTELLDRHLRVNGDVFYSDYKDIQLSSLVGGLPTTQNALAGRAYGGELEVTAQFGGFAANAGLGYLDAKFKNSACISDTNAAGTDPGCATNLRFVPKGRVLPFSPEWTVNAGVQYTLSLGSVDVTPRVQWSYLSEQYATPFPSVNTLVPGRNLFDARLTFDLGRKYKLEGFVNNLTNKTYIATQIQNSSSADGGIIYGAPRTWGVRLKVEIGN

SEQ ID NO: 217 - protein, 698 aa, Escherichia coli str. K-12
MPLNENDNHYYYWGEYMSYPLKQHKLAHCTALILGLSPFTFSIAAPTEQDTLIVNSSMGHSRLTPTEQQEKEKLEKVAGGTNLVMIEKDARLATLQDALDYQPGLVIQNFFGGIDQPRLNIRGSGVQSAPLARGVLLLQDGLPATDADGSFHISTLEMRDARMVSVRRGANSLNPQSNSLGGELDVLSYTGRNEQGRLRYEYGSYGREGLQTAFGGVSDDGSLDARVNFTYDHFDGYRKHSSSQRKTLRSNFGYVTDNFENRTWLNWTDLRFDVAGPVSEEVLNNNPTDVYPMVWLREPHRNVEQFRVANRSDWQIGNQAIGAGVWHIRTHDNFTTPAYYRFSHSHSEGLQFTYNIETEPVTYRTAVAWDQMTLQTDLMQNRKGTPADKKKIGKYDGYAENIYGSVGVDLHVTPTVTVNFDVKATHARRDVEKRQSSISLDQSWTFLTPKAGIVWRPTESQRYFANISASEEPATFWEIINSSDGKLTKLSPQKAITYEIGGEGEVTEGLKWNLALYRSQIKDEYITTYDSAGTVVGVFNYAAKTRHQGFEAGLTGRIGAGPGDINYRASWTYNDFRFMGGEYNGNYIAGIPRNIVAAEVLYELGDWSFGPNIHWAPTDMAVDHQNNLDIQKRKHYAVLGLKGSYKPTKQWSVYLSMDNLTDERYATTSVANQTVTAKDSTLFPGMGFNVNGGVTFNF

SEQ ID NO: 218 - protein, 367 aa, Escherichia coli str. K-12
MQKIVFSLSLFSSLSLFSFCSAEENGAYASVGFEYSMSYAIQHNNPFLNQERIKIISNAYNQINGLNQVANQVKNMPKTFEYINNNLKNNPKPSATAMQAEAYYLQSTLKNIEKIVMVSHSAPSNPKLVQALEEMQKPTADPLELVTNLKNLELQFNHSQNNILASLSSQTARLSNSLNSLDPSAHSKNISNMYGVTLSVGYKHFFTKKRNQGFRYYLFYDYGYTHFSFAGNGIGLGKMNNHLYGLGVDYLFNFIDNAQKHSSVGFYVGFALAGSSWVGSGLSLWISQMDFINNYLTNYQAEMHTSFFQIPLNFGFRVNVDRHNGFEMGLKIPLAINSFYETHGKGLNTSLFFKRLVMFNVSYVYSF

SEQ ID NO: 219 - protein, 695 aa, Escherichia coli K12
MAPASDRKSVVGWYPQQYGADQRYTKDERIDGRIAFQWQPSDDVVLTIDDNYSRQKVVTDIAGFGIWFNQGDLRNVEQDSNGTTINFLQAGSPTDFTAGTETSVLETNQVGLNVKWDATENLQIDADASYSKSRLNPDGQISNENGDIGYGGLIGTTLGVRVNGNSSSSFPELTTYGPAGNEAAWTDQAIIGSHVTVRQQQLNSDEIKQFRLGATWKQDDLTIKLGGRYMEDEFALENRNTFANNFWQAYAGYGAPSGRDTGVPIPASLIDGTISTKNWLPGFSGNLPPVLLKYDARAYQRYLEGLWQGPDTPGYNAGCCTGFNGTFDLALDPGTVQRITEKNWSAYVSVNFKADVAGMPFHFNAGAREEIVKVISRGIGRVPLSITPSTADPTLLTVNFSDSQAVTESSSYSYFLPALDMKLELTDSLHLRFDASRTMTRPRLDYLGPVLNVGAGQRVGALTATGNNPFLKPYLADNFDLGLEWYYQPNSYAAVNLFLKDVSNFIVAGTDRQTINGVIDPSTGQEAVFTVSRRINGPEATVKGIELAWQHVFGDSGFGFNANATFVETNKPYDESDLSQSGFAVTGLANSANLVAFYDKDGIEFRTAVNWRDKYLLQFGQAQNNSAFGAEPTFVNSALQIDLSGSLRLTEQFSLFGEALNITNETYSTHGRFSNQLLDVYGYGRRFTAGVRYRF

SEQ ID NO: 220 - protein, 659 aa, Escherichia coli str. K-12
MVVFTKRKIAVSIIAAMTTVPAFADDSSDKIFVTTASGYQQKIEDAPASISVVTREQLETKAYRDVTDALKDVPGVLVTGGGSSSDISIRGMDAKYTMILIDGKRVDTRSIRPNSDGAGIEQGWLPPLPAIERIEVVRGPMSSLYGSDAMGGVINIITRRVQQEWTTSLRADTTITERKNSGNTGQGSFYTSGPLVDGLLGVKLQGQYSHRSEDKIIDGFGRQIMTSGGGTLSLTPNEQNAFDLDFKKDNQHRDYREGYTAARGDGSGFSKYDMTHMALTHTGTYDIASTDTYVQYDEAKNPGRKMTAEDLVFRNQSVFLLGDHSVSIGGQYRKEKLKDQSNKLPGNSELDRYSWALFAEDEWLMTNDFALTGGLRMDNDENYGAHWTPRLYGVWHADEQWTIKGGVSTGYKAPSLRESSANWGQATGGNKGNAIIYGNPDLKPEKSITEEIGVIWNNQDNLTAGVTIYNTDFKDKITEIRRCDNSIDTIRDCTLADGEGDTPGKPYRFVSDKANVDKARMQGVEVTFNWGILDNLEFAANYTYTHTEQKSGVNKGKPLSKQPKHMVNTTLTWDTTEDLQTWGRMNFRSETSDYQGRGQQMSKGTPSYALFDLGTSYKLSKNANIVGGVYNVLDRRVDKGTYGAELEGRRYNIGINYNF

SEQ ID NO: 221 - protein, 314 aa, Escherichia coli str. K-12
MAQLKNNLTLTSYGYRRNTFTYGVFGGYQILNQDNFGLAAELGYDNFGRVKLRLAGKPQAKHTNHGAHLSLKGSYEVLDGLDVYGKAGVALVRSDYKFYEDANGTRDHKKGRHTARASGLFAVGAEYAVLPELAVRLEYQWLTRVGKYRPQDKPNTAINYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 222 - protein, 231 aa, Escherichia coli K12
MRPEYSFMRREVMSRITAALFGATALVALSSAPALAQSPFDGGYVGAALGYAWMKPNGTTTFSNATTQKVDRTNDGVTGAVFLGYGKTIDTLYLGIEGEIGISDQEKNSTLAGNTYNFDAGTSLGIALRAGLLATPDTLVYGRIGWQRTDLDVSGRLGSVAGTPTMDENEHLNGWRIGGGVEHALTENVLARLEYNYTDYESYKVSYGQGGARTNAEPHESAVRAGIAYRF

SEQ ID NO: 223 - protein, 2218 aa, Escherichia coli str. K-12
MTNISPKLFQKVIQKGLKTALFTTSTAALMLSSSGTLGVANGVISNNNNAAFSDNIGANNWHGITQAGADNAQGVAGPQDNYAFTFGGDHIITADVAGRIIQAINVAGTNPGGLNINHNTNVGSIITDGNLLPVTINDNQNLTLTGTNAVDIQHGFNANANIYTGLGNITLGGANAQLTIHSNMPALIILTGNINGGGIITANTDTTINGIIGNANPLAKISVGATTLSLGGNIVKANAINLTDNVSELTFTNPVVVTGAIDNTGNANNGVVAFNDASTVTGSIGNTAALAKLSVGAGLVQVQGGVVKANAINLTDNASELTFANPVIVTGAIDNTGNANNGVVTFNGDSTVTGSIGNTAALAKLSVGAGLEVQGDVVKANAINLTNNASKLTFANPVVVTGAIDNTGNANNGVVAFNGASTVIGSIGNTAALAKLSVGAGLEVQGDVVKANAINLTNNASELTFTNPVVVTGAIDNTGNANNGVVAFNGDSTVTGSIGNTAALAKLSVGAGLEVQGGVVKANAINLTNNASELTFANPVIVTGAIDNTGNANNGVVTFNGDSTVTGSIGNTAALAKLSVGAGLVQVQGDVVKANAINLTNNASKLTFANPVIVTGAIDNTGNANNGVVTFNGASTVTGSIGNTAALAKLSVGAGLVQVQGDVVKANAINLTNNASELTFVNPVIVTGAIDNTGNANNGVVTFNGASTVTGSIGNTAALAKLSVGAGLEVQGDVVKANAINLTNNASELTFVNPVIVTGAIDNTGNANNGVVTFNGASTVTGSIGNTAALAKLSVGAGLVQVQGGVVKANAINLTDNASKLMFANPVVVTGAIDNTGNANNGVVTFNGASTVTGSIGNTAALAKLSVGAGLEVQGDVVKANAINLTDNASKLTFANPVVVTGAIDNTGNANNGVVTFNGASTVTGSIGNTAALAKLSVGAGLEVQGDVVKANAINLTNNASELTFTNPVVVTGAIDNTGNANNGVVTFNGASTVTGSIGNTAALAKLSVGAGLEVQGGVVKANAINLTDNASELTFANPVIVTGAIDNTGNANNGVVAFNGASTVTGNIGDTAALAKLSVGAGLVQVQGGIVKANVINLTDNASELTFINPVIVTGAIDNTDNANNGVVTFNGDSTVTGSIGDTSALATVNVGAGATLQVGGSLVVNNIDFKAGGSTLEFNGPAGPMYNLTGVIANGNNGKLNINAASTVVANDASIGEVAQIDIQNGKNFGINAKNADVNLLNGQVISFKGANSSLLLVNNSTTDDRVITLKNDLPAFATGGGQLTLIGTTKLITLQGDGGAKAIGTVRNELGSLNIFGNVAFNNIDTTNVIEFNILNNTKFVDVGGITNQINKINIGAANALCAAGEGSYTIDTEGPNAINILANGQTINFAHEDAELVLQNSAVGNGTIILNAVLDPLAPNKGKLVVDSGAAGGRIILASVGGATYGTAVNRLKELEFKGNGAFQIDTEIFANDLELSVPAITYNQDINANLTFGANTALTQNYNINGNVDFNNQAAVITLGVDKSINGSVTSSNGVNGTIIARGASTIKGAITNLAMLKLGAGNVTITTGGNTSITEIQGNGTGMLTMPAINLIGSINKTGGQALKLNFTGGGSVIGVVGNANNPVGDITTAGTMSFGSSVNAKGTATFGGNTSFADTFTNTGPVTLVTGSTYNFAKDVTAMSFKADGATMNFSNNLAFNGAITGSGTTINLGANQVTYTGTGSFTDTLTLNTTFDGAVKSGGNILIKSGSTLDLSGVSTLELVVTATNFDINNIDPNTKYTVVSAETAGGLKPAPADNVKVTINNENRFVNFTFDELSLTLFAEDVSKAVIDKEFTGFTQTSLERMAKAQNGSDARQALNNDFGSMTNSQVVDAVSHLIQDVIKPSDTIAAVNNQIIASNISNSLINLNARIAELQPVAVAAGDEDRDAKFGAWVSPFVGNTTQKMRNNISGYKSNTTGGTIGFDGLVSDHLALGLAYTRADTDIKLKNNKKGDKNKAQSNIYSLYGLYNLPYENFFVEAIASYSDNKIRSKSRRVVATAVDAIAYQTASGKYKSEGYTGQLMVGYTYVMPENINLTPVAGLRYSAIKDKSYKETGATYQNLVIKGKHYKSFDGILGAKLSSNINVSDVVLTPELYAMVDYAFKNRVPAIDARLQGMAQPFPTNRFKQNKISFDVGVGVTAKYKMMEYSMNYDTNIGSKYFAQQGSVKVRINF

SEQ ID NO: 224 - protein, 774 aa, Escherichia coli str. K-12
MTLDFPASGEYTLRLLRDTGIQEIKISVGSEDESRTIYTEKKASAPKAGIVVEGEREKTVSSRTKVRYEEIKRMPGTFGEALRALETLPGVIPNIGFGGGANGIIVRGANPNANTYLYDDLPILYPFHLDGLTSVIHNDLIKSMDLYSGAYPANFNNATGGIIEIETVDSVQKTKGAFQVSLWSTTAYTATPTSGGKGYLAIAGKLGYLDKTLGASGLLPEGIRLPRYNDSQIKYVHNFTPEHQISFYNLTAQDNFAINIPNKPANDPTSSQLALLGGAKASFGQSFRTTALRYTWIPGDKFQNRITLINFDPIGEYNVGVGSIQGKQYQRGSYVGVRQDAYWTATKFLKVDFGTEVRRFSFRDYGTEVALRDPTNPSPNPYNSANPDFIGRPISIQGNSPYYNAYTTLHFKYGNFLFEPGARYDYVQVTGNGALTPRATASYTLPDVGKGMTIYGSGGDVSRFPLTTNFNAETGNPDLRFERARKVSAGIDQKIDQVWQVKAEFFKNEFTDTIIDDPYVSTPVGLNPDKSLWLTQPIVANRPLNYSNRASGWSHGYELLIRKNARPGTRDWFGWISYTWSQSFQNTNLYQVYEGDTTQVGGIERKILAAYFPNSVEQLAPWDRTHVANVIYGWRVNEGYQIGGRWSYLTSVPSRPIIGDDGGRFSNPLNGLTYWNPQYSNNPYTSDYGYVKRGTDFHRLDVRFDIFENYSWGYLNWYLEIVNVYMRKNKNGYDFDNSKPFSATNPRENDTFGTLELPGGTVIPFFNVGMEVHF

SEQ ID NO: 225 - protein, 216 aa, Escherichia coli str. K-12
MNMKRVVTALLSGVAFFGIFAPSAQAQFAEGLYVQAGGGASFPNRIGTSLGTAINLNTGYTAFGAIGYGINNGFRIEGEFAYSSFDVSSLVFQGNTSAGRGDIDTYSGLVNIYYDLLFPEITDIVSPYIGAGAGVSSISANNITAPGFTTVNGSSTVFAYQFKAGLGFRLGSSATILLGYRYFATAAPGFTDNLGTSLTTDSPNIHNVELGFRFSF

SEQ ID NO: 226 - protein, 347 aa, Escherichia coli str. K-12
MRQVFWRNKCTLVRRFDKIKLHHLSRLYLNIRVREMKTHVIAVMIIAVFSESVYAESTLFIPDFSPDSVTTSLSAGVLNGKSRELVYDIDTGRKLSQLDWKIKNVAILQGDLSWDPYSFVTLNARGWTSLASGSGHLVDRDWMNSEQSGWTDRSIHPDTSVNHANEYDLNVKGWLLQGDNFKAGVTAGYQETRFSWTARGGSYSYDNGQYIGNFPPGKRVIGYSQRFEMPYIGLAGHYRINDFEGNVMFKYSDWVHAHDNDEHYMRKLTFREKTGSSRYYGASVNAGYYITNNAKIFAEFAYSKYEEGKGGTQIIDKTSGDSEYFGGDVAGIANNNYTVTAGLQYRF

SEQ ID NO: 227 - protein, 657 aa, Escherichia coli str. K-12
MGIERRGVSVALSLCLASGLAYAEDFAPSLKLNSVKVSAEAKEERGSPAVINAETIERKQAKDLKELFANEPSVDIGGGGRNAQRIYLRGIESNNLNITVDGAKQGRSLFQHRGDSFGIDPDLLKQVEVSTLSSADSGGGALGGSIAFETVDAQDLLEGNQKLGMMLRSGYASASDGYLGGTSVYGLLSDHLGILVDVSGQNEDDYRGGSGEDALYTATKDRNYFAKLSLLDLEGHTLKVGATHNKSSGHYVSGSTGSDMGAPSASQKADFQVLKRDTYTLDHRYNPENPYVDIQTKIYRNERHLENRTSLLDVTSQTTGGSLKNVMTLDSGIFQHRFTLGGDYEQEKGIVENSLYENEAKTTGLFLQGLTRVEALKLHYGLRWDDYKSDFGPKTLSGDELSPNFGAEYELLSGLALFSNYSESVRAGGIIPLQWMAGITQSANFNNGEAFKPEISKQKEGGIKYSTRGVFADNDRMKLSATLFKTTIENLIDYTRSGGPSGKITKIFNQEEDLISKGYELKASWEKEAWATSLGFIHVEMEEGGEPVVVSRRKAASMGDRFVWDVSYQMTPELLLGYTLHAVDKLDDVPALYRRAGYVTHDLELQWRPASIKGLTWSLAVHNLLDKSYYEQSSFESGDSIVEEAGRDVRLAVKYKF

SEQ ID NO: 228 - protein, 1036 aa, Escherichia coli str. K-12
MIKSIYSNLLPKAVLLSVFLSPGYVISKAHANTDSISGIEQTNGKLSGRVIDAKGEPIPGANISVKGTTIGTITDMDGNFSIDVNPNQILTISFIGYETKTIPVSNQKTLNVVLQETVNQLDELVVVSYGTQKKRDLTGSVSKIDAGELESFPVGQFAQKLQGQVAGVQINQSTGQPGKGMGFRIRGAASINGGSSPLFVVDGIPINMDLSSINPDEIETFSILKDAAATSLYGSRAANGVVLITTKRGKQGKTQVDVNASFGIQTLKGLKTPDVMNGEEFAQYKKEYYEDAARYEGYTGGVPEQYQNPSQYGTGTNWYDLLTRNAATQNYSISVTANKDKFNTAIVLGYFRQDGVMYNSNFERYSLRANNDYQVNDRLKLGLNIAPTLQIKNNQNTDGGWQILSAAFLADPTVNPYDENGEPILSLNSPGMFPQPNWIRVLHEKTSKTQDLALLSNAFAELDIWNGIKYKFQAGFDLGAKNYRDFTPSTAGGAMFTAPPQKASGQYNTNFHYSWTIENMLMYNHKFGNHNIDALVGYSAQKYSNEYNQLTATDFPSDDIPWMGAGATKNGDNNIEQWALASVIARANYSFKDRYLLQATFRRDGCSRFGAGNKYANFPSISAGWIVSDEAFMEPVTNVMNYLKIRASYGLTGNYNIGNYRYIAGVSTYNYVLGGSLAPGKGLGNLGNNALTWEETKQLDLGVDIGFLNDRIYLMYDYYNKKVDGLLYQVDIPRASGFSNIYSNIGDYKAWGHEITLQSRNLVGDFKWTTNLNIAFNRNEITKMGTNNTPKGGYSNQEDFNRLAVGEPIGIFMGYVFDGVYMTEEEFNSQPKHASSEIGTVRMKDVSGPNGVPDGIIDNNDRVKIGDPNPDFIYGMTNEFSWKNFDLSILISGQVGGDIINSNYEHTLNIDGCFNVLKKVANRWRSPENPGDGQVPRTKAGTTELFRFNNSSWVYDASYLTIKNITLGYTIPIKPSQYLSKLRVYVTAQQLVTFTKYPGMNPEIAMNEDMGWNGLGVDRTTYPVPRTFSIGCNISF

SEQ ID NO: 229 - protein, 853 aa, Escherichia coli str. K-12
MSPTINLNRKSLALLIAIVCSGSAQGEEYYFDPALLQGATYGQNIARFNERQTPSGDYLADVYVNGTLVTSSTNIRFNAVKEGQQTEPCLPLSVMKAAQIKSLPATDAATECRPLREWVPHAGWQFDSATLRLLLTIPMTELTHKPRGYISPSEWDSGALALFLRHNTNWTHTENTDSHYRYQYLWSGLNMGVNLGLWQVRHQSNLRYANSNQSGSAWRYNSVRTWVQRPVASVNSILSLGDSYTDSSLFGSLSFNGAKLVTDERMRPQGKRGYAPEVRGVAASSAHVVVKQLGKVIYETNVPPGPFYIDDLYNTRYQGDLEVEVIEASGKTSRFTVPYSSVPDSVRPGNWHYSLAFGRVRQYYDIENRFFEGTFQHGVNNTITLNLGSRIAQRYQAWLAGGVWATGMGAFGLNATWSNARAEHNDRQQGWRAELSYSKTFTTGTNLVLAAYRYSTNGFRDLQDVLGVRREAKTGIDYYSDTLHQRNRLSATVSQPLGRLGTLNLSASTADYYNNQSRITQLQMGYSNQWRNISYGVNIARQRTTWDYDRFYHGVNEPLDVSSRQKYTETTMSFNVSIPLDWGENRTSVAMNYNQSSQSRSSTVSMTGSSGENSDLSWSVYGGYERYRNSNSDSSAPTTFGGNLQQNTRFGALRANYDQGDNYRQEGLGASGTLVLHPGGLTAGPYTSDTFALIHADGAQGAIVQNGQGAVVDRFGYAILPSLSPYRVNNVTLDTRKMRSDAELTGGSQQIVPYAGAIARVNFATISGKAVLISVKMPDGGIPPMGADVFNGEGTNIGMVGQSGQIYARIAHPSGSLLVRWGTGANQRCRVAYQLDLHTKEPFLYLNKICEKE

SEQ ID NO: 230 - protein, 708 aa, Escherichia coli str. K-12
MRNGAVVKNNSGWAAGLAVALMGLPYVGEVSAQEVDLPATTASGQRQAAGYRARESSVATRTDADLMEIPFAVSSVNTELMRTVAAGRGDDLYDWVAGVARQNSFGGLWDNYAVRGFAGDGNWAGTDYLLNGFSWNRGNSVPRDTASLERMEVLKGPASALYGRGDPGGIISYTTKQPQFKSANTISVSAGSYGATRETLDSTGALSPTLAYRLNLMNEDNGSFRDTVSSKRYLVAPGFTWKAGPDTVIHYEMEAARQSAPLDRGVVAVNNQLGAIPASRFLGEPRDGDYEVRNLGHQFTVDHRINADWSVNAGVAQRETDLYGRSSEALALQADGRTLWRRYRHVDFHTNDLQGRLELAGKLQTGAVGHTLVMGADAYRFTYDQLVERSTPTAAAPYAIDIFNPVYGQATPALRTVTNALERDEGQGAYVQDTLALGERWKVIAGLRWDNYRQSIDDRQSGTTTSQQQTAFSPRLGVVYQWSPAFSVYANTAYSFRPNSGTDANGNAFDPEKGRGYEVGAKWAGSGWLATVAAFNVTKRNVLTADPANDGFSRAAGEVRSRGVELEWNGELGSGFRGIANLAYVDAEVTRDTVLTPGARLVNIPRVNGSAMLMYEFAPGFAQKAGVGAGVVYVGRRAGSTANTQDGFQLPAYTTVQLNGYVQLDKHLRASVVLNNLFNRTYYVSSYNSVWVTPGAPRSILGTLSYSF

SEQ ID NO: 231 - protein, 722 aa, Escherichia coli K12
MSVRAGAATAAVATFFAIAPVYGQTAPAPSQDAVPAADAAAPNAGLSGAISLDQITVTSTKTPEQAIDALSASSVVDTSQINILQPSKASGVLQDIPGVTTQESQNDPGQSVNIRGLQDFGRVNILVDGARQDFQISGHNANGTYYLDPAFIGRADVTRGPVSNIYGSGAIGGVVSYTTRGVEDVLDPGKIYGASQTTGLGSNSREILTSTAGAARFGDYADLYAQFVYRGLASYFDGVDEKVADTGSTLAGGLFKANLRPAEGQQITVSTLNQSYNFTNNGTSNAGSRFSDHVTTGNYTLGYTAARPDLPWLDFSAKAYYTTTKNQQTALAPDETYEALGVVPGDPLADSMSTIGFDIHNTSRFDTGPLSHELTYGGDSAWDHVNTFDNAGGFISALTPSGNRRLSGGFVQDQLRYGGWLRFVGALRYDDYSLTGDGVNSGGGHLSPKITISVTPVQGIELYGLYAEAYRAPSVTETFIEGVHPFPAFNILPNPDLTPETGHNFEGGVNIKYDNILAQGDKLRIKANVFSNTVDNYIDFEPVGPSFLVPFIPGAPTSLCNVAPFLCFPITSFQYVNIAQAHLYGVELEGGYDWGGGFVTISGAHINARNVSANQPLITSIPDKISGTFGLRFLDQQLTIGARAVFVASSVKLYDDTGATTNEPTKGYGLLDLFASYKFSESVNADLYLKNVFNQQYTQYLNTLPSAGFGAKASLTVKFSSM

SEQ ID NO: 232 - protein, 780 aa, Escherichia coli str. K-12
MYKIKPIVTAISFAMASSLSPVIAQEKTEDETVNDSEIEVISVMATKRAQSIQEVPISVVAFSGEDMVKSGIEEVADLGAFTPNLYVSKSSMQVSQTIGIRGVGTSSNAALEPSVATYIDGVYMPRPGALLGSFTDIEMVEVLRGPQGTLFGRNASIGVVNIRSKSPELGENYTDISMGVGNFGALDTAITANASLTNNLAVRGNLNYSADDGYGENLYDGNDKLGENDSSLARLSFLYQASDDFNALVKFDYQKLNGTGSPIEVLPESATPERLQVLNYLGAVPDLSGIDGVVNQVHDDSMESSQWGTMLEMNWNNLLTDYSIKSITSYRDWSNNTLEGDITRLPLDLAARQSDYSSRSFSQELQFISPIGETYDYITGVYFSKESYSIDQTFHLGAAFCPVGVGASLAGMPPALIQATITACLAMPQENATPAAFSQTTESLAAFYQGTWHLNDKLDITAGIRYTDDSKSADMLVAPTNLVAGALLAGAEDHQLSFDDSQVTWLLNSKYQFDQDLMMFATVSTGFKSGGFNSVMTQGGLTADERTIDSEEVINYEIGARSTLFEGVMTTNATLYRTEIDNFQDRSFKGLNFITSNVGKLRQQGLELEMNVYPTDELTLRASYAYLDSAFLDYKDATNLPGIPGPQDLTGTPNNRSPKNQLSAFAEYADTFSSANLGWYARIESNWQDDSNVGSTTNNNPQDIQEAFALTNIRLGLLGSNEDWSVQLYAENVTNESYCQNTFNQPFGDQFGTVSNGGTLIRCVMGTPRTFGLRASYHFE

SEQ ID NO: 233 - protein, 784 aa, Escherichia coli str. K-12
MLSGICFIQPAQAQNNAAGPVETNTRMFDIPAGPLDSALDRFARTAGVNLTYDPALISNKVTRGLNGRHDISAGLMLLLAGNSIEVIRQPGGGYTLHKVPATGNLTTDGKAVLPTLTVKADSLKQGAAEEGYLVSNVSGIGLWDERSLRDTPYSMSIVPSDLIENINAQNMGQIFKMNPLTQEPPIQNFTGIPMVVMRGFQSTNPVYDGIPLALGNGSAVSVIEIDRVEILGGTSGFLYGGGRVGGAINYVTKSPTSVPLRRLTFGNYGGTQFYGHADISGKFDDRGRFGYRANLLYQGGDTAIGEPVKQKVANIVLDGHLTDTLYADVKYTYNDYSKEATQPTFNSVIERTGVDTSKRYSPKWASNDLERHKAYTSLRWDPSKYFTLRSAFFYQHTNMRTNQIYLNEQANRTFIPRMLNAPWEKHENYGGYIYLDTRFSTFAVDHKLTLGYSSTYYEYFLRGNGFVLRSGTSLSLNEVKNLSEPDWGESFGKGTVSSPWIDQYNNVLIGDDITFNDQWSAMIGFNYATTMNKASGFYGDGIKYEKSALTPSVSVLYKPIKDVTTYVSYMEALERGTRVGNTYTNFGEVFPPLVSKQYEVGLKYDVNPNLLLSTALFRIEKANQFSNQAMPIPTYVQDGLQVHNGVELILTGKVTDNLTIMGGGTLMDISVEKANDPALEGKKPVNAASRMGKIYAEYALPWITGLSLTGGIYYTSERYGNAANTDKIPSYTLYDIGARYATRVLDKSLIVRLNVINLTGKNYWQDANYLGVPRTVAFSVSTMF

SEQ ID NO: 234 - protein, 216 aa, Escherichia coli str. K-12
MLFVILSIFSSLTYADGTFSKYYNGRFYFSIDVPIEKYENGIGETSKLDFVKNSKSIPTKDFFSAYEAGNSDGLTIKDKSENITILAYGTNFLNTEETNGLEDIENIKESFKKDNLDYNEFIKKYYNGKLSKNINPLKYNYNKVLFINGNNITYNTIEKDFYVVSYIENNKIHYKKVIYNKDKNSYAIFEASYLEKDKKIMDSIVNEMVKSFKIIK

SEQ ID NO: 235 - protein, 378 aa, Escherichia coli K12
MSRSSANKYVVRIIFAQQEMQMKKVMLATWLLAIGGFAQAQSSVTLYGRIDTGLEYMSGLTNGSGRSVSRLRAESGDWGTGMFGLKGVEDIGGGTKVIFQLEGGLNSMVGQVGSGTTIFNRWAYVGVQNDTYGTLTAGRMLWISNGLWDFDPLGQTAWSSASLVRGRNWQASSNNVAYQSPKWGGFDVAGQYALSNSTNWNAGGANGQGRSVGLQATYTSAFFQVRGIYDELRNPTTGQFDDVFNYSREYFGGLNVFLGPFKLQAAYQASQASQAPAGAPTRTQLEWGGLAWQATPAVALIGAVYHVNANNGGGNATIYTIAGSYNLSKRTLLDVQVATARNSRNANFSLEANGPTSSDNPLPGHSQSGIYAGIQHAF

SEQ ID NO: 236 - protein, 610 aa, Escherichia coli K12
MAENRKDSTQIGRNYVIDEVVVTGTRNETDIRHLPMTISIVNRQQIEKRYEPSLLPLLTEQVPGWFTTSRGIMGYGVSTGAAGGMSLRGIGGSPTAGLLVLIDGHPQYMGLMGHPIADAYQSMLAERVEVLRGPASVLYGSNAMGGVINIVTRKQQEEGVKNNMQVGYGSYNTLQTEFSNRVKKGCFSSVVTGSYNRTDGHRSDMEFEQYGGYAKLGYDLSTFWKVWEDINVTHFNASNPGTVQTPLFDNDSRITRGMTSFALENHYEKTSGTLSFFYNWGRHKINDGYKTGEEPQKSHFNSKDRMLGISWYQSATLFTGNRVTTGFDYQHFGGESWNKVLATGERKSGVDKQMDEFAGYIDFRQDINSWLSLDAGVRVDHHSHVGTEWIPQGGLAFHFPKNTEVKAMVSKGYRNPTIREMYMFAPANPELEPEKMINYEFSYSQCLLEGALSYGMNLYYINGDNIIMSNGLTPPLNINSGEIENWGIETNVGYRINSHWNIYANYSWLHMENPVLAAPEHKLYAGMDYTSGRWNISTGFQYVSGLYSSVTKGHEQQENFVLWNLRGNYRICHFADIFVKGENLLAQRYEINAGYPMPKATFMGGINVNF

SEQ ID NO: 237 - protein, 803 aa, Escherichia coli K12
MNMARQNEMGAIAAPRRGRGLLLIGASLIGLAAPAGMASAQQAPAEAASADAVDGVEVITVTARRRAESLQDTPIAISAVTSEGLTARGIDNVTQIGDFTPNVKFNSSVPVSASNATAAIFIRGIGQNDYQLSADPGVGLYLDGVYISRGVGNVLDVLNVERIEVLRGPQGTLFGRNTIGGAVSVVTKKPGDKLAGSLELTTGRFNRIQAKGSIDVPLAEGVYSSFAGFYHKRDGYVKGVVAGAPDLGDTDQLAGRFALRLEPSSDVTIDLAVDGSRAREQSAPNVAIAIDENAPAAQVWNAVYSGAPGICANTADPSRFTDQRCFNNQWALGPYRHGGTFTSVSGVFTNGNPKRYQSASNLNIWGASGTIEWKIADGISFKSITAYRKVTGFWTRDSDHSPATIVETNSDWKQDQFSEEVQLQGDVADGRFNWVVGGYYSSESGNHRDLVNIVDAVFLSGAVLDGKSLAFFGQGTYEIVHNLNLTAGIRWTEDKKTFGNANQYVVEAGFLTGAPFNPDGSGLQNGDPLMGPLGQRSTVKDTAWTPMASLSYRFSPELLGYVSYSEGFKGGGFTQRVFPPFAFIPSFKPETSTTYEVGFKSDLFGRKLRLNGAAFLNDYDDLQITVNDPTLGFAPIIQNAAKARIKGFELEMQARPIGGLQIDAGLGYLDAKYRRVDIRALNAGVTTATKLQNAPKWTLSAGVAYNIQADGIGSFQPRVDWSYRSRVYNDAVNNPLLVQDGYHLVNASVAWTDEDKRWGITAGVKNLTKEVYLGSGYADSFGGLVEGVYGRPREWYLSARYSF

SEQ ID NO: 238 - protein, 191 aa, Escherichia coli str. K-12
MAFRMSEQPRTIKIYNLLAGTNEFIGEGDAYIPPHTGLPANSTDIAPPDIPAGFVAVFNSDESSWHLVEDHRGKTVYDVASGDALFISELGPLPENVTWLSPEGEFQKWNGTAWVKDTEAEKLFRIREAEETKNNLMQVASEHIAPLQDAADLEIATEEEISLLEAWKKYRVLLNRVDTSTAQDIEWPALP

SEQ ID NO: 239 - protein, 88 aa, Escherichia coli str. K-12
MKINNILRNIFMKSKDTLKWFPAQLPEVRIILGDAVVEVAKQGRPINTRTLLDYIEGNIKKKSWLDNKELLQTAISVLKDNQNLNGKM

SEQ ID NO: 240 - protein, 208 aa, Escherichia coli str. K-12
MLGKLFVVALMGLSSSVFAGGWQVKIGGSVLAPSKDNNTLADGAVTNAKADHAFSFTPSIEYFFGDTNISSELLLATPFKHDVTANVAGGPSETIASFKHLPPTLTVKYNFKNSTGFTPYIGIGATAVIAWDEETKGSLTGTELKAENAYGIAGQVGFNFQPADAKNWGVFADVRYADVGSELKWNGQKIGTLEVNPWVYSVGYSYKF

SEQ ID NO: 241 - protein, 392 aa, Escherichia coli K12
MMMKKTLLATALVGMFASQGAVAADDSAELRKIIEQQQKVLQDLEKRLDETEKRVEKTADVVEESASESKSATTIGGYGELHYNNITDNKSGKDKKAIDFHRFVLFFGHEFTESTRFFSEVEIEHALSGDDKPGEVELEQAYIEHDFNEMFTGKAGLFLVPVGIINETHEPPTFYGVERNPVEKNILPATWWEAGAALNVKASPGLAFDGAITSGLKVDETYNIRGGRQKVAKADASDLAYTARVKYTGVTGLELAATAQYQSDLTQSKAGVDTASATLLTAHAIYSIQGFTVKALYAQWDIDGKEAEALGRDEQNGWYIEPSYRINESFGVFARYNEYDNNAGNSEDTKVEQTNLGINYWLHENVVFKADYEKVGGAKDADGFNLGVGYQF

SEQ ID NO: 242 - protein, 1056 aa, Escherichia coli str. K-12
MNQKVGIVLLLCLLLNSIATDLYGASLSSKPPQKVVTGTILEGDSGTPLPGVTIVEKGTKNGTSTDFDGKYSITVPAGATLVFTYIGFVSQEIVVGDESQIDLTLSPDMDTLEETVVIGFGGKQKKGSVVSSITTINPKELKGPTNNLTTMMAGRVSGMIAYQRTGEPGADNSDFFIRGLGTFGSGKRNPLILIDGIESTTTDMARIQPDDIDSFSVLKDAAAASVYGARGANGVVLISTKSGKAGETKFSFRSETRVSANTTNFNFADNITYMNLANEAALTRDRNAILPYSQTKIDRTAQGDNPLLYPSNNWIDQLIKDYTVNQSLNLNVSGGSEKARYYVSGTYNVDNGVLDVDGINNFNSNIKLRNYAIRSNINIQLTPTTEAIIRVSGQFDDYNGPVGGGQAIFNSAVWSNPVAFPAIYPSELLPFIDHPLFGGAPTGIASETLLNNPYAQMVRGYQTRKTSTIRPQLELKQDLSFITEGLRIRTMGYLSRYSTYTVSRQYNPFFYSSYLNPVDGNIELQVLNDGSASSIGTVGQEYLGYSEGEKLLDSRIYNETAINYDRTFGEKHAVSAMLLNLISSYENGNSGSVQSSLARRNHGISGRFTYAYDNRYMFEGNFGYNGSERFARGSRYGFFPSVGLGYRISNEKFFEPLKDVVSNLKFRLTYGSVGNDQIGNTEDRFFYLSNVSLDDGNYGVSFGQDFGYYRNGVYISRYANYDIGWEESEQVNLGVDIGLFGDLNIVADVFRQNRTNILQARSNIGSALGLTAVPQANFAKLESYGLDLTADYNKQLGKYLWTQLRANFTYADNEILEYDEVDYPENLAYRSQIGQNASQVYGYIAERLFVDQQEVDNSPTQFGDYTGGDIKYRDVNGDGVISQSDMVPIGSPTTPKVIYGFGGTIGYKAFDLSVFFQGSAGSTFFINPQNISPFVINGGAQNGLLQVVADDYWSEEDRDVYSFWPRLSQNFIENNNQTSTWWMRNGDFLRLKTLELGFNAPQDFLEKFHIKSLRFYASGLNLAVWSNFDLWDPEMGGNGLGYPIQSVYNLGLQVNF

SEQ ID NO: 243 - protein, 366 aa, Escherichia coli str. K-12
MSELCRRQIIRQQQIMKKGALTVLIALLPLAAIAQTPSINEDGKKIEKEKMETKDYLPEVHGTIRAKYEYQTTMGAGRFEVRNARVSVTGNVLPSVAYKAEIDLSDEGQIKMLDAYARLFPTKGLTVTAGQMRVPFTIDAHRSPHQQYFPNRSFIAKQVGNVRDVGFTVGYTLPTDVPITVEGGLFNGSGLTNQKEWHKEVNYSAKAQFLFTKGLNLTLSVQSIQPEEVRMQSYDIGAYYETGRFHIEGEYLYKQYSGNAFKDVHAVNTFINYDLPLRKVFNKMSFLLRYDMMTDQSDAKTADEETGRLTVTDYKRQRLTGGITFSLSKAFRTDLRLNYEKYFYAKNSIAKESEQDKVVLELMVRF

SEQ ID NO: 244 - protein, 417 aa, Escherichia coli str. K-12
MMDTTCTLARSALAVSLAFGLGLPAWAQEGGFFEDAKGGLTLRNYYFNRDFRDPGAAKVKVEEWAQGFIFKFSSGYTPGLIGFGLDGIALFGVKLDSGGGTSGSELLPVHDDGRAADDYGRAGLAAKLRMSATELKVGELLPDIPLLRYDDGRLLPQTFRGAMLDLREIEGLSLQAGQYREVSLRHSSDMQDLSAWAAPGVTSDGFNYAGAEYRFNQQRTLIGAWHSQLEDIYQQSYFNLLHSQRVGEWTLGANLGYFIDRDDGQARIGDIQSRTGYALLSASHSGHTLYLGLQKVSGDSQWMSVYGSSGRTLGNDMFNGNFSNADERSWQVRYDYNFAALGVPGLLAMVRYGHGENATTAAGSNGKEWERDTEVNYTFQSGLLKNLNIRLNNATNRRSFNSDFDQTRLIVSYPLTL

SEQ ID NO: 245 - protein, 1070 aa, Escherichia coli str. K-12
MSKLAIDSGKNKRSRLNLAITSALLGLCPLLVSAQTTTENDNDVINKKKEEPIEVIEVEGIRGSIFSAQNLKRYADTVKDVITASDIGALPDKSVTEALQRVPGVTIERFASSDDPKHYADEGTGVLVRGLDRVRSEVNGRDAFSANQSGGLSYEDFPAELLGAVEVVKNQTADLISGGIAGTVNLITRKPFDSTERLISFNAKANYGDFRDEVTPSFSALFSDNWETKAGKFGFLIAGSQSEYKTRGDGVGLGNFHSRGDSFFPTTDQWGGIIGIDPSSPVDGPALPDQPAGSVWHVPAAIHMSTATNDRKRTGFTTSLQWANTDETIVATLEHINSKASLEWNERQIGQAAQGFKGYMGSSQNWKNDAENGFPLTTDDGFVTSGIALGVSPETPFFYRSRWNYNENTVKDTSFKVTIKPVDRLTVNLDYQHIDSDKAVQNYSMSGQTRGNHVHVVSPYFLDMRGSRPTVEFLSDNILTPGYSPNEDWNGPVPNLFLGSGMEQVEHNTAKADSFKLDLTYELDGTFTKIKSGFYTSDKDLTVRDTAYEGWSAIGTPWIQDDRNAASAINRPELFERIDFSDYYNGDVLQGNVNNFLFPRMDLVKNYADSLRQGCKDGWHNATNSAANNGTCTGTYVPYADKPNRVEGPYAAHNISSTNEKRTEFYVRGDFDFMLQDIPVVGNVGLRYVNYKLESTGALVQPAEIKRGEPGSSLNNVMQQPEYKRYYDLANGESELSTVNGTDYNTILPSLNLSFAVTDDVVVRFGASKALYYPNLVDARNISIVNLDYTRRLQTPGADYDETNNPVVGLDDIELTALAGNPYLKPETAINTDLTTEWYFAPAGYITFGLFHKKLDNIIRNKSFDLDVSYNGENYDVSAYGPANTGSGTIKGAEFSYSQFYDMLPGAWSGLGLQFNYTYITQNGLEDPNEISKGTLGFDEYGNPIADNRNTFRVFSGLPLQGYSDQNLNIIGMYEYEDVSFRLAYTWRSEYLLTLRESEEYVPAYAEASGMMDASLYYSINKNWKIGVEGSNLLATETKTKYQMDQAGTQTQALSFTTDRRFALSVRAVF

SEQ ID NO: 246 - protein, 995 aa, Escherichia coli K12
MADITYRSRILGSSILGGVAFLSATALAVTPAAAQDATAALAANAQTAGELDEVVVTGSRIARKDYLANSPIVTVTQDDVRATGSANIETLINELPQFTPLGSASSNSPNLAGQAQVQLRGLGAIRTLVLLNGRRVVPSSASSVVDLNLLPTPLISSVETITGGASSTYGSDAVAGVLNFRLNENFEGVQLDVQYGVSDRGDAESEVYSVTMGGDIADGRGNAVLSLSYSDRDSVLNAAREFSRISGFAGTSPLGSTVFDANNLPSAAAVSAAVPGAARGNTFGFNNNGTLFAYQGARDYISPGGLDYEGFRMPGPLQQTDFTYTTGDRNYMIIPQQRYNIYGAANYEITAFAEAYADFLFSQYEAGNQLASNPATGPTTGFRIPGTNPFIPAELRAVLNSRPNPNGSFRLDKRFNELGPRRQNETYDVYQITTGLRGRLPVRDWTYDAYLSYGRVDNGTTYTGYLSRSAVQRLLDAPDGGASICAGGFNPFGEKPLSAACIDYVSRVPKNTTTNDQRVAEINLQGGVFNLPAGEVRVALGATHREQNYDFVPDELMLATFTLNGTTGPELAGASGQPLSGSDKVREIYGEVLIPLLRDLPFVHSLETNLGYRLSKYDTIGRVSSYKADLSWEIVEGLRIRGGVQRAVRAPSINELFATQNLTFMNIGVPISSAGVPQFSGDPCDIRGAYRAPGAANAAQVRALCLAQNVPGQVIDAYTFSNSQTPGLTGGNPLLEEETADSFTVGATWQSPFSNPWFSRLSGSIDYYDITIKDVVGTLATTEQLRRCFNENGTSNPTYDPSNFFCQLFSRDPNSGQITNTLETNANLGTLKTSGIDFQIDWAVTLADVGGPEWGALALNVMGTKLQDWKRQDLPGGAFTDRKGTVSNTFGLTLPEWKFLSTLSWNYEPFSVGVRWRYQGEVENFNNREQVLGAVNYFDLNTTWKVNKTVTLRGGVNNLTDKQPPVYSPAIAANTDPSTYDLVGRRYYLGLTARF

SEQ ID NO: 247 - protein, 392 aa, Escherichia coli str. K-12
MHLRADGRRRPPRPAARRIRFTSTTRTKETPSMKSRSLRAAVLTGSAAVAGLAAGAAHAQSSVTLYGIMDAGIEYTNHAAPEGGSSVKLKSGNKNTSRWGLRGVEDLGGGLKAVFRLESGIDLANGAFDDGPDSIFARRATVGLKGKWGELTLGRNYTVTYDYLLPFDPMGYAQNYSWATSSTATGGRKDGMFTRSSNAVRYDGEFGGFKFGAMYGFGNVPGSVKTSSKYDVALGYETGPFAAVVTFDRQNGAADSVTPADTVNYIQGIHAGLSYDFGNLKTMAGYRNYRRTFHTSAANQLSDTYWVGGSYQFTPTFSLIAAVYHQDIKGGTDADPTLVSMRANYALSKRTVLYLSGAFAIAKHDQKVGVSRDFAGYGTTQVGVTAGIQQRF

SEQ ID NO: 248 - protein, 418 aa, Escherichia coli K12
MITASPRPHAWRGYALGLGLLPLAAQAEFLADSSAHLDLRNFYQLRDYRQHAAPQAQAGNWSQGFVLRLQSGFSEGPLGVGLDATGLLGVKLDSGRGRSNDGTLPFGPNSKQPVDDYSHLGLTAKLRHSKTLLQVGILMPQLPVVFRDDMRLLPQTFDGALLTSSEFDGLTLSAGQLWKSRTRESAGSDDMYIMGRDKAHASDEFNLAGATYALTPRLSASYYYGQLKDIYQQHYLGLLHSLPLGEGLSLRSDLRFFDSDADGAAISGPVDNRNLNGMFTLRAGAHAFGVGLQKMIGNDAFPVLNGYTPPYVANLMTYQTFTRPQEKSWQLRYDYDFAGLGLPGLNFMTRYVQGRDIERGAGRADDSEWERNSDLSYVIQSGPLKSVALKWRNVTYRSRYGTDLDENRLIVNYTLKLW

SEQ ID NO: 249 - protein, 744 aa, Escherichia coli K12
MDINGMSMLKRNFKYSTLATAICLLYAPTTFAHIEKVETDTLTVIGQQDNQITDFQSVVDTRSAQAQTASTTGQLLKQIPGITVSGTGITNGGNIMMRGYDQRGVKIFVDGIHQPIDNTMNKLGGLFIEPSLISRVKVKHGGSSVKHGSGALGGVVSFSTLHPNELLDANKNLGAKLFSSFSSADKHFSYGGVIAGRHQLVEGLLAYSQRERGPIRIADDSILNNHERIKNYFAKAYVYPTEEQTVIFSARQYNNAGEQREVLNRMGGFGKRDSNNMYRATKQNDISLTYHLNPNNYDWLDLSTQLYYSQFKIAHTFLTDTRKEIYPDIESVLGNSEKRTQYTYGMKVENAFNLNYFQDRLTQSVIIGIDAEKQKMVSNNKAKNFPLSHMDNASGWVHNTFNTPLLPITLIAGLRYNYYQNVPDNSKTLDYYKDLNKKGDMTSADKYQETYQNISKNIALRLTLTKWLQIYSSYSVAFRAPTLSEMYNDSVHFTIISPFNKKSYDARWVPNSTLEPETNRTWEHGINLQKNALIFTNDQINIKASYYSTESIDHITYQQWYHSRKPIQLKNSHIALSPIKDAREPLLFQSVNLPKALIHGFDLRLLYSHPYIAMGVNYNQTKTLELSSLETISMVRPETLTAFINVPIIKTPFSVAWSGKFAGPTAKKGTHKYPGSEEVTTRLKEDLQQYPGYGVHSFAVNYQSNNKDIQASLVLDNAFNKVYYSTVGVPQEARNIKMSVSYRW

SEQ ID NO: 250 - protein, 659 aa, Escherichia coli str. K-12
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDSQQGSLTVYGQLSETVDAMVYGQGISRDNFEDGAGKETFGVKGDTYNVLAKVGFEPAVGHRFQVSYDVYRDQGDYSPRPDMAGSANLGLSKNRLVPTHYDRDTITGSYELKQDKHRGKVTLYSSQTEIDRDESVMAGVWPDNRLSRNTATNRNVGINALFQSDYELAAHRNQVSYGMDYVDQTSKATYGSTPFMEESAVSTAVFAENKLYVNDVWSVTAGLRFDDFKRKAMTGTKDFDEVTWSLGTEWDVTSDWTLFANARSLFKGPELLETFVRYQDQARLADNIKPETGLNTQGGVRFDKTYGDHFVGANFTLFKTQIDDHIRTSNSYLISNVGDMEIKGFELSTTYAYQAASAKLSYAHSDANDVTNGGPMLNSVGNSADMGDSIALSLGYQADSIDTLFGWTSIVVLDEDNVVAGAAKKEGYDVHNLYAQWTPYSVPNLVLTFGVDNVFDELYVSHASRVGLAKSFVADDYEPGRSYKLSAAYQF

SEQ ID NO: 251 - protein, 251 aa, Escherichia coli str. K-12
MEIIEMNKVFVVSVVAAACVFAVNAGAKEGKSGFYLTGKAGASVMSLSDQRFLSGDEEETSKYKGGDDHDTVFSGGIAVGYDFYPQFSIPVRTELEFYARGKADSKYNVDKDSWSGGYWRDDLKNEVSVNTLMLNAYYDFRNDSAFTPWVSAGIGYARIHQKTTGISTWDYEYGSSGRESLSRSGSADNFAWSLGAGVRYDVTPDIALDLSYRYLDAGDSSVSYKDEWGDKYKSEVDVKSHDIMLGMTYNF

SEQ ID NO: 252 - protein, 705 aa, Escherichia coli K12
MELSNKMNLRLSLITAALLPLMSAPFSANADDSDIEKIVVTGDFQRETIQTLSASASLLSEEEISLRGASYLDEILGSAANVNFTAGASRGRFIQIRGVGLRSQFVDPINPSVGLVIDGINYSGLGGSSLLFDIDQVEIYRGPQGTRFGADGMAGMIQMQSAKATSDPSLKLHLGAGTYNSHEAGLAASTGLTDDTTARISYFRRKSDGYVDNLYLNESTQNQDEQVARFKLNSQLTENLNTELNFHYIDINNGYDAFTLDNSRDSVADEPGQDNQKSYAVGIANTYTGFDKFDVSLNVSAIDSELLYSYDEDWVCNDINEPQLCAAGLHPWGYSSTDIYNRDRDDQSANLQFNDKTGNWVAGLYYQNRDVDLERQYTWLASPFASTYETSNIALYGQVATPIGPKTTLITGLRVEQYQGDYTDSNGFIQETDDVMLGGKVALEYQVIDRTMIYASITRGYKAGGINSEALAKAKDEGLNLDANFFQQHTSFDPEYLWSGEFGVKGSSLDDALTLRLAAFYMHRDDIQLKAWQVEGQQFTGYVDNASSGSNYGLEIEGNYRLTDNLLLTGSAGYLDTEIDNFVTQSGLNQDGREQAQSPKYQYAFTARYNFTNAFYAMVGIEGKDDYYFSDSHNSKAPNSNLVNLSFGYDADMWSVRAWARNVFDEAVPTRGFEFGNDPLDGYETHTYTQLGEPRVAGITFTLEL

SEQ ID NO: 253 - protein, 998 aa, Escherichia coli str. K-12
MKRLFVSAAVLPLLHAAGAHAETKISTATTTPVRTSTVSGGQPDSILIEANGSIKPTAAGAAVTMDSAHAVKNSGAIGFTGVSNATGVLLVGGASGAFTNSGTIDIVEDYTAEDADKDGDLDGPLAQGANRFGVRATGPGAFTGDVRNEGAINVEGNDSGGVSLETRLQGSLTNAASVGVVGDRSVGVRADSVSGDVRITGAVAVRGQGSVGVQLGDVDGAVVLQNGITATGYRSTQRADDATRAKLDADDLLQGGAAVRLTGNVGKGLLLDRPPTESNADDKDEDDDGVDDTLEATAQLASSGSSPALDIGGAQATTFGLVGTGDRAFGIVNRGQITSDGVNDAVSATAVRIGQTGGGTTTIQGGIYNDKAVISAKAYGAEATGLLLNPGAVVNTLRNTGTIAGDQIGGAHEGRAIVDLSGTLNIIDNSGVIRGSVTPKSGETATARGVALDLRANANGVALTQAKVGSDDKPQIIGDVLFGSGRDVLTVRAGTVTGDLSFGAGQDELVIDGGAQVAGRLSDSDGRLTVNMGEGRLTVTNTDTVNVNALHLGQKAVLAVTIDPAADEATRFRVAGQATFASGSQLDVELRSLLRGSHSYEVVRADQLSVADAAATISGAPYLYKSALRADISTGSLYVDIQPKTAAELGMNRSGAQAYTAVFDNLDTSEALEQAFLAQTTEDGFFGLYDQMLPDHSGGAIMSAAAISSAISAATAQPMTIDRESGTGIWAQEILFEIRRGREDALGFKSQGFGLAGGVDLLGDANALGLSAAFVATEYRDRGAAAGEQVSMNVLNGGGYWRYSAGALQASARAGVGYVWFDGDRRLVGSGLELRAESDWTGWIADAHAAVSYTLDVGAFYARPELALDYLRLSEDGYTESGGGAGFDLTVEDRKGDLLTGQAALAVGWRFGEEFYWAPELKVGWRQRLAGNPGETTARFGDGNPFTLDAEQVFDGGIVARLGLRGGSPKAVYALDAGGTFEDKYREYDIRATVRFQF

SEQ ID NO: 254 - protein, 742 aa, Escherichia coli str. K-12
MKYNLLFVLGLLSFVSYGQSYSNNESGASVTDTVKGKKGEILNEVIVTKNKEPKPVTAVRSGLKPMDNPQTIQVIGSEVIEQQQAIRLSEVLKNANGVYVGSARGGAQESFFSRGYDLSANNMFKNGFRYNSGSIPDVSGLDKVEFLKGGSALLFGNVAPGGIVNLVTKTPQFKSGGEVSMQIGSFAYYKPAFDFYGGLSKSVAFRINGSYENSESFRDVVKNERLYINPSLLFVINPKTQITLQGDYLSADWTPDFGTGIIGTKILDLPRNTFYGSLWSNGTTKSSSASVLLNHDFNKNWKLNFNSSFQNYDRASKSTAQLSSVKDNGEWTRPLVQNENLEQILGDQISLQGNFNTGSVKHQIFTGADWENSFATAYTFAFDPANYDTINLFNFDPSTQKNTIPDARTTQIAKTETNRFGVYFQDLISITDKFKVLAGVRWSWQEAEVTTYKEVYANKVQNVKPENAVQTVGAKKLDNAFSPKFGLIYQPRKDISIFGSYSTSFTPNTGTTADLKPIEPSIIDQYEAGIKTDFLEGMLSTNVTVYQIVNSNLAQTAEFKADGSLNSDTNVKVLSGETKSKGIEVDVTARPIEGLSIIAGYSYNDMRYTKTSGLNGSFIEGDRLVRTPANTANLSFYYLVPEGFFKGVSIGAIGNYIGDRFGGWNDQYSTDLVKYPDGIYHREIPIDGYTTIDVSAGYTWRKFSILCKLSNITNELNYTVHENYSVNPIAPRQVMTSLRYKF

SEQ ID NO: 255 - protein, 651 aa, Escherichia coli K12
MSGWWSFLIVLCALPGVAWSQEPPQPSAAEEPVALTADPAPEEPVAQTVVTASRSPERLDNTPVATEVITRAEIVASGARDAAELLAAHPGLEVASTFAGSNLRIQGLGSEYALVLVDGERVTGRVNGAIDLTRLSMEDVEQVEIVKGPSSVLYGSDAVAGVVNFITRQARKPLGADLRLSYGSLQWLDLDATAEAQREAWGLRVSGGVQRRDAYDLEPLDISTTGSSLSGFNVSARGDLKREGPLELSSTVSYERRVQRGVDLGATGAIFDRASRDDELTVRLSPAWRLSDSVTLRTDGHYTGFKRRYVNDQRQASALDTVEDTRDQLARLGSQLDARLGERHALVAGVELLGEHLVSGRLDDEKGERGRLSLYAQDSWTVLAQPNLALVPGVRLDVDSQFGPAVTPRLALRIDPLSALTLRASYGWGLRAPSFQELLLDFENPAVGYTVRGNPDLKPERSRSLSLSVEVRPASASLLWLNLFQHSLRDMISYNLEQTPEGMRFIYANLDRASVRGGEVGVRQKLPGGVLLDVGYTLIDGRDRETDEPLEGQARHRVTGQVTWRFRPWGLETWVRGALVGSRPFYPDTDGDGVANPYRAKSYVTLDARISRQLPAGLRLFVAGSNLLEAGNTTDLPIPPRLLQAGISAQF

SEQ ID NO: 256 - protein, 1806 aa, Escherichia coli str. K-12
MNRIYRVIWNCTLQVFQACSELTRRAGKTSTVNLRKSSGLTTKFSRLTLGVLLALSGSASGASLEVDNDQITNIDTDVAYDAYLVGWYGTGVLNILAGGNASLTTITTSVIGANEDSEGTVNVLGGTWRLYDSGNNARPLNVGQSGTGTLNIKQKGHVDGGYLRLGSSTGGVGTVNVEGEDSVLTTELFEIGSYGTGSLNITDKGYVTSSIVAILGYQAGSNGQVVVEKGGEWLIKNNDSSIEFQIGNQGTGEATIREGGLITAENTIIGGNATGVGTLNVQDQDSVITVRRLYNGYFGNGTLNISNNGLINNKEYSLVGVQDGSHGVVNVTDKGHWNFLGTGEAFRYIYIGDAGDGELNVSREGKVDSGIITAGMKETGTGNITVKDKNSVITNLGTNLGYDGHGEMNISNEGLVVSNGGSSLGYGETGVGNVSITTGGMWEVNKNVYTTIGVAGVGNLNISDGGKFVSQNITFLGDKASGIGTLNLMDATSSFDTVGINVGNFGSGIVNVSNGATLNSTGYGFIGGNASGKGIVNISTDSLWNLKTSSTNAQLLQVGVLGKGELNITTGGIVKARDTQIALNDKSKGDVRVDGQNSLLETFNMYVGTSGTGTLTLTNSGTLNVEGGEVYLGVFEPAVGTLNIGAAHGEAAADAGYITNATKVEFGSGEGVFVFNHTNNSDAGYQVDMLITGDDKDGKVIHDAGHTVFNAGNTYSGKTLVNDGLLTIASHTADGVTGMGSSEVTIASPGTLDILASTNSAGDYTLTNALKGDGLMRVQLSSYDKMFGFTHATGTEFAGVAQLKDSTFTLERDNTAALTHAMLQSDSENTTSVKVGEQSIGGLAMNGGTLIFDTDIPAATLAEGYISVDTLVVGAGDYTWKGRNYQVNGTGDVLIDVPKPWNDPMANNPLTTLNLLEHDDSHVGVQLVKAQTVIGSGGSLTLRDLQGDEVEADKTLHIAQNGTVVAEGDYGFRLTTAPGDGLYVNYGLKALNIHGGQKLTLAEHGGAYGATADMSAKIGGEGDLAINTVRQVSLSNGQNDYQGATYVQMGTLRTDADGALGNTRELNISNAAIVDLNGSTQTVETFTGQMGSTVLFKEGALTVNKGGISQGELTGGGNLNVTGGTLAIEGLNARYNALTSISPNAEVSLDNTQGLGRGNIANDGLLTLKNVTGELRNSISGKGIVSATARTDVELDGDNSRFVGQFNIDTGSALSVNEQKNLGDASVINNGLLTISTERSWAMTHSISGSGDVTKLGTGILTLNNDSAAYQGTTDIVGGEIAFGSDSAINMASQHINIHNSGVMSGNVTTAGDVNVMPGGTLRVAKTTIGGNLENGGTVQMNSEGGKPGNVLTVNGNYTGNNGLMTFNATLGGDNSPTDKMNVKGDTQGNTRVRVDNIGGVGAQTVNGIELIEVGGNSAGNFALTTGTVEAGAYVYTLAKGKGNDEKNWYLTSKWDGVTPPDTPDPINNPPVVDPEGPSVYRPEAGSYISNIAAANSLFSHRLHDRLGEPQYIDSLHSQGSASSMWMRHVGGHERSRAGDGQLNTQANRYVLQLGGDLAQWSSNAQDRWHLGVMAGYANQHSNTQSNRVGYKSDGRISGYSAGLYATWYQNDANKTGAYVDSWALYNWFDNSVSSDNRSADDYDSRGVTASVEGGYTFEAGTFSGSEETLNTWYVQPQAQITWMGVKDSDHTRKDGTRIETEGDGNVQTRLGVKTYLNSHHQRDDGKQREFQPYIEANWINNSKVYAVKMNGQTVGREGARNLGEVRTGVEAKVNNNLSLWGNVGVQLGDKGYSDTQGMLGVKYSW

SEQ ID NO: 257 - protein, 155 aa, Escherichia coli str. K-12
MTILSLSRFMLAGVLLASFNASAIPGFWQQGYGQGNTEYSVTEASGKTFTINCTGNPDQNGFYQHSVFLTLADDKMVSSHDDDTTITVVMDHQQYIIPSSLGWRNGDNAWFDFISNISEAGQFDVYVNDHKAGTFTADRKNAEKVLSTLGDCSND

SEQ ID NO: 258 - protein, 373 aa, Escherichia coli str. K-12
MQTSASRRRAAMIFAVLNAAAASAAHAQSSVTLYGSLDAGVAYVNNRAGSPQAAMLQGVMQPDRIGFLGNEELGAGWRAVFRLENGFATNTGALMRSGTLFNRQAYVGLSSERAGTITLGQQTAFNYDWLAPMGNGFQSSNLLAAHPGNLDGLVETTSAQESNVVKYRSPALYGLRVGLLLGFGGVPGNFSSGRIAGAGIDYVNGSFGLAAAYVNEHDRALGPMLGDTTAGLGLSTFQGRPALSYVADKVENAGIGARYDWGTVRLHALYTYVRLKAGAQTDSYRTFDAGATWQATPANAVAGGMSTTSFIGRRYLSASLGDVYALSKRTQVYLHAVAQQATGSAAARAAIFAIGASGTQRQLAIVAGIHHLF

SEQ ID NO: 259 - protein, 150 aa, Escherichia coli str. K-12
MTLHGAVDYVDSKYDSFVITQPTQFVPPGRTGCIQTYSGGFATVDCSGFPLVRSPKWSGSAGFTQSFDMANGGTVALGGDLSFASSAYLFTEFLPIQKQGSYANLSASLTYTAAGDRWFISGYVRNITDEVIYTGGSGQSSAFVQGMGIE

SEQ ID NO: 260 - protein, 740 aa, Escherichia coli str. K-12
MKPLSIRLAAGACSLGVMAFCVATAHAQETMGQASGETAAAAEASQESARTLGTVTVTAQRRSESLQDVPVVVTVFGADEIAAARIQQIDDIVTRTPGLSFDAFPASQPRLYIRGIGSGDRGASGDPSSAVFLDEVYLGRPSAVAFDAFDVERIEVLKGPQGTLYGRNVVGGAINVISKRPVLDSFGAGASATAGNYGRLDGAAFLNAPVAGNTGAVRVSGSYRSNDGYVENPFLGRDVDDQETLSGRLQYYAEPTDSLRMHITLDGTRDRALGTANHVLELDETDPLSNFYAQNFDPDVTYGSDPGFMERDTWGARGEVAYDFSFATVTALLSYRDLDYGFGYDFDGGNPDPTSPGFNAINISGGNEETAELSSQELRFSSLPDSPVTWVVGLYRYNQDVLRTDSLILNADVIAPIELFDAFVADAELDSHAVFGDVSLPVTDKLTVFGGLRYSRDEKTQRVFNTDSNVPLRADDLFDATASADFDDLTYRAGLEYQLTPDHMAYASVSRGFKSGGFNGEPSDAAAAVTPFDPEVAVQYEAGHKSLFLDGTLIWNNSVFYVDYTDLQTTQTNNGVRIITNAGEAHIQGYETQLQVSPATNFNLAVAYAYTDAVFDEFVEDGVDYSGNQISRSPKHKVTVSPSYTLALANGPDLTFAVDYQYTSKIFDDNNNQPPELRDATSFVDARVVLDGLGNGMSVSLWGKNLTDERTRTFQGGFLGANFGAFNPPRTYGVTLSWDY

SEQ ID NO: 261 - protein, 1081 aa, Escherichia coli str. K-12
MNINNIARLPCFRKTLLASLLVPLLTPLYSWAAQTVSVTDGNSVAILGEYGTDSDNLSPVSVQGSTSEVTGDSDVAITTTGRGANGANVTNGGTLTLNGSAIKTNGVVAFGISNNKGTVNLQGGTVTTTGSTAYGVSSTGLGSSADINGTVISTSGSSAYGISGAGGAKLTVNNTTLNASGGGSYGIYLSDIGSALSGANNTINNTSSASGTGVYIGNGGINATLDNTTINMTNGYAGVSVGRDSTITMDGLTATGNMNQVFDITGSATVSNANIDLASGAVLRAMGNSSTNKAVIILNNINAISHSGNATMVNANMNADVTINGGSYHSKGTYAMGIWVPDTTSSVKVNNAEFITEGDGATAIENRGTATVDSTVVRTSGNSSHGIYSESIFNATNMSISTAGVGSIGATAARGGNLNLAGATINTTGASGMVLGTFIGSSINAKNITATSTGASAYALWTQTSSSIALKDSQITTSGVNAGGIYAAGSNAVYSKVMLDNSQVVSENGAGVRAYGANINIDVNNGSQLIGGNGLLVNASTNVGTLASPLNIISNVNLNADNYSVLVGDLQAEEHNNVSLTLKNNSVWTGAAYNAKSVDVDSSSVWNLTGDADVESMHILGQMNFIPSSSNPNARALGYSFSTLTINSNLTGNGSFVFNAQLGDDSSPADKLHVIGNVTGDHYVQVINQGGLGALTSGTGINLITVDGDTDFGQFTMSNGVVAGAYQYFLYKIDEHSWNLQSNLAPVGPTDPGTGIGVDPAPVAPQPPETAYRSEVPGYIAAPWLNAFYGFTTLGSLHERRGSAEGAANGFNQDSWGRISGQHNKFDAGRFSYDSDIWFAQLGHDFYQAENSAGTQATAGVMITLGKQETDTQDKARAVRPELSVNTGKIKTDAYGLGGYYTLMTPQGGYIDLVGQGTLYRNNYQSQHDAKQNGYGAALSAEVGQAYPIAGSWKVEPQGQLKYQYLNLNSFSDEISGVSATSYSVGQARAGMRVFSEATKQQTIKPYLSADVVYQLGKNPQVTIDTASLRPEFSKTYWQGGAGVTAKVNSNVDIYADAKYQRAFNGKMDGYAGDVGVKISF

SEQ ID NO: 262 - protein, 404 aa, Escherichia coli str. K-12
MTTLTVRVFTTAEIIYRKTVIALVCHLNCSRQETVTMNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLITVKDNKVTVQN

SEQ ID NO: 263 - protein, 1030 aa, Escherichia coli str. K-12
MIVLLLSLLLGISLHAQERGSITVIVQDKNGGVIPGASVNVAKNNLSFSRSSVSDDKGMAVFQAVPADTNYCIAVSFIGMQTEKRCGYNVKAGQKVTVVVEMEDSRSTQMDEVVVVGYGTQKKENLTGSVGVIRDSQIAGRPVTQLSQALSGVTPGLYINANTGEPGNDQANIRIRGTGTLNDANPLILIDGVEGPLDNINPSDISSVSVLKDASSAAIYGSRAANGVILVTTKRGKMNGKTSVSYNYYTGVATPTVLPEMVTDNATYLKLYREAMQNTGSSVSYTDADIERYAQLPSTDWIDEIFRDRAPISQHSLSVNGGSDRISYLFSSAYLDQDGLLDGDQQYKRFNSRLNMDMKISERFDAGVSFSYARGTSSLASQQNIGELTGKGSLAFEGGLTQHPLTPVYDGEGRYAGPEAILGLRNDRASGRAILDQQRTAALNNDLLGSAFLTYEPFADFTIKGTLAFNSQTRHAEEANKEFKQYDWMTGTQLSVTNPASNLTDIQSSRFNVTSWLQANYEKSFGKHTLKGLFGFNQEHSEQQNNRLSQEGFAVPSQIIFGKGSRTTLVSGTKGEWALRSFFGRLNYAYEDKYLFEANLRRDGSSRFGKNNRWAMFPSFSAGWVASNESFWNKDIVNYMKVRGSWGKLGNQNTALYPFASQVSLENNYVLGTGQVSGAALATLGNPDLKWETTTTTDIGLELGFLNSRVTLEADYFVKRTDDILTELNNPLVTGVVSPTIVNAASVENKGWEATLNYKDKIGEVTVGVGGNITYIKNKVLAINPSLGGADDRVELSAVNNIYLMRGESINTIYGYITEGIFQNNEEISNAPDHALFGKPVPGNFRIQDTDGDGVITEKDRVVMGNRQPKWLFGFNLNAAYKGFDFAALFQGIGKADAFISRLNGPFPRAGLRKIWEDRWTPENPSATMPSLWSDRSGYNGKTVESLPSSFWVQNRDYLRLKNVQIGYTFNKGTLKALPVQSIRLYLNGQNLWTKTKFKDFDPERLDTEAYVTTSLPQARIITGGVNITF

SEQ ID NO: 264 - protein, 713 aa, Escherichia coli str. K-12
MTTWEGDTSRLVSPDTGLEHPLEVPRGGGAGFSTSCLPRFRLNAFRQRGRLPGKESSVKPQYLVFSLPLCISSVFAHDAAEMPAVVVSATRFEQIDSRLPANITVISAQDIRQSPASNLPDLLKTQAGIGVSALYGSFGIDASVDLRGFGPATASLNTLILLDGQRLNPAAMESVNWSLIPLNNIERIEIMRGSGTVLYGDGASGGVVNIITKKATGSQQNITLGAGSNGLLTTDAQLSARGESAHINLAGHFADTNGWRQNSAATQTSLAGRVGIDGSSAKGFVDFSGFDESARLPGALSQADYDQRPRYSKTPQDHQHRDGFRIRPGVEAEIAQNLLFNAEFSFDQDNYDSYSGVYRSTYEREKEHWSFTPRLRWAHGLPSLAASETVIGFDQYHGDWRSVSNSALFGISRARAEQDSQALYLQNLTHFDEHWGLMLGARSQRMWQSAADSSIQGETQRTKNAGEIGLTYAGSHWQVYGKVGTTFRFANTDELFGYDIMSGNSVFSANLRPQHGTIKEIGASARRGDISVKAAAFDMKLTDEILFDSNLYTNINTDPTQRRGIELEAQWQATSSLALRGSYTYLDATYRSGSFTGKQIPMVAENKGALALQWNAQQFGQYSATVNYVGERYVSGDYANTRRQVGGYTTTDLMAAWKFSQWTIAAKVLNAFDKKYANWATYQSSAAYGYATDYYYYPADGRSFVMTARYDFK

SEQ ID NO: 265 - protein, 701 aa, Escherichia coli str. K-12
MKINLCSVIAASLLIFWIQLAEAETETEADQAEAGQKLPAVTVTGERIGSFNSDFVQVGTFRDMAPIDVPQTSNVITREVLDAQATTGIFGALRNTAGVTRSQLNGSTYDNIAIRGILVENRSNYRLNGSLPIINLIDIPMENKERVEVLKGASSLYYGFVPPSGIVNLVTKRASKDPVSNVSLMVNMYGGANSHIDLGRRFGSEQQFGARINLLAGREDIGIRNFSGHRALVSGAFDWRVTDKLSLKLDVEHYRKEVSEQAAIRAPAAINGVITLPPVPDARRNLAGEWQKYDAEATNLLLRADYAISDNWGLLFEIGRAETRRDRNFSQFQDYNLVTGAGTLRTFFNRGQNWDNQNIRTEVFGRFPGQFITHEVSVGFTGNERRQNPRTSSTFDTAQNLYNPIDIAHQSPTTPFSANRSKITDLGVYISDRILIGSKLQIMLGARGSFYKSVAKTTHYKADRINPSLSLMYKPIPNVSMYASYIEGVEESGQAPANRANNGEILAPAVSKQKEVGVKALVAQGILLQVAYFDIKRASTTVDAANRFVLNGMAQYSGFELSASGEVTKQLSLIGSALFMESEQLNKANAETFGKIPDNTPKRTASLFAEYRPTSIPGLALSSGVYYVGRRPVNSANQAFVDDYAILSLGARYTTRIAGKRATVQAVVDNVTNSNYWSTAGNGLLGVGAPVMFKIVSRVEF

SEQ ID NO: 266 - protein, 821 aa, Escherichia coli str. K-12
MAFRLEAVKNKQGTPFTAGSLRRITSWLLASTILCCAGVGLSSPSLAQQPAPAPASAQSRAVQFSIPAQPLPAALDAFIRASGWQVGYSTRLTDGHRSTAVNGAMPPAQALRMLLAGTGINVSLTGANTATLVGPNSAAAGGAAPAGAIALDTIDIQGETAWGPVNGFVASRSATATKTDTPILEVPQSISVVTRDQIETRRNQTLNETLQYTPGVLAERTGQQQFAPRFQVRGFSADGFNGAIYLNGLRGATNWSDIEPYGLERIEVMRGPASVLYGQGQPSGVIALVTKRPSEKPIHEFQLQGGSFEQRSGAFDFGGPVTEDGKLLYRFTGLLREGGNGIDFSNDKRAFLSGALTWRPTAETEITAYSLHQRNQGRWNFGLPARGTVLPNPNGRIPVTRFIGEPDTYNRTEMTVAGYNLQHHVTDSLTFRQNVQYSRESWERRDVNPTSVGADLRTVNRRAESRHVTRDTFAIDNHAELKAMTGPLQHTVLFGVDHRRGKTAVLGNYGTVGPIDVFAPVYGSPVVWSTTDQYAERQPENFIGVYVQDQIKLDQWILTLGGRHDWADTSIVDIIGGSVTDQNNRAFTKRAGLGYEFDSGVVPYVSYAESFTPLSGRTFDGSPLRPETGVQYEAGIKYQPRDMNLRITAAVYDLQRQNVTTADLANPGFSIQIGEVTSRGFEFEAVASLTSNLNLTAAYAYNDARVTQSNDANLGKRPVTTPPHLASLWADYTIREGALNGLGFGGGIRYVSASAGDFLNTFEAPAYTVVDAMARYDIDNWRFSLNVSNLFDNQYVVGCFSLVQCNVGRVRTVLGRVSYRW

SEQ ID NO: 267 - protein, 831 aa, Escherichia coli str. K-12
MNISPLVLGISLVLISLHGTATAQDTPVQKQDTADAATLDAVVVTGAARTQRRFDASFAVNSLSREDVQKLAPKSYADLLGSVPGIHVEATGGEVQNITRLRGIPTDRGFIAFQQDGLPLYQELDGHFFNSGDGMNRFDVMNQRVEIVRGGPAPIYASSGGAIVNNILAEGSEDTHGKAQLTIGDTGLYRGEMYQSGALGKDTFYAVGGFLRQHDGYRDNGFPNDKGGQIRGNIKHYFDDTSWFKVSGTFVDDHNTFYLPIPVADPRNPSVPLDPYIDYFDGTLNSPSLRSVNLKYLDGGGVLQGMNRDLADGRHMRFGNIGFQYENTASDWTISLKSGYTKGRNTFDALYSTTNPVDARSFANGYLGAARTAFGAGVARMGYALAGSNGATAYDPYADSGLVISAQYRAADSDFYSGQADLGATRLFETAWGNHDLNIGAYTAFFGTTSFSLYQDMLMEMRGKPRLLDLVAYGNDGAPLGYVTDKGTLRYTTTLNRGKVDARMFAVYANDTWALSDRFKLDAGIRHERYRYEGYAEQTAQVDLGDRNTLADNTTRRFTGVVQNHRLNPSATNWTVGANFDFTTSVGAYARVSHMEIVPNSSVARSIDPTIVQTQLDQYELGLKAGFGRSYLYLTAFYTKFDPLNASFVAFNPTTGRNDQSVPFIGTAVSKGIELDGMFRPLDWFSIAGSITVSDPQYDSLQNDSGADPAAVNGKQIVREPKLYGNLRPTFSFQHGQDQFETWLRYDVVGKSYVDLFNQTALPAYQTLGLGISWKRGNWGAQLVGDNLTNEKGLTEGNTRTDALAGQGSAEAIYGRPLFGRNVRLMVSRSW

SEQ ID NO: 268 - protein, 279 aa, Escherichia coli K12
MEGLRQCWPAAALGLVLVGASPAGAADLLPPPPPLPAPAPAVEIGTGWYLRGDFTASDFHKPGDDTLPGTPGAKLVDLRLSSTQGYGGGIGYRFNSFLRADFTVDARSRSRFHDYSSRTGFVEGFNEEAGKLDVLTGLFNVYADLGTWWGFTPYIGAGVGFAEKRFHSAWTRTTCLTVTCGDTQPIYAIGPQAVDLRANHSVTTFAWAAMAGLSYEIGKGVSIDASYRYLDIGKARTGFDAYGYNTRLKNITADEFRIGLRWAFGAVPFAGLAGMPAAY

SEQ ID NO: 269 - protein, 1016 aa, Escherichia coli str. K-12
MNQHAHHRPRQTAVTLAVAALAAMTQMQTATAATVSSPFVGLYMWGAGDLSVTSTISGGPMGVLSFSFSGGAVGTLTNSGLISGGYGVQNSSGMAALNNTIGGSISGTGNDGVFNASSIGTLTNDGAITGTHFGILNYYAATISTLTNSGAITGGGTSGGSWAGIDNAGSIGTLTNTSTGTISTAGGVFGVYNTYKIDTLSNSGLITASTRGIINSGTITTLINNSGGTISHSGSGFGQGIDNSGLIGSLSNSGFIGVTGGTGGTGGTGGTGYGNGINNSGTITTLTNDSGGTIVGKYTGLYNSGTIGTLTNHGAIIGGYSAGVANDGSIGTLTNTGTITGSNSYSGNEGFGVNNGGTISALTNTGTISGTVSGSGTAYGISNVGTIGSLANSGLITGSTYAVFNDAGGTLGPVTNAGVIAGNIGNLSSRDLSISGGTGTTFGTLTGYGGGSTLGAIDNPNASVAFVSGNLLLNDNINLGSGTINAVNNTGSAVVQVNQPVSITGNYNQGSGATLQIGVASGATTQGTLGTDAGYGRLVVTGNTTIAQGSSITLQSNGYAFAAGQRYVVVDTAGTATYNAGSLRYAINGYTSTVTGAAVANGSKSDLVLTVVSARSLSAATTPSPTTSSQTTTTTPNPASMATVPNAIASLNGLLGYTGIGSANLLNLYNATLGSLSEGSTAGANQIGKQLSATQTGWAPAAPTFDALNVVGAHVNTLRLAQAAGATGVATGDSPAQWGVWGQAFGGHAQQSERDQTDGYRANYGGLLIGADREINDRWRAGGVFSYSNTSIDNTGDTSGSFARVNGYGLIGYASYTGNPWYVNLSGAAVQQRYDTSRAVSMQGFSGTASGHFSGQQYVARTEAGYPLPVGSATLTPLASLTYSYLTQDSYTEDGGNGTALSVGATHVGSIKSGLGAKLEKGFATRYGQIVLEARAQWIHEYDHARQVTSASFAADATGQTAFTTVGMTPVSDLADISLGATLLRANNLSLSARYELQAGRGYVSQTGSVRLRQLF

SEQ ID NO: 270 - protein, 994 aa, Escherichia coli str. K-12
MSVTGLVTDSESQPLPNASIFVKGTSIGVQSDFDGNFSVQASKGDILVISYLGFFTREVTILDAKRLEIVLKEDAASLDEIVVVGYGTKSKTKLISAVSTINAKALKDQPVANVSNALEGLASGLFVTQSSGEPGFSNSSFEVRNFGAALVIIDGAPGDLNQLDPNEIDNISVLKDAAAAAVYGVQGGNGVVLITTKKGKIGKPKLSYSNQFTFTAFTAYPEYLSSAERGEVLNEGLRNSNQNPFYTEEEIALFKDGTDPINYPNTDWRGLVLKDWGFQQQHNLNLSGGTEKVKYFVSTGYVSQGSNYNADVLSFQRFNLRANVNAAITDELNLTVNMGARRQLNEAPAYSAYNVFRELSRSLPNDLAYYPDGTPARLSVTPNHIVEGINDFNAGYYRARNNNFDAKISLKWDVKQVEGLSFKSYASIVYNNNFSKNWGKSYDLFTLNRQTGNYDAFSAMPEGAVSETVLLQTTNYTNHYVLQESAMYDRTFGSHNVSGLFLAEIQKIQGQDFSASRQDFQSTLIDQLFAGSLENQIANGGEFRQNRLGFVGRLSYDYQSKYFFESTYRYDGSSRFAPGNEWGLFPSVSAGWRISEEAFFTPLKNTISNLKLRASVGTAGNDGTSAYQWLSGFNYNLFYAINDTAIPTIDNTALPNKDITWETNTTYDVGLDVDLFGRDLKFSFDYFFRKREDVIAGANASVPSTLGVALADQNFYEFSNEGFEFSLNYNKQINDNFKVSSILNFSKSREKAVFIDETLQEDLFMRGNLTETGGYTGLRRGYISDGFFQSPEEITQYAIQDNNGNSSLQPGDIKYVDLNGDNVIDVKDQKVFGNGSKATTNYSLNFGVEYKNFALSVLLTGAAGYDIYLEGEAQSPLRNGFNGYDYQLDYWTPENTGARFPRISNGGFNENNYRYSDFWIRQGKHIRFKNINFSYTLPKRTENSTFDEIKFFCTGQNLFVIKDFEEDFDPQTGSGLGWYYPQTKSITFGINVSL

SEQ ID NO: 271 - protein, 955 aa, Escherichia coli str. K-12
MLKTATLRGWLAAGVSIGALAAFATPASAQAPGGNVIEELVVTAQRQAEALQDVPIAVSAFDQNALEKSKIDGGPNLVLAVPNVNFSKSNFTGYNFQIRGIGTKLTAASGDAGTGIHLNNAPLIANNLFETEFYDMERVEVLRGPQGTLYGRNATGGVVNLITAKPVDTFQANARAEYGNYNSIKLRGMVNMPLGDTFAVRLAGNYLKRDGYGENLATGNDADDRDLWAARATISFTPSDRFRSWLLLDHFEEHDNRSRIGKQFCTKDPGPASIGGMAYSADPNRAQIQRGFFSQGCLESSLYDPSALGTVNSQGTLGGLFGSLAGFQTGDAYAGKVQTSDVRDIESLFDPIYKSKTDIYEFNAEFDVTDNVTMNWMSAYTFYKLYTRQDYNRYLPSTTFNATPNPCNFFTAPCRTPTGPDVPAPLYAGIYGLLFPGGVVGDPQNGPQNRFTTSDISSAYTEQWSHEVRFQSNFDGPFNFNVGGLLTKYTSTGDYFVMFNTGTGFYQMQNALTAGNPAAANCTSGAGCVAIDPSADPTRLGHNYYDNYGPYKLVSYAAFGELYWQMSDTFKWTLGLRYTVDDKEVQAHETSLGEPGAGPIPIGLRKVKFKEPTGRFGFDWKPELGFTDDTLIYAFYARGYKAGGINPSFSPGVGIVPVSPTFEPEFIDSFEIGTKNTLLDGTLQVNATGFMYDYKGYQVSKIVNRTSVNENVDAEVKGVEFEAIWQPLQGLRFNTSIGWLDTELKNARSIDTFDRTAGNPNLIVVKSDVASNCVVPLANAQTALGASNALGSPFVLLGLCTPVSNAGAGTNILGSGAIAAGTNAFGGLVSEGVEQDLSGNKLPNSPEWTVSLGAQYTWVFGDWDATLRGDYYHQSKTFARIYNSDADRIRSWENVNVTLSVNNPDMGLELGAFIKNATDETAITDFYLTDDSSGLFRNVFYTEPRTYGVWISKSF

SEQ ID NO: 272 - protein, 359 aa, Escherichia coli str. K-12
MQKQYKPALKLAAVAATLLSGAAMAQSSVTLYGQADMFVGGFKDVGGADRAWVANSGGMQTSYWGIKGTEDLGSGNKAIFDLNGFFRTDSGSMGRFNGDSMFSRNAYVGLQNDKYGTVKLGRNTTPYFISTILFNPLVDSYVFSPTIFHTYLVSAVPGKLNDPGIIGDSGWNNSVLYSTPNFGGLTANVIYSFGEQPGKTSENKWGGNLMYFNGPFAATLAYQQVKFNIQPVGDLGVPTGFDRQDAVQGGITYDFQVVKLFAQAQYIKTRINGAGNGGDLKHTNGQIGASVPVGAGNVLVSYSYDKTKNDVTDFKRNTAAIAYDYNLSKRTDVYAAYYYDKRNDAEHGDTFGVGMRHKF

SEQ ID NO: 273 - protein, 1041 aa, Escherichia coli str. K-12
MKITLLKSLMLVGAFLCFGAAQAQEVSGTVSDATGPLPGASVVVQGTTTGTQTDFDGNYTLDGVPGDAVLVFSYIGYATQEVPVNGRSSINVTMEEDAQALDEVVIIGYGQTTVKDATGSVTAVTSEDFNSGVIASPEQLIQGKTAGVNISQTSGEPGAGIQVNIRGANSVRANNNPLFVVDGVPLFGQNTDASGDTGNGGSDVGNPLNFLNPNDIESISILKDASATAIYGSRGANGVVIITTKSGRAAAGGKFEWSSNLSVSTPVRQFDLLNREEFLDAVELYGGNRNLVDFGNDTNWQDVVMRTAASSNHNLAYSQNYGSGNVRATFGYQKQFGVVEKSEFERITGRLNLNHRFLDDKLILGIQASISRVNREQPPLAAGAGFRGDILGSAYSANPTWGSSPAFDDGGGQTQPANYLASTQNITNTNRLLVNGSLEYKFTPELSGKVNLGYDTSNSENTSTLNANLQNFTGIEGIGFGTYNTLDRDNKTLEATLNYTKQFDNSNLDALVGYAYQDFRTQGRNSAGRGFGTTDLNGMGEDLRSTVNAAQSVIDGSFQQFYYGTNTGNLVVNRLFPTVVSGEVVDGGFNKRVQAITADIFDNTDELQSFFGRVNYSIAGKYLFTGTMRADGSSRFGPENQYGYFPSGAFAWQMGEEDFIGESISTLKLRLSAGITGNQDGLGYGNFVARQRFAGLGINNDASVNQNGLSIVATDVPDLKWESTVNYNIGLDFGFNNDRLNGSIDVYQSTTRDLLLQTPPAAPSTQPFQFGNVDAEIVNQGIEFAISYDFAQSEDFNFSSSFNIAYNENEIQNFAGAINTGEINGPGLSGAFAQRFESGVSLFSFYMAEFTGFDSDGNPQYVDIDGNGIGDPDADKSFVGEDGLPDITTGLSLNANYRNWDFSAFFAGQFGFSVYNNTANSFFNAGQLVTARNVTQNVVASGENGGASTAVSTRFLEKGDFVRFQNATIGYNVPLSGEGFFDTMRFSLTGQNLALWTDYSGIDPEVTVGTGTLGSGIPVRGIDWAAFPNPLTVTFGINASF

SEQ ID NO: 274 - protein, 321 aa, Escherichia coli str. K-12
MKLKNTLGVVIGSMVAATSVNALAQGQGAVEVEAFGKHYFTDSSRDIKNGELYGAGVSYFLTDDVSLGLSYGEYHDITSEDRVQDGSHKKIKGSLTSLDAAYHFGNPGVGLRPYVSAGVAHQSIGQADRGGRDRSTFANVGTGLKYYFTENFFAKATVDGMYNIDADEGEWMAGVGVGLNFGGGARQVAAVEPTPEPAPAPIVDNEPEPAPEVVRVELDVKFDFDKSRVREESYSDIKNLADFMQQYPQTTTTVEGHTDSVGTDQYNQRLSERRAEAVRNVLVNEHGVQGNRVNSVGYGESRPVADNSTEEGRQINRRVEA

SEQ ID NO: 275 - protein, 227 aa, Escherichia coli str. K-12
MNKSLLSASLVALALAAPVAHAHQAGDFILRSGAITTAPNENSGDLKLDGAKVSGTKATLDSDTQLGLAFAYMLTDHIGLELLAATPFKHTVGVKGLGAGLDGKLADIKQLPPTLSLQYYPMEPTSKFQPYAGVGINYTLFFDEDLSSNRKAQGFSNMKLQDSIGIAGQLGMDYMITDNLLFNAAVWYVDIDTKATIDGPSALGVGKTKVDVDVDPWVYMVGIGYKF

SEQ ID NO: 276 - protein, 367 aa, Escherichia coli K12
MAMASTALASPALARDDAWYVEVDGGAMIVEDIDLNVNTASDALTISSDEGFDFGGIVGYDFGAARLEAEASYAEASIDDILVGTAGFPAGRAGRLAPAGTYEANGDISILRFMVNALADFGPDDGLQGFVGGGIGVARTALDTTINTNGAPGIDDSDSGFAWQVLAGVRAPLNDNWDVGLKYRLFNAESVELIDRAGRIVDNNVRTHSILGTLTYNFGAAPPPPPPPPPPPPPPPPPPPPPPPPPPPTTPCNTGPYIVFFNWDESNITPEAATILNNAVTAYANCGTASVMLAGHADRSGPQTYNVGLSQRRNASVREYLNGRGIPDARISSEAFGESQPRVPTADGVRELQNRRVEITYGPGSGM

SEQ ID NO: 277 - protein, 661 aa, Escherichia coli str. K-12
MATAFYQWYFEADLIQRSGDLTQSDMVIGLLLIVLVFEAARRVMGIALPLICALFLAYGLFGQYLPGDLMHRGYDIDQIVNQLAFGTEGLYGTPTYVSATYIFLFILFGAFLEQAGMIKLFTDFAMGLFGHKLGGPAKVSVVSSALMGTITGSGVANVVTTGQFTIPLMKRFGYKSAFAGGVEATSSMGSQIMPPIMGAVAFIMAETINVRVNLTAGSWDERRIQADVSGALTDEGNIRGRAVYAHENKNSYLDRYSREVNVFYGVLEADLNPDTLFSVGYSLDKNNANSPLWGALPLFDSVGKPTQLSRSTSTAADWSWWNNQEQRTFTELTHNFANGWQAKGNVTYVKKQSDSELFYVFGTPNALTGDGLFGYPSQYSADFHQWIADVSIGGPFSLAGREHELVLGANWYKSKVEELSRYIPKKSVAVSSEQIYNGASPSRRYTEIFNPQKEEGADRQRLDPIEGENYELGIKGELLDGKLNVSAAVFKTKQSNVAESLRFDPVSGKQLYDGADYLSEGYEVEVSGEVLPGLQVMGGYTYVDIQNADHSHGRTYAPKHMLRASTVYRIPQHPQLKVGANLSWQDDIYRSISLADGSGGRIEQDDYAVVGLMAAYDIDPNWSVSANLNNLTNEKYLSSLYWEQGFYAAPRNASMTVSWNY

SEQ ID NO: 278 - protein, 1192 aa, Escherichia coli str. K-12
MTVPAAFFEKRPSSGDGSFVDNSDTNRANNMLISGGRVGKCKGIVGGIAPCEAGLVLSFESLSVVSAAAFTSLLIWSSPSLAGSCDPAGPETWSCSGAATGSDPSAVIFSSAPVTVVTQPGFGLSTSGEAIRVETIGGIAITDGNASSITSSGGQGILAINDVSGAVEITSNGSITGIDGIYVINTGTGPTTITSSGTAIGTIGNGVYVSNDGFATDLTVSQTGGTIFGADNGISTTNRGFGATAISVAGDVDGAAENGIWAQNFANATGITITQAVGSTITGYTHGIRADNWAAGAISITTAGVINQTQTGAANNDTFGVYAYNSTAGTDIILTQTAGSISGNWFGMYANNQGSGSTRIISSGDVTAIVRAGLYAYNAAPADSIFVSQTSGTVKGGTYGVFADNAGTGSTTVTLSGDVIASGDYGVYSRNASSATDLMVRQTAGSIAGRTGILASNRGTGASLVSVGSRVSGGAGAGIQTIAANGSTIDIASSATVTATSGIAIRDGGVAGSPIASDTIGGNVVVNSAGIVTGDAVLGLGDDTFNLAGGTYAGNIYGDDRDDPRSNDGVTNHEGNDTFTWTGGTLAGGFYGQDGSDTAMVSASAYDGSQVLDGGDDTSVADGMIDTLTLKGVTATTNGGKIINWEVVNLDGASLSIDDGVWHVGEPDEATTGVFLDNRSRLDGIASLAFDGNMTIDSTSAFVGTGGGTGVYSFSGDVANAGTITTVDDAVGDVVIIGGNYNGNGGQILFDVALGDDNSKTDMVIINGDTSGMTNVGVNNVGGTGAQTSEGIRIIEVNGASNGYFSLVGDYTIGDRQAVVAGAYAYQLYQGGTSSPNDGNWYLRSQLTVSNPTPTAPLYQAGVPSYEAYPQALLGLNGVPTLQQRVGSRFWAGNGASVGTPYATPEGAGVAIEGNGVWGRIEGVHNHIEPRFSAAAAEYDQNVFKLQAGIDGLLTETESGKLIGGFTVHYAHGKTDTRSVWGDGEISTDGYGLGGTLTWYGENGFYLDGQAQMTWYTSGLNSLLARTNLTDNNDGFGYTLSLESGTRIAIDPGWSVTPQAQLVYSNVDFDAFTDTFGARVSLDRGESLQGRLGVTLDHESAWQNDKGLLNRSHVYGIGNLYYEFLEGTRVDVQGVRLASRNDRVWAGLGLGGTYSWDDDKYSIYGEALVQTSLNDFGDSYSVKGQVGLRVKW

SEQ ID NO: 279 - protein, 76 aa, Escherichia coli str. K-12
MLKTDALLYFGSKTKLAQAAGIRLASLYSWKGDLVPEGRAMRLQEASGGELQYDPKVYDEYRKTKRAGRLNNENHS

SEQ ID NO: 280 - protein, 817 aa, Escherichia coli str. K-12
MIITKTGVSCAALAWALASWLSPAAFAQTQTQPAPEAATAVDDVVVTARRRDEAPISVPVSVTVLGAAQLKMLAVDSLQDLRAVTPGISVGEVSGGVGGTVALRGVGTTAGSNPTFEQTVAINVDGVQLSRGGAVRVGQIDMEKIEVLRGPQALFFGKNSPAGVISITTADPTSTFESEVRGGYEFNANERQLEATISGPLTTTLGARLVVYGSDMDGWRDNTADAAAAAANAIRPGSVTGSTRSGPQQKFFFTRGTLKWRPNDAFDARLKLSYADNKGIGYNQAGGFQRIYCPSGAPQLAPQSTALNGGAANPALAAALSVDNCRADATYANGNINPAFLVGSPEGFTDPDGAGNYSQQLYSLEMNYRPNDWLALTSVTSWAKNEDFRADTYAVAPSDAVAANDFTGNTGYTQFTQEVRLASKLSGPVNFLVGAFYEDSDLETYTRNILAGAPLFLHNIDGTTQSVFGQGIWDITGKLELAGGLRWSKEAKDFAVSRNGAPQPVSPDSADFKNTSPEVTLTWRPTERLTLYGAYKQGFKSGGFAAATNTGAAFTTPLNALYLPESAEGFEGGLKALLFDGALRLNTAAYDYDYTNLQVNSLDNSSGVPVIRVNNAGAATVKGVEGDFTLKLAGAPGLTIRGAANYNDAKYANFLATCYIGQTVADGCNLLLNPLTGRYTGQQLAGHRLVNAPEWTGSLGGAYTGKTFIEGIDWGMNVDGLYKSRYNPHPELHPGAQQDGVIFLNADVRVFRDDHRWELALIGRNLTEEYRVDVASNVPQTGVATRTGSALTGGLADLSGNVNRGREVMLQLTFRPF

SEQ ID NO: 281 - protein, 891 aa, Escherichia coli str. K-12
MKATKEVARLLCSVAFVAASFGGAGHALAQDASVSAPDAMQTDDNAAELDEIVVTGTLLRGVAPTGTNVVGVTSEDIVSTGVTSSADLLARVPQVTNAFGGVPQGSSTIAEPITRPNIRSLGASGGSTTLILLNGNRMVGAGILQTSPDPSAIPPSVLERVEVIPDGGSSIYGSDAIGGVINFITRKRYDGVELTAKYGMGDDYTTTDFSAMAGKDWGSGSALIAYAYAQHDAIAGADRDWFAQDHLAAGGSDFRSQSCAPGNITTGGVTYRMDTRTVGVNRCDENKAIDFYPEEERQSVYAALSQQLTEDLSFDVTGYYSERDTVRKGQSPTDGTGVRGTGTITSANPYFRPIGAETSQTVAFNYSAVTGDALENPSNFSSMGLTPTLTYKFDGGWQIRATGNYGRSTNTVHTRQINTTAQAAALAGTTAATALNPYDVGTTNSTVLDSILNYELYGDATQEIRSVRTVADGSIFSTAAGQARLALGAEYYEEKLDQTQGQGTIGNPIGASSSSNRDVTSLFGEIFVPLKGQDSGIGSIDVNASMRMDVYSDVGDTINPKVGFNWRPVSELRIRGNWGTSFHAPSLSDLGSSVDTRAQVLGVSPFRAGGSPASDLFRPTILLAGGNPNLKPEEATTWSFGADWNPVGALDGLRVNLTYFNVEFTDAIGLAPFFNGASYFANPSYASFFTLNPTQAQAEAATAGQRVENAPSITSLYTGGGATPYALIDARRNNLGSLKVDGIDFDIGYDWTLPLGTVSAGLAGTYTLNRDSQAVPGAPTVNELDNSTSRYSLVGTLGWRSGPVTVDAIVNHRAGYDVTGVVGQSEVDAYTLVNLFARYELPGEGWMQNTALTLNLDNVFDEDPPYFNSATGYANGATLGRVFSIGVRKAF

SEQ ID NO: 282 - protein, 647 aa, Escherichia coli str. K-12
MKRARFVPFFVVAASLPLSFPVLAEDALERVVVTGTRTPKLLASSPVKIDVVDKAEIARLSKGTLRQVLEVMPGVVVRRSQKDGYNVQLNGFNGDHVLVLINGQPIISPTGSSVDLDQISVANIKQIEIVRGAASVLFGSSAMGGVINIITEKVEGSQFSADYEASYFTDDAIEGDEIGHTSRITAAKAISDWQLGITAQNITNPGFDYDGETTSQDGGAVDKSFVQMSLSTLINSVSVQYKGQWLDEQKDKPQSSIPGQATIISYLSNVTQWQHDFRLEQQYDWHINTRYLSHDEESGNSNGLRQTDIQLAEMEAQKIYSTKDIEWVGGVVLHGDSLDQLNLSTGTVEVDDVSRESAELYLQGNWQQNHTQLLAGARIQNDSDFGWHTAFKASASQSFNAENTSWQLRAGVGSSYRVPNLKERYYVFDHSNLGYMVLGNDALTPETALNANVGTNLRLTPTKSDWLYQVDINLHYTKADDFITTAVDVDASQDAGLDISVYKNLDEATLYGADLSASAQDDNWQWQLNYSYLVSEDGSSQRLPERPTHLVKASVTYQFSHTDTSLQLYGVHEGNVSPSIGYSSIAKDSFTTLNAVVQHQFTPQWQARLGLENLTDEHRSTEALLAGAFDARPIAARRLYLGVSYQY

SEQ ID NO: 283 - protein, 707 aa, Escherichia coli str. K-12
MKIITARQAAFPALLFPFVFSPVSQAATAEDEQTMIVSATPQTVSELDTPAAVTVVEGEDMRLATPRINLSESLNGVPGLQVQNRQNYAQDLQLSIRGFGSRSAYGIRGIRLYVDGIPATMPDGQGQTSNIDLSSVQNVEVLRGPFSALYGNSSGGVMNVTTETGRQPPTIEASSYYGSFGSWRYGMKATGAMGDGTQAGDVDYTVSTTRFTTHGFRDRSSAQKNLANAKLGVRLDDASKLSLIFNSVDIHANDPGGLTESEWKANPQQSPRAEQFNTRKTIKQTQAGLRYERQLSEHDDLSVMMYAGERETTQYQSIPMAPQRDNPAHAGGVIVLQRHYQGIDTRWTHRGELGVPVTFTTGLNYENMSENRKGYENYRLNNGVPQFGVKGDLRRNERNLMWNADPYLQTQWQLTEKLSLDAGVRYSSVWFDSNDHYVTPGNRDDSGEASYHQWLPAGALKYAFTDAWNVYLAAGRGFETPTINELSYRPDGQSGLNFGLKPATNDTVEIGSKTRIGDGLLTAALFQTDTDDEIVVATSGGGRTTYKNAGKTRRQGAELSWDQRFAGNWRVNASWTWLDATYRSNVCKSGDCNGNRMPGIARNMGFASLGYVPDEGWYAGTDARYMGDIMADDHNTAKAPSYTVVGLNTGYKFNYSNLTVDVFGRVDNLFDKEYVGSVIVNESNGRYYEPAPGRNYGVGVNLAWRFE

SEQ ID NO: 284 - protein, 696 aa, Escherichia coli str. K-12
MALTHRTFSHGIGVLTLSTLLASPPLMAEDSRQPDKPGKGSLALESLVVTGEKLDRELKDTASSVSIITDRDIDQNKTGDASVSEVINGSPNVIYTDSVGAPIIRGQDTQGPNNGQNVFWGGTVPRATINLDGHYLNYNEMFFGATSVWDLDSIEVFRGPQTTSQGANAIAGAIIVNTKNPTFTPEAAYQAEIGSYHSRRSSVAVSGPLAQDFAGRLAVDYSARDTFIDYDNPKFQGGKTDQDFRNLNARAKLLWLPTDIPGLESQFTFAHNDSNRPTQEAASAPFHKLEHSSTTMPSWEQDTNTSILDVSYELGNGLKLFNQAQYSLSSVHRVTGAAGEGDADIHQKNASNESRLTFGEKEDLLSGMGGIYYARTRTDETLNLRGRSAFDDTKTNLGIFGELNYRLTDLWTLSTGLRYQQDHIERTGNSVLAPGALNYDKTFSTVLPKVSLAYAATPHWTVGGLVSRGYNPGGVSLNLTTRQWAYFKEESIWNYELFSRASFLDDRLLINTNLFYMDFKDAQYNIPVVISPGVAQSYTINAEKAHAYGLELDLDYRLLDNLRLKASAGTLRTRIDKISSNADYAHNEFARSPGYTLSVGPSWDITERLNLNAQVRYLDGYYSDTANTSAYSIKPYTLTDARMSYRFNDQVQLYGYVKNVFDDRSPTYMQQNRGIGGIEASMTQPRTLGIGVKGAF

SEQ ID NO: 285 - protein, 724 aa, Escherichia coli str. K-12
MARVFLNVSNNVSRIYRESLFATTAILLIGIAASPAAAQSASAGDTATTLEPIVIQGASSDSKADRTSVTAKNSAGATKISTPLVETPRSVSVTTEKEIEQRGAQTVIEAVRYTAGVTTGPNGFDPRFDQIYIRGFNITTVGDFRDSLRQPYINYGMFRTDPYQLQRVEVIKGPVSVLYGAGSPGGLINKISKLPTEEPIREVGISYGTEDRLQGMFDFGGPIGEGKDDFLYRIVGLARRGDTNFDIADDRYFLAPSFTWKPDEGTMFTVYGLAQSDETDSNVGAITTLDGKIHELRESDPDYDDQKVRQQQVGYQFEHEFDNGLTFRQNLRYSHLNLEARYLGVTGWTGTVAHRGTNAIRDEMNVFQVDNQLESKFDTGPLAHTMLFGLDYTNLQSSFGYGAGAADPAFDFDIANPTYGVSGATPDYSILASDADMRQVGIYALDQIEVGNWRFNLGGRQTWVNQTRDAILPAVSSEEVDKNAFSWQAGALYLFDNGIAPFVSYATSFDPVTNRSTSGKILAPTEGEQYEVGVKYQPPGSDILLSAIAYHIVEKNKPVLVDPLLFAYGSIGEVTGKGIELEARAAVADGWDLIAAYTYNHSEVTGGGENEGNTPALTPSHVASLWANYTFQETNPFHGLSVGAGVRYVSENWTDTANTSKNPSSFYIDASAAYDFGAVDKKYEGLTAAFNIRNIADERDTVCNEGFCYLGQGRNMTGTLKYRW

SEQ ID NO: 286 - protein, 243 aa, Escherichia coli str. K-12
MKLLKSVFTLILYFIFSLSLFAEVKFSNDFNLDIKKKFSDLEIKTMYRDLSLNDKVSFSCFNNAIHGLEKIEDLEIFDSSNDNLLVMVDYTKPSTEERLFIIDLRKKQLLISSLVAHGRGTGDLYATNFSNKNNSYSTSSGFYLTGNIYNGKNGESLELYGLEKGKNDNARKRTIVIHSAYYANKSFAEKYGRLGRSKGCLVLPTDLNTKIINLISGGVVLYVHTNFDENKEYDFSKLLSKSF

SEQ ID NO: 287 - protein, 739 aa, Escherichia coli str. K-12
MASGAKVTGANSAIINDGTFYLGSATDAKNASMLEINDFAQFFNTGTLILDNNKNAIHLNANNGTLYNTGTMELTATSNKGAINYWGAGAAFINDGTVNATTAVLAYAGGGAGNAPDKHAFFWNQSNGVINYDADNGRAVDFSAYNNYVAVNDGTMNISGNNAYGMYGGKNAQLVNNNTINLGTEGTTDTGMVAMALDKNATANAVIENNGTINIYANNSYAFSVAGAGHVVNNGTVVIADGVTGSGIIKQGDSVNVEGTNGNNGNSDEAHYADYTLPETPVEPGSNTTSGFAPGDTSGASNNLNGYVVGTNADGSAGQLKVSNASMEGVGINTGFTAGTADTTVSFDNVVEGSNLTDASAIQSTSVVWNAQGSQDSDGNVDVTMTKNAYADVATDGSVSDVAQALDAGYTNNELYTSLNVGTTAELNSALKQVSGSQATTVFREARVLSNRFNMLADAAPQIKDGLAFNVVAKGDPRAELGNDTQYDMLALRQKLDLTANQNLTLEYGIARLDGDGSQKAGDNGLTGGYSQFFGLKHSMAFDEGLAWNNSLRYDVHNLDSSRSVAYGDVNKIADSDARQQYMEFRSEGAKTFSLMDDALKVTPYAGVKFRHTMEDGYKERNAGDFNLSMNSGSETAVDSIVGMKLDYAGKDGWSATATLEGGPNLSYSKSQRTASLQGAAGQSFGVDDGQKGGGINGLATIGVKYSSNDTALHLDAYQWKEDGISDKGFMLNVKKTFR

SEQ ID NO: 288 - protein, 214 aa, Escherichia coli str. K-12
MMQPSIKPADEHSAGDIIARIGSLTRMLRDSLRELGLDQAIAEAAEAIPDARDRLYYVVQMTAQAAERALNSVEASQPHQDQMEKSAKALTQRWDDWFADPIDLADARELVTDTRQFLADVPAHTSFTNAQLLEIMMAQDFQDLTGQVIKRMMDVIQEIERQLLMVLLENIPEQESRPKRENQSLLNGPQVDTSKAGVVASQDQVDDLLDSLGF

SEQ ID NO: 289 - protein, 409 aa, Escherichia coli str. K-12
MLCVGLSLWSATSGIHYVLPTNRFQCGSSEETILKRKTLALSIAAAGLCAGTQAHAQSSVQLYGLMDLSFPTYRTHADANGKHVIGMGNEGEPWFSGSRWGLRGAEDIGGGTKIIFRLESEFVVANGQMEDEGQIFDRDAWVGVEDERFGKLTAGFQNTIARDAAAIYGDAYGSAKLTTEEGGWTNSNNFKQMIFYAAGPTGTRYNNGLAWKKLFSNGIFASAGYQFSNSTAFATGSAYQVALGYNGGPFAVSGFYNHVNHGGFRNQTFSVGGNYTFSIVRLNAGYFRYNGDQGSLGQRHDDSWTVSMKIAPKGALDYELGYQQMRVKNAAYNADGFVPNANLGAFSLTNGVGNGFKETIYGSVFYHLSKRTELYLAGDYMRLHGGYTVSSTFGAKNQLELTSGIRTRF

SEQ ID NO: 290 - protein, 1071 aa, Escherichia coli str. K-12
MTKLKLFFSALMLLTIGNIFAQITTSSLSAKVNDGTSPLADAEVTLTHIPTNAVYRAVTNKQGRFSFENLNAGGPYELEIKSKDTKDYTNSQIHLALGDNDLPTIVLSKVDNTILEEVVITSSKPSSKNNGTNINEKQVNGLPLINRGIQDVTKLVPQSSNNSFAGTNFRYNNVTIDGSINNDAIGFSPSLGGQSGTSGMPGSSTRSNSISLDAIQDIQVYIAPYDIKLGNFLGGSVNAVTRSGTNTVSGSIYSYGRNASITGPNNAGDGSKMPKSFGDYQIGFRLGLPIVKDKLFFFTNMEYAERTDPIFYNAGQTDANGKLTSLVDNATADQISNFVKTNYGFDPGTYNSYNNFAMSRKFFNKLDWKINEKHSISLRNNTVVSQATNLERDAANFRFSDMDFTQKNQSISTVLELKSHFNSQWSNSFIASYSAIKDYRDPKSNNVMFPQVEIGYNGGTIFLGNDREATVFNMKQNTAEITDNLTYKTGNHTLLFGTHNEFYDINYGFVNALNGRVSYKSLADFYNKLPSRVRGTYPFDGSTRDEIFNNPYAKFKVNLYSVYVQDEIRIGNKLKVTPGVRIDYTDLPNKPKLSTQVQNSPADPNYGTTYSYTPLSQIKNNFFSTALVSPRIGFTYNVDEDKTLVLRGGSGVFTGRVPFAWLGYAYYNDGVGYGSYDKNNLTAAQVAAAGDPLSANGLNGYHDATPKVQADLIDNKFKMPAVLRNSLAIDKIIAGYKFTTEAIYTKVIRDLEFQQVNKTDNPTYFSYDTKHEMPIYAANINAAFSNAYLLSNTNKGYRYSITEMISKTYDFGVNFMVAYTYGDSKDVTNGIRNSMESNFQMNQSLTPNDPQLATSNFNIKHRIVSNVGYAVKLADNNTFSANVYFNAQSGNPFSWGFVNSTIAGTGQAAGLAYIFKDAAEAAKYIGVNNAGVPSATAAQQVADYEAFINGNDYLKSRRGTFTQRNGDTTPWNIQADLKLMDEIKVDKVGSFQISFSVANIGNLINKDWGRSYFVPNTYNSTASIGLTKSGNLGGLATGDPTYTFQKPTSAPYTIDQLASRFQGQLGVRYSF

SEQ ID NO: 291 - protein, 707 aa, Escherichia coli str. K-12
MAKIHSRKSVSLRKLKCSAAVSLAVMVMSGMVHAQQATTTGDEPATLEAIQVSGDLLGTGLQNSVKRYAGARTVVKKEEIENSGAASISDVMRRIPGVQVSDNSGSAGSAISLNVGVRGLAGRYSPRSTILLDGIPMANAPYGQPQLSFAPVSLNNVESVDVVRGGGAVRYGPQNVGGIINFKTRSIPTTPGATGDVSIRQNDYSKGGSNTQYSAFAGNQLENGLGFAVLYSGMSGSDWRVGSDEKVNDLALKFRYELSPTSEIYGKFSYYDVTSRTPGGLTVAQYNADPFQNTRPTDYWSGDRTAFDIGYINTISDTQEFEIRTYYNESNRQSTLYTVNRTTNAVSIQHQPRSYQTLGIEPRYTQRFNIGNTTNDVTVGYRYIRERGDDNVYSESVTTGALGAQTTFDNSTDAHSIYIDDKIAFGAWRITPGVRFEHINSLRHDRTTGADFEVKNNKPLPSLNVAYLLTQDITLFANYGTSFGVVQNTQLNTMTPGNPLKPELAKTVEAGARWKSKQVSAEITAFNIRFDNQIQSVGSGANLAFFNLGKTEHKGIETAVDYTFDKAGPMSGFNAFANYTYTRATLESGAFAGNDVPFYSRNTDTVGMRYETGPWGFNLSSTHQSSQFADERNTVAESVNGENGLIPGFRLWNAQVNWKSPNKKGLEILAGLNNLTDKRYFTRTTDGNLGKLVGAPRMIYVQARLAF

SEQ ID NO: 292 - protein, 877 aa, Escherichia coli str. K-12
MAMWDLGGTLGSALGGTWRRAALASASLIAIGQASAAQERSITPTFVRAGERLNIVPVAAGDAGPPRALSARRVRLSIAPGPLEPALASLIARTGLSLAYRTALTENRATRGVEGDVLPLEALARLLDGTGLTYRAAKHATITLVNPRYAQASLPPGDSNAPTPVGAAAASVTLDELSVEAQQPTFGTTGFVATRSTAGSKGNDSILETPATVSVITRDELNVRGVQDVNLAVAYTPNVQAVDYPGGQGGPTFTLRGFNANNFDSVYEDGLRYGFNSFDQNIEPYAYERIDVVKGPISVLYGQGQPGGIINLVSKRPTFVPFNEVFLQGGNYGRVQAGFDLSGPVEGAPQFAYRVTGLVRNADSQVKYTPDDRTFIAPALTWRPDADTALTVLGKYAEYRGGGSEQSLPIVGSILPSARGFFPRSPFVGQPNFNTGLLENKEIGYILDHSFAPGWLLHAAFRAYETTSKFDAVGASPAFTPPGFLAVSVFPYLRDQSSQGLLTDNYVQGRFDTWDIQHDVVLGVGFQNYYRRDARTFPNGYPTSAANRLIDLYDPVYNLGIAFPQQTNVATRALQQQTGAYVQDQMKWNGFILTGSLRNDWVEQQVRTTFNFPNLPVATLNRTTIDNQNFSALSYRAALGYAFAAGIVPYAAYSTSFNPQIAGQRADGSALPPREASQIEGGVKWQPVGTNALVTASYFEITQTNIPLADPLNPGFFIVTGAAESRGFELEGKASLFDGFNLIFGYAHLNTKVTRNATNPALVGNRLPNAPDNTLSLFADYTFPLNSPFAGFRAGAGVRYVGERTDATNVDRIPAYALVDASLNYDLAQLNPAWKGAVLSVNANNIFDQRYFTSGFYTGYVFEGFRRSVFGTLTYRW

SEQ ID NO: 293 - protein, 146 aa, Escherichia coli str. K-12
MNMFFDWWFATSPRLRQLCWAFWLLMLVTLIFLSSTHHEERDALIRLRASHHQQWAALYRLVDTAPFSEEKTLPFSPLDFQLSGAQLVSWHPSAQGGELALKTLWEAVPSAFTRLAERNVSVSRFSLSVEGDDLLFTLQLETPHEG

SEQ ID NO: 294 - protein, 1151 aa, Escherichia coli K12
MHMKSIKAPLLAATSSVMLAMAMTASADAIPFRDDVGDEGAQQFAQGWDGVVQIYLWNRVSGQITFNCTGSMINARTVISAAHCFDAYPEQVYADGPGSLTPIIAYGPDTFVPLFNWINTGQQFVDDLNGLSFGVDLMMHPDSEVNGVNTFPAADVAMIALSNPLYTLPTYGMLFSPIPEDVFNEGVLVNQIGYGTFHPGSDSSIGSINGRRRAGENMLGLLASQSDFFQALAGEGAGSPVPSDNQLLYWTDFDLPGRTGTCTRANLGPTGEDSIFCDDNVPGDGVRLDGDTVVLPGPSIDYFPGDALPNEVATGGGDSGGPLMAMNLFNNPLILGVLSGGFVDGFFHSSGQSYGEVSYYNPLFTYHQWISENNPYKYVSAMAGDGLWSDGDHWVQGLDPNYFVYNEDGEIVNGLPDGDEGGLGQRRPIEGIVFDTPVADTDTGDNPAGTGAGIGGGLVNFAANGVVATLPEGLRDGAAGSAWAAPEAATAQTVSGLIQTLTGPGYTGFVPSNYYGRPNAPAFEDPAQFFDVTLAAAGTTTFDLDFAEIDNLTLAGGDARLVINEDTDLTSLIGVNVIAGELEVNGGLLTRELMLWTGMLSGSGIVSLFDLNAFVGNGQILDGALFNVGGVVTAGAVGQTGSLTIQGDYIQTSGGVLGVDWSADGADLLVVNGDVSLGGLIAVNPLDGYVPTYGDTRRILSFAGERVGEFDGDNLPGVLYLATTYGAGFVNVTVEAESFSTQAQFQNGAQSGIAARLDNAREGSYDALSNLYAPIDLLSGEDLTSAFENLVPHEHYQLRRASEAHLELFANQMRDVALGQGRAEASGQAMAAGFTAQLMGGDQTARLDDASLAIAADQAAGGPNIQDQGNGWRLFGAAGATDGELDTTNVSSSELEGSYGFVGFDYQTRNWLRVGATLGYANSEAESLLVGGGQARSDVDTLQVGVFALAQQGGLTAMLSASHAGHTADSDRTAVVGGASFRTTGGQDGHTNAVTGALAYDLSPVEDALKLTPIVSATWSETRFDAGEQSGSVASMTVDPSEYVELVGRVGLAASTQFRLGAAVLEPRLYAGIAADARGSDEAVIASLNAASGPIVIDPVNTEDNDWSEFSLGVTAHLDSGLAVAISYDSLNDRRGVLDTETLSVGARFRF

SEQ ID NO: 295 - protein, 370 aa, Escherichia coli str. K-12
MASTALTAPAMAREGQWYVQGDAGVMLVEDTTFDVDGSPGDAVADHDTGGDFGALVGYDFGAFRLEAEVSYKEAELDEVAAGTEGLALNPSAQGGFNRFFDVRDALGETSALSFMINGLFDFGSDDGIQGFAGAGVGVARVDLDGRVNTNGPGVWDDSDTGLAWQLLAGIRAPLSDSFDVGLKYRYFNAESVSIIDPLGRPLEGDFNTHSILGTLTYNFGGEAPPPPPPPPPPPPPPPPPPPPPPPPPPPPPPPCNTGPYIVFFDFDESVITADAATILDNAVTAYANCGTAAVMLAGHTDRSGSVTYNMGLAERRNASVRAYLTGRGIPDGRISSEAFGESQPRVPTADGVRELQNRRVEVTYGPGSGM

SEQ ID NO: 296 - protein, 92 aa, Escherichia coli str. K-12
MANVYYDFGKESSIRPYIMGGAGMAHVNRLWTDENEEVFAWQAGAGVGAKAAKNTTLDCGYRYLKPDNVDTCGLGDGKLECHTIMLGLRYQF

SEQ ID NO: 297 - protein, 353 aa, Escherichia coli K12
MEKNLGSWEHLNMKKTLISASIASVLTLASFGALAEGPNFYGRLDLSVTDSDTGATTQEGKDGTVLETNFSHVGVKGSETIANGFDIIYKMEFQVENTSTNKDVFKARNTYLGLKTEMGTVLVGRNDSVFKQAEGGIDLFGNSNADIDRLVGGQTRAADGVWYYSPKIAGLVTLNATYLMEDNYTNDANKTSYEDQYALSATIGDKKLKAQSYYAAIAYNTIGGIDAYRAVGQVKLGDFKVGGLFQNTESQTNSDQEGNSYFVNVSYNLNGVNLKAEYGKDEAGFGKYYKNITDTDGSDVNVQVITIGADYKIAKSTLIYGHYAMYEGDHKIGTGTVDLEDDNIFTVGVRYNF

SEQ ID NO: 298 - protein, 555 aa, Escherichia coli str. K-12
MMQNKINLLLLSQIVVLILNVPVLAEDIVKNEWRSPDKSDVENLSSEVISEDAQDLGEEVFINPDIYSQTSPEQTMAQVTSVSQLSDVQPSDWAFAALQSLVERYGVIAGYPDGTFKGDRAITRYEFAAGLNAALDKVDQLIASGLTDKVTNADLETLRKLQEEFATELAISRGRVDALEARSADIQAQQFSPNVVLGGQTIFGLAGGFGGNRPGDGEANTIFTYLTQLQLASSFTGKDRFRIGLISGNAANNSFENLQAFNTNMARLAWQGNYDNQVSINSVEYRVAGLGDRVVFTFKPVGFSLGSVLSSNSIYADAGQGAISAFAGSTPILRIGNLDAGLGFDWLLSDEIRLQFAYGTRGSSDSNQGLFGADHSALGLQFLYKPTPSLITGLAYVNAYSSNGHLDTGTGSSNADTSGGINEPSQIHALNASMRWQLTNKLVLGAWGGVMVTDSLKSDAVVLSSTYTVSLGIYDPFGRKGDLFGFLYGLPPKLNNGVLIPTADTGNSTHYEVFYRYLVNDNIAITPGFFLVTDPGHISSNNDIFIGAIRTTFSF

SEQ ID NO: 299 - protein, 410 aa, Escherichia coli str. K-12
MTGKRWIVAAALALWASQAGAVNGMRMIGFGPVQSAMGGASVGLPLDSATVITNPAGLSLVDGRVDFGITILDADVRYRAVGAASGQEQTSSRRPTLIPGFGLVVPLGDRLTFGLGGYGIAGLGVDYPQDLLGGRLYTSYSQLRLAPGVSYRVTPELSLGVTANIMYATLEYSAGGGLGLQPRDGAISYGGGFTVGATWRPVQWLTAGLAYESRGWFQDFEYEVPAHTIVVDPATGATANVGPGVEKLELDQPDLLTFGVGLRPVAGLAVAADVQWIRWSQTNGRNQPRLQTDPALTGGMQLDLDWSDQWVLKVGAEYAAASWLKLRAGYDYGKSPLDADRALENLAFPAVLEHHVTAGVGLELGRTSVSVGGTYAPEGKQTGSNLAQGIAAYETTFTAWTLDVGVAHRF

SEQ ID NO: 300 - protein, 885 aa, Escherichia coli str. K-12
MRLLHSPSRPHCAAPSCPPPPHALSLALGLALIGWLPSHATAADMSGGGDALTMDAVQVRNPFQSQNTRAIATKQAAPTIVDSVAADSIGQLPDFNVGDALRRVTGVSTVEYQGEPRYVTVRGLNGNYNSMLIDGFAFASNDIGSRQALMDVLPANFVDRIDVVKSLLPENDGGAIGGVTNLVTATGFARPDGLLTASAKGGANLVGSRYGGRTPVGEGELKWGKRFGRDGQFAFLGAASVWRREISVPQQENGGALNWYNADGTRASSAYGGTGAAVPSERRWYNYDNTRERRGVTARVDWQPDGPLSGHVSGYTFDQHESSDRNAQVAQVQNSARLTRSGPQSGTLDNLNQLVELGQLRWKRGLSGINGELLAELPDQWRGALRASTSRATVDNPQTWDRFQQNGLAYGFDWNGTLPAFTALDPALAEDPTRYANLNHQQERTTYAERVSDLQLELRRNMDEDSQGLGLAFGLRQVRTHMQTAFQRTTWSGLPYSLADVLGNATCALGCNAPMLIIDPDLADARWDAVSGQARGVADITAQNSGTYSVDEQVRAGFAQAQWRGERWRLAGGVRLEQTRFGSSGQQLSGTVWAPVSAQRTYRNWLPSLAGQLQTSANGTLRFGASRSIGRPRLDQMALNGGVLTLGSNPPTLNQGNPDLQPRRSQNLDLGHDWTFDDGGSLLSIALFHKTIDNEIFRYGQLQSIDGEQVLVTQPRNTDRPVRMRGAELGAIKELGPWLPALAGLSVGANVTFLDVDYPVVLGDGSRTTLSVLPQQPKQLWNLTLNYARGPLRSTLAWSRTGELWDDRYPNYSNQQEFYRNRYQQPLDRLDLKLAWDVSPAVAVSLDVLNLTGQGYEYRIGRHQEYVQSAWKMAPTVMLGVNVKL

SEQ ID NO: 301 - protein, 798 aa, Escherichia coli str. K-12
MLKNTTYLFKQTFIASAIAASLSAPSVYAQGETFVMEEVLVTASKREKTLQETPIAVFVTSAETIERANILDTADLTSVVPTLRITPAGTRSASVRYSIRGLGNGGSNGTEPSVGVFIDGVYRARSGSIIGDLPRLQRIEVLSGPQSTLFGKNASAGAISIITMPPSQEFEAKVEAGIGNYNQQILKGYVTGGITDDIAMSFSAGTNQRDGYSEGRYGFSDLNDRDRWNVRSQLLYTPTEDFSLRIIADYSEIDEVCCTVANVINGAGVTAVINGLAGEQAVLDAGGSFDYKSLLDFDPTNAIEDGGISFHADIDFEDFTLSSITAYRFNEITTTGDIDFTALDIASSFSTPDVKTFSQEIRLTSTSDGPVSWILGGSLSKEEISTYGYTLYGDDLRPFVNSLIGGLLPTLELITGTPSGAFYAAGTKTIAEAGLDTDSYSIFGTMDYSINDKLTATLGLNYTKDDRESSAEQIDNPDLFGQVDWRTLNPFGAGATLAGLAFRPQALSYPNEVEDGKSSDDDVTWLARLNYELNDNVNVYVSAATGFKSSAWEGGKPNVEDQAAIEAAGIDVVNQTYGSRKSDPEYSTVYEIGIKSSFNNGSVNIAIFDQSIEDFQTRGFDGVNFINLNAGEISVQGVEFDILYAPSANWLFTMAGTYLDPEYVDYKEGVRTTDDFGTEPYDRSGTRPGGIHSLALSTAITYSFMLDNGANGYVRGDYLHESDTEISDSFPGLSREVGTFNASAGLLFDNGVGVKIWGRNLNNDEYLQGGFSGVAQRGTVNSWPNQPRTYGATVSYEF

SEQ ID NO: 302 - protein, 676 aa, Escherichia coli str. K-12
MKLAACFLTLLPGFAVAASWTSPGFPAFSEQGTGTFVSHAQLPKGTRPLTLNFDQQCWQPADAIKLNQMLSLQPCSNTPPQWRLFRDGEYTLQIDTRSGTPTLMISIQNAAEPVASLVRECPKWDGLPLTVDVSATFPEGAAVRDYYSQQIAIVKNGQIMLQPAATSNGLLLLERAETDTSAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTGYATLADMQEYQFGALYLSGDEVKKSLGERWSDWKPAAGQTWHSFNDYINFSDKTGWDKWWGKNWIRTDIGDYDNPGFDDLTMSLAFLPDIKTESTTASGLPVFYKNKMDTHAKAIDGYTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCLAQMDTTWQQMAEKLQGFNVLSYLSSHDTRLFREGGDKAAELLLLAPGAVQIFYGDESSRPFGPTGSDPLQGTRSDMNWQDVSGKSAASVAHWQKISQFRARHPAIGAGKQTTLLLKQGYGFVREHGDDKVLVVWAGQQ

SEQ ID NO: 303 - protein, 352 aa, Escherichia coli str. K-12
MAQVATWRRRLVWCVGGAALLCCAPSLAAQSASTGTGSVTLYGVLDTSLEITDPGSGWTPRLDSGAYRGSRIGLRGSEPLGAGTDLVFTLENGFSSTDGSLQSPGLLFNRQAWVGARGAWGEMRFGRQYSPIYIPFKGDLDAFGAGTIASGLNNLSKITPYASNAITYLSPVVGGFSGTVMMATRDPAESDGNGIDGYYVTASYQIDELRLLYARQQTHGAGALRANLGGATYAVNKVRVWLAFFNGDGGMPLYHGAGGALSAQYSFSSATRASVGYAHVRDFTGAGASADQFSLAFEHNFSATLLFYFSAAYLSNHDGAGFTLRGVNVTGLPVAYPGAPVAGVQFGVVERF

SEQ ID NO: 304 - protein, 839 aa, Escherichia coli str. K-12
MASIRLTYRRRPAPARHLPRASRPAAPGRLARRLAGAVLLSALLPLPALADTDADAAPAAPRASRRAFDIPAGPLEAVLNRFGRDAGILLAFPTELTAGLTSGGVHGRFDVDGAFDRLLAGTGLVALRQPGGGYTLMRADGSAAGPVAAGAAPAAELPTINVRSSALRAESYRAPKEAGVLRSDIPLLDTAQAVNIVPAQVLRDQRPRNLDDALGNVSGITQGNTLAGTQDTIMKRGFGGNRDGSIMQNGMPLVQGRAFNAATDSVEVLKGPTSLLYGLMDPGGVVNVVTKQPQLVRYNAISLGASTFGHGKNGGSATFDSTGPVGDSRLAYRLIVDQSSEQYWRNFGEYRQTFVAPSLAWYGRDTQVAVSYQYRKFHSPFDRGTALDPRTNAPLDIPARRRIDEPFNNMDGESHLAQLSVDHQFNADWSAHVGYSYNRETYDANQLRTTGVDPVKGTMTRSNDATHGSLSTDSYGIGYVTGKLSLAGMRHDVQVGFDTEYRRIYRKDMLRQAVKTPFSYVDPVYGLLPPSSTVSASDSDQTDTLHDASAFFQDTVHLTDKWIVSGGIRYITYNQVAGRGRPFTANTDLSGSKWLPRAGVVYKWTDSFSLYGSYSQSLKPSSSIAPMTGYIIDGATPPEEATAWEVGGKLDLAGGITGTLALFNIDKKNVLVSQYNDATKLTDWRTSGKARSRGVELDVSGKLGERVNVIASYAYIDAKTTEDPLYAGNQLWNVARHTASFAAVYDFGTVAGGDDLRLGADVRYVGARPGDSANSFTLPSYVLADAFATYDTRIGKQKLSFQLNVKNLFNRTYYPSSANRYFVAVGDARQVALLTTLQF

SEQ ID NO: 305 - protein, 1768 aa, Escherichia coli str. K-12
MWYSERLLGTTALAGLAFACLFSLQVERVNAQTVITGTINNPPFTINGTNGLRIGQNGADGTLNVFSGTTVPIGQLVEIGVANANGTLNVYEGASVTQSGNFVFIEVGNGFNEGTINLYESGQLFAPTGDIVLEGQGTINIGGEENAAARSAGYLRVDDIYMLNGSKIVINTTSSGGNHLMADLVSVSSGSGEVLFENGTTQITNNNSRFSGKMFFEENATAVFTGTNAVGNAQLDFVGGKVVTTGSTTISGDIEVTNVGAVNDATFETSNGNLTLSGDIIGNGKVRFEGNGITTLSGNNTWTGGADIDGTEVVFSTASHLGSGPIELNSGHLTFSGTTATVNNLFDLDGTSSMEVGSGDTLTVSNDISGSGRLKKLGDGTLVLGGTGSNFSGGLDLADGTVQFGSAASIGSGNIIYYGGDLSFVSGSDATISNTFEMHNNGTLDVQSGRTLTITGNIVNGGGSPGKLTIGSGGTVDLQGTNSFSGGLVVQENSTVGFSDSDDLGSGTVELDNGNLTFNGTTATISNLIDLDGTSSMTVGTGDTLTVSNDISGSGRLKKFGDGTLVLGGAGSSFSGGLDLAEGTVQFGAAANIGTGNIIYYGGDLSYVSGSDATLTNTFEMHNDGTLDVQSGRTLTITGNVIDGGGSPATLTIGSGGTVNLRGSNTFSGGLVIQENSTVGFADSNDLGTGDIGLDSGNLSFIGTSATITNNLELFDDSTIDLQSGRALTISGNITDGDGTPGMLTIGSGGTVNLGGTNTFTAGLTVQENSTVGFTSASNLGTGNIALNNGNLIFNGTTATIANGFDLTGTSAITVGSGDTLTASNDISGTGLLKKLGTGTLVLGGATSNFSGGLDLAAGTVEFGAAANIGTGEVLFYGGDLSYVSGSDATITNNFKMHDDGTLDVQSGRTLTLTGDITDGGSSPGTLTIGSGGTVNLQGDNSFSGGLIVQENSSVEFTDPDRLGLGTTTLSNGNLLYQGTTDVNLSRIAIASGTSNTIDIDDNTVDLEISSNLSGSGNLSIDGGQTATLTGTNSSWTGDLGITDTELIFNDGANIGNGNVGITLNSSTLTYTGGSTVTINELAFSGTGNVVGTTDVVGQINIMSGLTGSDQVTFTGPGEVNLLGDNSDYSADIEIDSGTVGLEGFSTSAIGSGDVIINGGTLFYLGTGSETVDTTKLQVNSNDNAIDMANAGASLTWTGNASPGGGTFLKNGAGTLILSDGTKSLVSSTINGGTMRIGASSTDSSTLAGSLTVNSDGRLEGYGTVSGSVTLNGGIIAPGASFGTITLGSLDATGTGGTLEMEIGSDPVTGMANADQIEILAGGSVDLTGVALDLVNVAGPTPVKIGDEFVIIDNLSVGGSLLTGTFSSVSHDMFMLDVNVLYGIPGDDNDVAIQFIRSSNNFNGLATTRNEHSVTLALDTINESGDLFTHLAPMNNAQIKALLDPLSGEINASTRAILLADSRFLRQAVNDRLYKAHSAFASEVDDDMVTRTVGDFEMWGQVYGSWGEFFSDGNARTTGRSVGGVLVGVDATYFDMVQLGVVAGFGRTSIDISSIDASSDSDSYSVGGYASANPIDNVKLRGGVAGTWYNIATDRDVALFPEETLSADQFAGSVQVFGELGYTLESTYGNLEPFAGVAYAYLTGPGFNESGGAAALKADSQSNSLTFLTLGTRGEFDLSNYLYGDTSFVGLAAWQYASAETLDYTQSFIDSGNPFTVASVPIARNVALIETGLQSNLTEHIQLNVNYYGLLSDEAVDHGANARLFVQY

SEQ ID NO: 306 - protein, 826 aa, Escherichia coli str. K-12
MSAIHELKPLLKALVMSRTLRSRSVLSGMGMACLLPLSAQVLAEDKAFNIAAQSLPQALQAFGEQSNMQVIYSADDLAGLKSFAVKGNMTPESAIGQLLRGTDVRFTVEGNTLMLVRSGSAKGLELGATTINASALGTTTEGTHSYTTGAVTIGKGQQKLKDIPQSVSVLTRKRMDDQNISNLTQAVEATTGLTALKSPGPGIFIYSRGFDIEAIQYDGVPIPRNVYALGSYITENMAIYDRMEVIRGAAGLLQGANSPGGAINMVRKRGQAEPTVTLSAKAGSWDRYGSQADVGGPLNDAGTIRGRAVVNYEKDHSFTDYAWNWEQTVYGALDFDLDEDTVLGIGFSNKKSHGRPYLLGLPRYADASNINLPRSTYTGATWNRSMNDQTAVYADLEHHFNDSWKIKASAIAMNESNEATYQFIAGVVPVGGSTGPRFSDYATDFANKNRAFDIYLDGQFEGFGFKQGLTVGANYSKFTSDDKYARQFTPGVDIFDIDHNRPQKSFDMIADAANLAVSTYDVRQKGLYGSYKINLTDPLTLILGARTSWYDFSFDQDNYFARELQEGGEKNSIKSTGRVTPYVGMVYALNEQWSAYGSVAEVFIPQTQLTKEKTALKPIEGTNYELGIKGELMDGRFNTSLALFRYIQKNRAVSDLTTDIEGPEACNGWYCSTASGKVRSQGLEAEIAGELFDGMQISSGYTYNTTKFLEDSDLKGKRFATGTPMHMFRLWGDYTLPGDFNKVSVGAGVNAQSSTVSFDRSFDLPGFAIWGSRVAYQATDEVNLAVNLNNMFDKRYIIPAFAQINSNSYYGDPRNVMFSVTYKPQF

SEQ ID NO: 307 - protein, 464 aa, Escherichia coli str. K-12
MTTRKIMASVLVSGLAGFSSLAQATDVFRLEGYGAVSRGMGGTAVAHDVGPAGMMTNPATLSLMQEGDQVMGGLDLVTTDIEVRNKNTGERVSSGEHASNRGPYAAPELAYTKRFGDWAVGVGAFAQGGLGTEYGTGSFLSRAVGGLNTGLDNSSRLLVLNIPFAASFKVSEKLAVGGSFDAMWQGLNLNLLLGADQVGSLLSSGRATGTLVPVLGGLPDLRGAHFSLTKNQPLGSGVDAWGYSGKLGMIYKATPETTLGASYTFKSQMDDMEGGATLTAVDGIAGQIPLKGKIKIQDFQMPAHLDLGFNQRLSAQWTVAVDVSQVFWKDVMKDIKVAFVADPSAAVPTGGTLNILLPQDYKDQTILSLGTAYDLSDQLTLRGGLRFATQALRSSTLFAVIPATPRTHLSAGLTYALSKQSKIDFAYSHALKETMDNSSLPNTSDPIQVKHAQNNATINFRYNF

SEQ ID NO: 308 - protein, 465 aa, Escherichia coli str. K-12
MIRKTACSVVALLVLLGATPAFATNGMNLEGYGAKSMAMGGTGSAYDTGNSAVMNNPATLGFMKEGESEIGFGIRGLHPNIKLENGGASDKSDATSFFMPSMSYMRRDGRFSYGVAMLAQGGMGTDYGDDSPLFSMGTSLKGAAGVSMSGKDIRSEVGVGRIMFPVAYHLTDQTTLGASFDVVIASMDLQMDMDGQHLAGMMAGNGGSISGSMASSLGAIIESGADINYARFDFSNHNPFIGKAVGFGTGLKFGFTHQFSKVVSVGASCHTQTKLADLETDKATLSFAGDFGEQSVTGKIKVRNFEWPATFAAGIALNPSDKWMIAGDVKYIDWSSVMDKFQMSFIADGSNPAPFAGQNLDVTMDQKWKDQTVWSLGVQYKATDKLALRAGASFSTNPVPDSNLNPLFPAITKNHYTCGFGYRVNDATSVSAAFSWAPKVTATNGDQTVISHSQTNWALNLTHRL

SEQ ID NO: 309 - protein, 1002 aa, Escherichia coli str. K-12
MTDVHAQNVRVTGVVSDTQGPLIGVNVRVKDSATGVITDINGKYSLEVPSNSTLVFSYIGYLNQEHKVGNKGVINVVMVEDTKQLEEVVVVGYGYQRKSDVATSVASVKTDELKSYPAGNVADMLRGRVAGVNVTSSSGRPGSNPNITVRGNRSISASNTPLYVIDGSISDSEEFSTLSAENIESIEILKDAASQAIYGARASDGVILVTTKRGSQGKMEVSYNGYVGIQSLWRNFDFYSPEEYVMLRREAKANDKGVIDAREISIAEALGDDVMQQVWASGQFIDWEKEMLKNALYHNHDVTLRGGNDKIRMAAGVNYFDQDGMVTTGSGYQKAAFRLNVDYNINKWISLGVNSSYALTKSDREDGSFSEFITRTPIAQIYNEDGSYSRYINSNNDVNPFYRAENYKREISTNSYRLNVFLELKPFKGFNYRLNTSFYNREQEDGEAKGVNYPGGGATAKLTDREDRSYLIENIFTYNVPIKDQKHKLTITAVQSVDHKQTKQLGYATDQLPVDMDWNFIANGQFTGSPIRSFTENNLVSFMGRASYILMDRYIMNVAVRRDGSSRFGKNNKWGTFPSVALAWRVNQEKFLQNATWIDNLKLRLSYGIVGNQNGIGNYTTLGLTDKLRYEFGDNSYMGYLPGAELTNPNLKWEQSRTVNMGLDFGLFRNRLSGTIEYYKTRTTDLLVYRGLNSALGYEKMLDNLGETKSSGIDISVSGDVIRTKDFTWSLGANFSQYSNEIVKIDDQVDENGKPLSQPGNNWFVGKPINVYYNYEPDGIYQYTDFDITRDAYGKLTYTLKPTIDTDGDGIPDKVLVRQDAVAPGSVKVKDLNGDGKITADDRTPISKDPDFTLSLNTSLKWKGFDFFMDWYGVSGRKIQNAYLSDANSGGSLQGKLNGVKVNYWTPFNPSNDFPRPTHNSNVTYQSALAIQDASYIRLRTLQLGYTFPTAWIKKIQLQKLRVYATATNLLTFTDFLSYSPELTPGAYPESRQFVFGVNLSF

SEQ ID NO: 310 - protein, 683 aa, Escherichia coli str. K-12
MSDLLSIGLSGLGTSQTWLTVTGHNITNVKTPGYSRQDAIQQTRIPQFSGAGYMGSGSQIVDVRRLASDFLTGQLRNATSQNSELNAFLGQIDQLNSLLADNTTGVSPAMQRFFSALQTAAQNPSSTEAREAVLAQAQGLSKTFNTLYDQLDKQNSLINQQLGALTSQVNNLSQSVAEYNDAIAKAKSAGAVPNDLLDARDEAVRKLSEMVGVTAVTQDDNSVSLFIGSGQPLVVGNTVSTLSVVPGLDDPTRYQVQLTLGDSTQNVTRLVSGGQMGGLLAYRDTVLDSSYNKLGQLALTFADTVNKQLGQGLDLAGKAGANLFGDINDPDITALRVLAKNGNTGNVHANLNITDTSKLNSSDFRLDFDGTNFTARRLGDDASMQVTVSGTGPYTLSFKDANGVDQGFSVTLDQLPAAGDRFTLQPTRRGASDIETTLKNASQLAFAGSARAEATTNNRGSGAIGQPNLVDGPSPIDPAVLQNAFGANGLPLSATVSADGKTYTMTSPLPAGWSYVDKDGNALPGSPTLNSGTSNSVRMAYTDPGSGQTYTYEFNLSNVPQTGDSFTLSFNKDGIADNRNALNLNALQTKPTVGGTDSTGSTYNDAYGGLVERVGTLTAQARASADASQTVLKQAQDSRDSLSGVSLDEEAANLIQFQQYYSASAQVIQVARSLFDTLIGAFR

SEQ ID NO: 311 - protein, 591 aa, Escherichia coli K12
MNQAKVFRIALLNVPTILGIIIGLSTAAIAGEPTRRDNTQQPSSIAQTPLNLEIPVPDAALETEELNPSATPETPEPSLDLDAMENQGMGQITNVSQLRDVSPGDWAYEALRSLVERYGCIAGYPDGTFRGNRAMTRYEFAAGLNACLQQIERLIGNVPDNIEELPTLRRLVEEFEAELATLGARVDNLEGRVAFLEDHQFSTTTKLSGEVIFGLVDAFGDEVGDDVNTVVHDRVRLNFLTSFTGKDMLQTRLQAGNAALLLARDGVTFDDGSQFTQEGRFTYDGDNGNDVIIDILRYRFPLGDKATVQIVANNGLHHYYVDTVNPFLEGLAGGSNAISRFAERNPIYRIGPFGAGAAIALKPSDNIRVDLGYISNTASNPGEDNGLFNGNYSGIAQIVYGSRFKIGLTYVHAYDDGSFNDGDGARRFLLGGTGTAFANLNPGQLANVTNLSADTLSTPVVSNSYGIEASLRFSPSFLVNGWVGKTDARLIGLGDADIWNFALGLVFPDLGKEGSFAAVVAGAEPTLRGLDVPGGTNDFNRDFAYHIEGFYKYQVSDNLSITPGIIWLTAPNQNSDNSDAVIGTVRTTFTF

SEQ ID NO: 312 - protein, 248 aa, Escherichia coli str. K-12
MLKRVVLLGALSVAASAEENAAFVGANYQVGMIQNQTKMVNELGVQKPLMKFPPFAGAGAQVGYKQFFGKKKWFGMRYYGFFDYTHDRFGVMTKGIPVGASGFIYNSFSFGGTTLTERDSYRGQYYVNLFTYGAGLDTLWNFVNKENMVFGFVVGIQVAGDSWATTISKEIASYAKHHSNSSYSPANFQFLWKFGIRTHIAKYNSLELGIKVPTITHRLFSITNEKGYTLQADVRRVYAFQVSYLRDF

SEQ ID NO: 313 - protein, 974 aa, Escherichia coli str. K-12
MKKNQFISLAIYAMKFSIYQIIAISIFNITAFSKGVDAQGVLDKQLSLKAEQQNIKTIIDKVEELTHVKFVYGPKSINSSRRTSIHAVNEKLGGFLEKLLKPYDVSYKVINDRILLYADNDGSTTQLVDVIVNGKVSDSKGSGLPGVSVSLKGTTTGTLTDVNGQFALKVATAGNYTISFTYIGYITKEVNININEAQKPIEISLSEDALQLDGVVVTGGGNPKKKLESSVALTSISNKDIVNRAPLNSIDLLKAVPGLTVESTGGDGPGNVWVRGFPQQGGYIFLGIQEDGLPLLPTGFNSTPSIDQYYKTDLTIQNVEAIRGGNASIIQANTPGAVVNNISYAGAEKAYGQFKFTTGLSQGLYRVDANTGGKLSDLVKYNIGGFYRSDNGVVNPGFKPANAGGQIKGNMTFSFKNNKGFVRVYGKYLNDKVQWLLTSYYPYDGTGKPRKYGNFDMVTQSITPMQTAWEYSDPTGKSHSFNLEDGMHTRLGSGGFQFNYTTDNGWQMVNNFRYQNTHTNSTSSTPVGITARTTTTPYYYTNGEAAPFAAGDQVITNSSGGQLNSDVQIVDYLDLKKTIKNHSINIGGGVHIYNRDDLRYAFRTYSEFKENPNILIQAPANSSRIIQTKTTFIGDTRTLSAYASDEVKLGEQWRVDLGVRVDNQNVDGKRPFYAFNTDGTPNYRAASNPTIAGYTDYNETITNWAASIGLNYKINTTSSLFARATRAYNAPNIADYNATAYNPDNIKDRPVYLAELGYKYAKNDLAIFASGSYSAIKNVSLAINVPTTAAGLQALIAFGSTRTWSAEYEVSYKLFKPLSLRFTGTIQDSKYTDYTASTASNAAVAAEFGDRTYSFTGNRTERVPVINTELSANYEFGKANLYVSGNYIGSRFTSPSSSYKLPAYIIMRGGAGYKLAKKVDMRFWVDNLLNARVLTEGDVRGDQFRDFSAITPGTLQIGRTLLQRTFWASLAYSF

SEQ ID NO: 314 - protein, 492 aa, Escherichia coli str. K-12
MNFRNGLQVQQAGQAAAQEVAQQQVRVNSQTQAMQAQAQQGQAQQNQQQVQQNQQQVQQQNQQQQQAQAQREANERARQQRLQAEREENARREQQQQQQEEERRNENERLAQQEANERAIAEENNRRIEEQRLQAEYQQRQANEIRVAEEYVKKPESQKLAEAINNTIVAHTENTFVAEVQKEVIREKSALVMKNPEKHAVELAKELINNKAELKEVAKVANDDTVVVSKTKQEQSLLFVANLAQVAPDNAKKVVEHLTEQGTRSVSVANVTAEAVTANINNHLSGGTMIAVAAGDEETPIITKKGLWVAGTFGSSTQDAYKGNPSYKGTVSGGTIGGDLYIGENSLVGLAYSRMNSDFKFKGSSTGDKLSAESDIISLYGQQQFSNGLILQEIFSASNSKINKKDLRPVGPNSYKTASGKYTSKAYGFEGNVGYQFSPVDGINLMPNIGIRYNTYKDNAYTETGTGVNNMYVAGKSGNFNYRDCRHKINRS

SEQ ID NO: 315 - protein, 710 aa, Escherichia coli K12
MYFSLITRSIFCLLMFYAVNALAISLEADDEEALLSLYGDEEMISLATGNSKPISRAPAIATVITAEDIKEIGATDIDQVLETVPGLHVARSPRGYNPIYTFRGIFSQFNSQVLMLINGIPITNLFAGDRNQVWGGLPVQSIARVEVIRGPGSAIYGADAFAGVINIITKAKEDIAGTEVGGRAGSFNSWDGWALHGDSWGGFDVAVMLEYGDTDGQRRTIDEDAQTFFDSQFNTDASLAPGSVNLQRENFDARVDISREHWRLRAGLQRRQNVGTGAGVAQALDPSGRFASDRWNADLTYHNPEFFSENWDVTAQLSYFNTSQEVEQNVRLFPPGADFNSAPGIDFPEGVIGNPEVFERHARFKVSTFYTGFEQHQIHAGTGMRYGDLYDVKEVKNYEFDFETGLPRPLGGLRDVTGDLSQVFLRERDRKNYYVFLQDVWNFANDWEFTAGVRYDHFSDFGDTVNPRLALVWATRYNLTTKLLYGRAFRAPSFAELFNINNPVAIGNPNLDPETIETVELAFDYRPSNALRLALSLFHYRWDDIIQFVSDPGTSVNVAENAGRQKGFGMELEADWALTSNFHLLGNYAFQHSTDEKTGKNAGHAPQHQIYLRGSWEFLPHWRLTPQFNWVIDRSRTASDSRPAINNYSIFDLTLRRTAIKRHWEVAFSVRNLFDSDAREPSPAGNPGALIPNDLPLSGRSFFGEIRFRF

SEQ ID NO: 316 - protein, 91 aa, Escherichia coli K12
MSGDENKLKKYRFPETLTNQSRWFGLPLDELIPAAICIGWGITTSKYLFGIGAAVLVYFGIKKLKKGRGSSWLRDLIYWYMPTALLRGIFS

SEQ ID NO: 317 - protein, 780 aa, Escherichia coli str. K-12
MSDSNFNLKSLAAILLGGVALPLLLPASQALAACALTSATPTLDTVECIGNTTVGSLPVPAVPISTQLILGADGNAATINLTANLPIFVTGPAGTFFGLDTANTGAPSSIIGVGTAVQVLSLNGADIRIGQNSVGGGLNANIIGLSGNGISAIASGAGGVSITTAPGTLVSGLLEGINVTVVDGDANITFNGDVRTTTPASFYDIAVRSTGAGNINIGGAGTVLAGGITALSAGTGDITVSGSGNTIDLINGPGINAVANGGNITINRSGFIVGALDGVTATTVGAGNITISTVGDVTGNDGFGLRTSVANGLATINVGAGSTIRGSAGPISPTGLTNINNAGTLSFVNSAIGVTNWATTTLNGQGGALAIDVNSVAGTADRLTVSQLTGTNLISVANVGAAGLISTPIPILTATNLAGGATVAAAQTPGIIDYTILQSGNTFSLASTVNTSVASATPTSIDAMLTALNTGFFQNASAFLSEPPDPGKNQWNGGLWIRLANGRNDISSTTTAFNATGAASSPAKVRADFDGFQTGVDLGVANVEGTGWNTHLGVTAGLVSLRTNDLILSNITSQANVPFIGIYAAVTGHNFFVDAQLREDFYALNLTNPAAFLNNSGLSGTAVAANASAGYRFDLPSAWFIEPSVAFMYSSLHMDSLRVGLDPSGTSFGTLDFNPFESALGRAGARVGTTYVFEQAELALQPFVTGSVWREFAGDTNTTFSAGASSVPLSVTRIGTFGQVGVGVSGQVLKTGLLGFLRGDYRFGEKIEGYAVVAGMRYQF

SEQ ID NO: 318 - protein, 113 aa, Escherichia coli str. K-12
MKTLPAITQRAVKPCLSPVAVWQMLLTRLLEQHYGLTINDTPFCNEAVIKEHIDAGITLADAVNFLVEKYELVRIDRKGFSWQEQSPYLRAADILRARQATGLLRQSRNNVVR

SEQ ID NO: 319 - protein, 713 aa, Escherichia coli str. K-12
MSFNNKILAALMGSALAMPAFAADADADAAPNRDDIIVLGQQMKAAPNAGKSDVPLIETPQAISIISTEQLKARGVVRLAEALRGVAGVSRSSTYGYYDAYQIRGFDAAYGSVYLDGLISQNVAGSNNELAGLEQIEVVKGPASMLFGSAPLGGIINLVSKRPRDDDFVDVGLATGSYNLVEGTVDANMRLDAAGTLLARLNLVYRDSNDFVRFADKNRIHIAPALTWRMGEDSELTLLTRYERNHDSPWSPVSAWGTVLPSAHGKLPIDFTINGKDSKAIHNQRYYHLGYAFKHRFSDALSFDQTLRYTDRKVYWNNWIFWAGFVDGAVVDGVQQGHVAGRYVYGPFRQRDKDLSTDGHFTLRVETGPVSHEILVGLDYRRNRSRFADDGGNFDPSANPLDILAPDYDRPFVHDPAAAYGGGGKSDQTGLYIQDHVRFGERATLTLGGRYDWAHSDGGVKDHKFSPRVGATYVVLPGASLYASWSKSFVPQAGSFTVAGDALPPETGRNIETGIKVQSPDSRLTGMVSIFELTRQNVATEDPANPFFFISTGEQRSRGVEVEATWRPTPAWTLSIAYAYLDAKITRDNLLPVGARLQNVPRHNLNLFGEYVVPQGPLAGLGLNLAFQYNSDKIGANYPEDVNGDGVPDPIAAFTLPSYALVDAGISYRFGPWGVRLNVNNLFDKRYFPDACCVDRVTPGEPRNWRLSLTRSF

SEQ ID NO: 320 - protein, 769 aa, Escherichia coli K12
MMIINKPAVCAAILFSISAASSYGEWLQESEFDLAEFNEFSVPVVLTATRIQQHQADVPASVTILDRSFIERSGVQTLSELLRFVPGMIVGPDRNNNTDSVQYHGGPTALPKNLQVLLNGRSMYRSGLAAVSWYEMPVSLNDIRRIEVVRGPNAATYGANSYQAVINIITRHPADTYGQTAEVQLGNNGDKTLYVSQGDRIHKTDYRFTYEYKQTDQFQVDEDERENQFIDFTTSTYLKNNAELQTYTVVSQGNRELTTNDTLVTLQQNENQVDENRYEFGMSYTQDLSSKHQIKLTSYATYYQQEQEYVLEGIPIALLDDDIRALYTDNKNLVEGSGTSAKGFEEAIETENPALIAGYYSSLSNEEKTNVGFLNMFLVGQFPGGESLLSDYTSRLSAPYQASVAAIVDRYENDPQTSPFDTTVAGTVFADLDEYRYDIELQDTYIVNDDLTLVGGASFRRDIVESDHYFSGRFTNDTYRLFSSATWQATESTITHFGLMAEKESDADAVFAPRLAVIEKLNPAQSVRFVYSESVRSPDLFEQYANWNFEVRNAESDGQLNGTTYYETSQGPGRLDHQHIASTEIGYYGRYQKLDAEIDVRLFHERLTDVIYQSLSLGDFETTTSNRIEFNGIEMQSTFVPWQDGQLRTVAAYIDAETNQDDNEDARRLLRIYAQHQVAVTWLQTWQHNINSAVSYLRTWDYDQLNEAPADRTELERIDARIAKRWVQSDWDVELSLTAQHDLTSDAYVWPQTVYQDRTRAQLGLQVGW

SEQ ID NO: 321 - protein, 1026 aa, Escherichia coli K12
MMFLLGLCGFAYAQNIQIKGTVTSATDSYPIIGASVVDKADKTNGTITDIDGNFTLTVKPGSEITFSYIGYKTLTLKAETSMSVIMHEDSEMLQEVVVTGYTTQRKADLTGSISVVSMDEIAKQNENNPMKAMQGRVPGMNITADGNPSGSTTIRIRGIGTLNNNDPLYIIDGVPTKGGMHELNGNDIESIQVLKDAASASIYGSRAANGVIIITTKKGKEGQLKINFDASVSASMYTNKLEVLNTEEYGRAMWQAYVNEGQDPNTNNLGYLYDWNYGVNGYPQLNGISMRKYLDAANTVPAADTDWFDQTTRTGIIQQYNVSVSNGSEKGSSFFSLGYYKNLGIIKDTDFDRISARMNADYKLIDNLLTVGEHFTVNRTSEVQAPGGFLQNVLQANPSLPVYTTEGKFAGPVSGYPDRENPVARLQRNADNRYTYWRMFGDAYINLNPFKNFNLRSTFGIDYSQKQQRIFTYPITEGNVANDKNAIEAKQEHWTKWMWNAIATYNMEVGKHRGDVMLGMELNREDDIHFSGYKENFSILTPDYMWPDAGVGTAQSYGAGEGYSLVSFFGKLNYTYNDKYLLSLTVRRDGSSRFGKDNRYATFPSVSAGWRLSQEEFMKDIKWLDDLKIRTSWGQTGNQEISNNARYTIYVPNYAGTESGGGSYGTSYDITGSNGGSILQSGFKRDQLGNNGIKWETTTQTDLGFDFSLFAQTLYGSFDWYYKKTTDILVQMAGIATMGEGSKQWINAGEMENKGFELNLGYRNSTKFGLKYDINANLSSYRNKITALPATVAANGTFGGNGVESVIGHPNGAQVGYVADGLFKSQEEIDNHATQEGAGLGRIRWRDLDSNGIINEKDQQWIFDPTPAFSYGINIYLEYKNFDLTMFWQGVQGVDIISDLKKETDLWSGLNIGFLNKGKRVLDAWSPANPGSDIPALARNDSNNEKRVSTYYVENGSFLKLRNLQVGYNVPKAWTEKIRMERLRFYLSAQNLLTIKSKDFTGVDPENVNYGYPIPLNITFGVNVSF

SEQ ID NO: 322 - protein, 379 aa, Escherichia coli str. K-12
MMKSKMKLMPLLASLSLISGCTVLPGSNMSTMGKDVIKQQDADFDLDRMVNVYPLTPRLVEQLRPRPNVAQPNMSLDQEIASYQYRVGPGDVLNVTVWDHPELTTPAGQYRSSSDTGNWVQPDGTMFYPYIGKVSVVGKTLSEIRSDITGRLAKYIADPQVDVNIAAFRSQKAYISGQVNKSGQQAITNVPLTVLDAINAAGGLTDMADWRNVVLTHNGKEQRISLQALMQNGDLSQNRLLYPGDILYVPRNDDLKVFVMGEVKKQSTLKMDFSGMTLTEALGNAEGIDLTTSNASGIFVIRPLKGEGGRGGKIANIYQLDMSDATSLVMATEFRLQPYDVVYVTTAPVARWNRLINQLLPTISGVRYMTDTASDIHSW

SEQ ID NO: 323 - protein, 276 aa, Escherichia coli str. K-12
MRRFFWLVAAALLLAGCAGEKGIVEKEGYQLDTRRQAQAAYPRIKVLVIHYTADDFDSSLATLTDKQVSSHYLVPAVPPRYNGKPRIWQLVPEQELAWHAGISAWRGATRLNDTSIGIELENRGWQKSAGVKYFAPFEPAQIQALIPLAKDIIARYHIKPENVVAHADIAPQRKDDPGPLFPWQQLAQQGIGAWPDAQRVNFYLAGRAPHTPVDTASLLELLARYGYDVKPDMTPREQRRVIMAFQMHFRPTLYNGEADAETQAIAEALLEKYGQD

SEQ ID NO: 324 - protein, 803 aa, Escherichia coli str. K-12
MRLAVSALAVSSALILPGVHAEDQQATLDQQASFEKIEIIGSRIALRTATDSVAPVDIITAEQLESTGMTETAKALQFAAPSYSFPFSSVTDGSDAVRPASLRGLSPDHTLVLVNGKRRHGSALVHLSGTVGKGSSNVDLNAIPMTAIKRIEILRDGASAQYGSDAIAGVINVVLKDNEQGGSLSAQAGQTYAGDGEQWRLGANHGIALGDDGFVNVSLEAHHKDSTNRAGLDPRQQYPQLADGSPDPREATFNRKSHQVGDAEYDNLGLFINAAKAISDNGELYAFGGVSKRETKSGAFYRRALDKRNLTEVYPDGFLPQINPEIIDTSLVLGYEFTLGEWNIDTSAGHGENSFNYNIVNSLNASMGPDSPTEFDAGTLSTRETNLNIDASRYFNFANDSEILFAAGVSWRKNGYQIEAGESASYINGGFDNRAAGSQGFSGFTPESEVDETRDNTGVYVELENQLTDDFYWAAALRYENYSDFGDNTSWKLAGRYDFTDNLALRGTINTGFRAPSVQQLYFSNISTLFNPDPVTGQLVPTESGTFNTLSPVTKGLGINELEPELSQSFSLGLVYRNDAGLALTLDAYQISIDDRIILSSSVTPDDSPAVAEALAGTNAESARFFINAVDTRTRGVDLVISQDFDIGAWGDLQANLAYAYNKTEIQDIHFPQVLDGVGKELFDRIEQTRMTAATPNNTGNLGLTHRLGDFKTNVRLSYFGDYTVGYSSGDVTYSDQWVMDMSVQYAATEALSFTAGAQNLFDVYPEKRPDSNNFNGIFVYPLTNTPFGFNGGYVFLEAKYTY

SEQ ID NO: 325 - protein, 500 aa, Escherichia coli str. K-12
MSEPLLIARTPDTELFLLPGMANRHGLITGATGTGKTVTLQKLAESLSEIGVPVFMADVKGDLTGVAQAGTVSEKLLARLKNIGVNDWQPHANPVVVWDIFGEKGHPVRATVSDLGPLLLARLLNLNDVQSGVLNIIFRIADDQGLLLLDFKDLRAITQYIGDNAKSFQNQYGNISSASVGAIQRGLLSLEQQGAAHFFGEPMLDIKDWMRTDANGKGVINILSAEKLYQMPKLYAASLLWMLSELYEQLPEAGDLEKPKLVFFFDEAHLLFNDAPQVLLDKIEQVIRLIRSKGVGVWFVSQNPSDIPDNVLGQLGNRVQHALRAFTPKDQKAVKAAAQTMRANPAFDTEKAIQELGTGEALISFLDAKGSPSVVERAMVIAPCSRMGPVTEDERNGLINHSPVYGKYEDEVDRESAYEMLQKGFQASTEQQNNPPAKGKEVAVDDGILGGLKDILFGTTGPRGGKKDGVVQTMAKSAARQVTNQIVRGMLGSLLGGRRR

SEQ ID NO: 326 - protein, 301 aa, Escherichia coli str. K-12
MSGAQNRRHTAMRGPRAHRAIEVSGDLMKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGHGVIRPPGPSGSLGNVDLDKPANQPAVKNARQWSPTIILNYYFNAPTAKFRPFVGIGVAYSWFSNIELNGNFAKDINDNLGSVLAAGAGKPGPTSVEGKASSSFTPVYNIGASYAIAKHWALTATLSYMPLKTYSSLVIKAADGTTLATTRTRLKADPLITFVGISYKF

SEQ ID NO: 327 - protein, 767 aa, Escherichia coli str. K-12
MKRILVSLVVLSHSAHAVKTHNLERVEASGVANDKEAPLSWRSKEVRNYMGSRTVISNKQLTKSANQSIEEALQNVPGVHIRNATGIGAVPSFSVRGFGGGSSGHSNTAMVLVNGIPIYVAPYVDISIPIFPVTFQSVDRISVTKGGESVRYGPNVFGGVINVITKGIPTKWESQVSERATFWGKSENGGFFNQNSKNLDKSLANNMLFDTYLRTGGMMNKHFGIQAQANWLKGQGFRYNSPTNIQNYMLDSLYQINESNKITAFFQYYNYFMADPGSLGIAAYNQNRFQNNRPNNNKSGRAKRWGAVYQNFFGDTDKIGGDFTFSYYGHDMSRDFQFDSNFLNVNTNPKLGPVYTDQNYAGFFIFDHLRRYIMNAFEPNLNLVVNTSKVKQTFNVGMRFMTMDMYFRLDQSTCEKTDIINGVCHMPPFVLSKKPSNNQNLFNNYTAVWLSDKIELFDSKLVITPGIRYTFLNYNNKEPEKHDFSVWNITKKRQNEWSPGLNIGYKPMENWIWYANYRRSFIPPQHTMLGITRTNYNQIFNEIEVGQRYSYKNLLSFNTNYFVIFANRYYAGGYSPQPINARSQGVELELYYAPIRGLQFHVAYTYIDARITSNADDIAYYFTGIVNKPFDIKGKRLPYVSPNQFIFDMMYTYKHTTFGISSYFYSRAYSSMLNQAKSQTVCLPLNPEYTGGLEYGCNSVGLLPLYFVLNVQVSSVLWQSGRHKITGSLQINNLFNMKYYFRGIGTSPTGREPAPGRSITAYLNYEF

SEQ ID NO: 328 - protein, 1287 aa, Escherichia coli str. K-12
MEIQQTHRKMNRPLVSLVLAGALVSAIPQESHAAFFTTVIIPAIVGGIATGAAVGTVSGLLSWGLKQAEEANKTPDKPDKVWRIQAGRGFNNFPHKQYDLYQSLLSSKIDGGWDWGNAARHYWVKGGQWNKLEVDMKDAVGTYKLSGLRNFTGGDLDVNMQKATLRLGQFNGNSFTSYKDSADRTTRVNFNAKNISIENFVEINNRVGSGAGRKASSTVLTLQASEGITSSKNAEISLYDGATLNLASNSVKLNGNVWMGRLQYVGAYLAPSYSTINTSKVQGEVDFNHLTVGDQNAAQAGIIASNKTHIGTLDLWQSAGLNIIAPPEGGYKDKPNNTPSQSGTKNDKQEISQNNNSNTEVINPPNNTQKTETEPTQVIDGPFAGGKDTVVNIDRINTKADGTIRVGGFKASLTTNAAHLNIGKGGVNLSNQASGRTLLVENLTGNITVDGPLRVNNQVGGYALAGSSANFEFKAGEDTKNGTATFNNDISLGRFVNLKVDAHTANFKGIDTGNGGFNTLDFSGVTGKVNINKLITASTNVAVKNFNINELVVKTNGISVGEYTHFSEDIGSQSRINTVRLETGTRSIFSGGVKFKGGEKLVIDEFYYSPWNYFDARNVKNVEITRKFASSPQENPWGTSNMFNNLSLGQNAVMDYSQFSNLTIQGDFINNQGTINYLVRGGKVATLSVGNAAAMMFNNDIDSATGFYKPLIKINSAQDLIKNTEHVLLKAKIIGYGNVSTGTNSISNVNLEEQFKERLALYNNNNRMDTCVVRNENDIKACGMAIGNQSMVNNPENYKYLIGKAWRNIGISKTANGSKISVYYLGNSTPTENGGNTTNLPTNTTNNARSANYALVKNAPFAHSATPNLVAINQHDFGTIESVFELANRSKDIDTLYTHSGTKGRDLLQTLLIDSHDAGYARQMIDNTSTGEITKQLNAATDALNNVASLEHKTSGLQTLSLSNAMILNSRLVNLSRKHTNHIDSFAQRLQALKGQRFASLESAAEVLYQFAPKYEKPTNVWANAIGGASLNSGSNASLYGTSAGVDAYLNGEVEAIVGGFGSYGYSSFSNQANSLNSGANNANFGVYSRFFANQHEFDFEAQGALGSDQSSLNFKSALLQDLNQSYNYLAYSATARASYGYDFAFFRNALVLKPSVGVGYNHLGSTNFKSNSQSQVALKNGASSQHLFNANANVEARYYYGDTSYFYLHAGVLQEFAHFGSNDVASLNTFKINAARSPLSTYARAMMGGELRLAKEVFLNLGVVYLHNLISNASHFASNLGMRYSF

SEQ ID NO: 329 - protein, 826 aa, Escherichia coli str. K-12
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLEWQLHSDASFSKTNNNPGVWKSNTLYLERGFAQFLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGTMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNWRRISYTLAASQAYGENHHEEKRFNIFISIPCDWGDDVTTPRRQIYMSNSTTFDDQGFASNNTGLSGTVGSRDQFNYGVNLSHQHQGNETTAGANLTWNAPVATVNGSYSQSSTYRQTGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEIPPSVNVAIDKQQGLSCTITFGKEIDESRNYICQ

SEQ ID NO: 330 - protein, 573 aa, Escherichia coli str. K-12
MKRSHYIIGGLALAMSMPSCLQAQTTQPKDTTMTRTVVVEQEYNPDIMDASKVNVLPKVEEPTVSKKEVEYATTFFPATSVPAGLMRPYTGKEVQPGTTPGYVRAGYGNYGNLDILANYLFRLSQKDKLNVRFQMDGMDGKLTLPFTDGEKWNAFYYRTRANVDYTHQFNKLDLNIAGNFGLSNFNFQPESVNSKQKFTSGDFHAGIHFTDETAPLRFNAETNLLMYERQHNMFNESEANTGIKETIIRTKGDVTGAIGDQQLITIALEMNNLLYNGYTKNVSTGDEYFKNYTTLLLNPYYELDNDDWKLHIGANVDLSFGFDKSFRISPDITAQYIFSDSYIVYAKATGGKQLNDFRRLESICPYGELPEANTTATLGYVQRPYDTYEQINGSIGFKASPYPGLWFNVFGGYQNLKNDLSYLGFDPSNIHSGSYLSFAQDNTENLYLGGEISYDYKDILGISAKYTYRNWDSKTEEYLLAVKPVSEMSFNVRIHPISALNINLGYDYISRKEVKEYAKMTAINDLHIGASYNVFKGVSVYAQVHNLLNKKYQYYLGYPTEGFNFLGGLSFRF

SEQ ID NO: 331 - protein, 364 aa, Escherichia coli K12
MEFYKKQTLIIVSFCLSLLIGVGLFNYLIDPFEYFRKAKYPIDWHERVGGTLLSFEGVIKHYPYNNILIGTSISLNFSLKDIHDLLGLKDPIKLTVSGMNIGEILSLLPFAFKHQPVNTVAMDLAFFEFILNKESKYFFEYPYFTGGFVYLYNFGVLKNALFYFSTNYLKIKEKTFCKLNSWFQLYDFCNSVLNRYDFDFMFSHNNPYDYSLDNVKRSYLSALKNPNQLAIDEENAYKITKQLEDFIQKHSDKHFILWTRTDSLLKYKVYNHTILTRNLNTIHNALKTLLKYPNVEIHDLRTMPLAKEIKRYKDIRHYDPIGSKEVLQAIASKKYLLTPNNIDSFKQKLIQTIENYQIPKEIQN

SEQ ID NO: 332 - protein, 798 aa, Escherichia coli str. K-12
MALVFIIISNKVAHCQHTIEGVVTDENEVPLPDVFISILKGDELIKNLITDSIGSYKIENLKSGIYKLNFSYIGYVDSILQIDLQKNTIQNFTFKNATELAAVVITAEKSVIERKTDRLRFNVANSDLIIGSSVWETLNKTPFVATNENGSIEIAGTSGVIVYVNGRKKRLSGEVLMNYLKSLPADNLEAVEVITTPSSRFEAEGGAGIINIVTKNSKEEGLIGNASLSARQTRLFSEAGSIYLNYRKSKWNLYSTAYLSNRERLTNYEKDIFYPSSTTDLQTRFIDRKNTSKTLFSGANFGVDYEINSKHIVGMLFEYSGADENQKRDAISKDSYATSDSLTFTRNRDEATDYNYSLNLNYQGKLDENGTLLIADVDFLEFSSDNAGVSKTDVVTLDTNDILYVRDWFRNATIQDITNTSFRVDLELPINDKISVETGMKFSFSNVDNDLDFDDRDISGMTWIDDPTRSNFFEYDENINAFYALINHELSEKWSYQFGTRFENTVAKGRLEGSTVVDRNYTNFFPTAFLKYRPSNKHSFVFSVSSRITRPSFWDVNPFREYTTDKAFFEGNPFLNPSRYYRQEVSYTKGSGKVRVVAQIAASQLVGEIFSLPFKSEEGIIINRKTNYGNKYSYSGSVTMATRVQPWWRLNATSLFGHVQTTGSYADDTITIDSNTLLFSLTANQTFTISKVKGISLTVFAKNTFPFTLVNTEIGNRLETEIAIRKNIGNFSLSLSGRDLFRSNKDQYDIRVGDIRINDINYHDTRSIAFAVRYAFGKSTVKDQRYRDTGNSDIQRRL

SEQ ID NO: 333 - protein, 463 aa, Escherichia coli str. K-12
MPLLCALIVGGLFGTSQAQAGGFMVPTTNTAGWGRAMAGGSLFPNDPSAAFNNPAAMAFIDKRIAQLTVNYADIDIKYNGDAYDYQGNPMTGGYQDGPGTPELGTNDGGQAGFGAWLPTGFLVVPINDRFAFGLSQVVPMGMRSTWDPNWKGRDFAVDTKIETIGLTGSLSFKVNDNFSLGAGVIIQRTSGFVSQNLDLYASAANSPGMGGIPFPASNSSALMRVKVDNTSPGFFAGAVWKPTDRDTLGFAYHAKIRNKLKGHYNLYDHDGGLTEGAIEGGTPGLAYPGLDLRMGASASARLDIPAYASLDWVHQFNDRLSLGASATWTEWSSFQDLTLKSHGNTIVSIPYTYRNTWTLAVGGDYKVTEQWTMRAGVAYDQTPTHNATRDPRIPDGDRYFASLGAGYRFQSMPELSIDAAYSRQFVKEVPLKTVNQDRLGGGRLDGRATSKGQVFSLSATYDF

SEQ ID NO: 334 - protein, 944 aa, Escherichia coli K12
MQTWKKKLVVSQLALACTVAIASQANAKDISGTTFNTFGYDNTATTPWYYGYADWDYSGAAHDGDIYPVIKKSTVNGVISTYYLDDGANGRANALSISNSTINGMITSKCMTSTCADGMDTDGTAHAQYDRFSLTVDNSTINDTYEHYAYDVVTGETSETHYLDTYDMGNAITLDVESDIVIQNNSHVAGITLTQGYQNLDNTPYDDETGVANNSNVFTDTLVVKDSVLTSGAYSDLGKSGFYGQTAKPSDYGETNPTWADDAAPDDATPDDATPDDAALDDAALIVAAGASDNAMQTTATFDRSTITGDILFASTFDNNFYEKGDPATDTTEDGVYNPTTNGWDGTDKLDVTLTNGSKWVGAAQSSVEAIGTSDMYGQGYNNVDWKALSPNSIWPDSTFDSNGHVAGEEVYQSGLFNVTLDNGSEWDTRKVSNIDKLAVNNHSQVNVENSGLLADSITLTNASTLNVGDSGAVATDSLYLDSDSRAALTEETAELYANTITVDNGAELSLGLGQVDTHNMVLTDGGVLNVASRDYVLNSDLNNARYITNDKSKAEYDHGVVAINSDGHLAVNGDVAGNYSVRIDDATGAGSVADYKNKEIIRVYDNNAGTSASFTAANKADLGAYTYQAQQKGDTVVLQQKELTDSANMALSIPSANTNIWNLQQDTVGTRLTNSRHGLADNGGAWVSYFGGNFDGDNGDISYDQDVSGIMVGLDTQIDGNNAKWIVGGAAGFAKGDISDRTGQVDQDSQTAMIYASAKFANDVFLDSSLNYTRFNSDLSANMSNGQYVDGNTTTDAVGFGLKLGYDWKPNLSGYVTPYAAVSGLFQSGDDYQLSNDMRIDGQSYDSLRYEAGIDAGYTFNYGGEQALTPYFKLAYVYDDANNSADVNNDNIDNGVKGSAVRVGLGTQFSFTKNFSTYTDATYLGGGDVDQNWGANLGVKYTW

SEQ ID NO: 335 - protein, 807 aa, Escherichia coli str. K-12
MITIPRTNRHGPRSTAHVLMMGSAMLMAMLAAPTAARAQDQDGSTQQASGTEPDYHVDTIVVTATRRAQSLQDVGLSITAIGGEELAARGATDIESFAPSIPNLGFGATNDGVLANRSISIRGIEGLNTTGFYIDDVPLDPSVSPLVLDVERIEVLRGPQGTLYGARGLGGTVRMITKQPEFDGLSGKAHARISTVKEGDLNLSADGAINVPVGEQAAVRLSGYYDRQSGIFDRVVGPIASPGIAAASGSGLTGGSAIVRKNVDDKTTFGGMAALRIRPAADLDITARLMAQKTKLDGYPLADFAFDPDSETSPTVLKADDFTQNRLFDIAEGGTDRWVQASLGISYDAGFGTVSSSTGYFNRRTQETEDSSEFISFTLLGPILQSAGLPTEPAAVQSPIHQRLDFRTFVQELRFVSDFKGPLQLTAGLFYQDTDSREAFTPDNIAPGFDEIFSTQLNGGVAASGFTGFGDLIFRSDSRFKVKEFGAYGEASIKPVDRLTLTVGARYFDVKTRFTDFQEGFAVGSSVSVGPLRSKEHGVNLKFLAEFKASEDVNLYASAAEGFRIGGANSELPSGLGCPAQAQALGINPDDATTFQSDSLWSYEAGVKSTLGGGVATVNAAAFYIDFSNIQQRVLLECGFDFVANIGAARSKGFELETALHPVRGLTLGVNLGYTDSRFSETVPGLVTKGDRIQQVPQWTASANADYRFALDSEWEMFVRGDLAYVGSSISRVVDAANPRTRPSYTLLNTRLGLSRDRYTVTLFVDNLTNEDAVFGDNRTLAAEAYGRPRIVRNRPRTIGLDLALEF

SEQ ID NO: 336 - protein, 644 aa, Escherichia coli str. K-12
MFQLPYVPIPSFVNSPFSQYRPLANGQTVVLIQGPGLPLLSANSLTFLGNYTLVSGHIAVDPNYVTLPLALTSGNITVGDGFTATINNPLTSGSGTITKLGDGTLVLEQAVQSSLLVQRGILRGSFSVTGNLTNHATLSPGNSPGTISVQGNFQQSRAGTLDMEVASPSSYDRLQIGGKAALDGQLNVTLLNGFRPKKGEKFTILTAGSGVSGEFSKTDLPTWDLLALRVFYGGNDVFLKAVVNSFGDLPGLTPNQQAVGHSVDQILNDPRETKLVNYLYDRSLNQLPGDLDRLAPEELTSVFSIGVAYANVQAMNLQRRTEDIRNGASGFSAANLAINGDGPSYSGSFGTAGPNGDDGKDSKEPKVLYPAENRWGVFLSGTGDWVSVGDDHNARGYDLNSGGFTLGVDYKVCPNFAIGLAAGYTGTTADLVDGGRVWMNGGKLGLYATTFAGGWYADVAAFGGYNSFDTKRAALQGDARGNTDGGEVDALFGTGYDFKAHGFTFGPTATFNYTYVGMNGFTEHGSLAPLDIHSGKGESIRTAFGAKASYDWKVGGIVIKPEVRVAWQHEYGDSTYDLGSSFANGAAGSFVVQGPRLGRDSLLLGAGFAIQCSERCSTYFYYDGELGRTNYQSNAVTGGIRVAF

SEQ ID NO: 337 - protein, 536 aa, Escherichia coli str. K-12
MTSLKTVSLAATAFVTMASQAIAADNQGLLEQINQYSANSATAQVNSIFQLSDVSPSDWAFDALRNLVENYNCIVGYPDGTYRGNRPLSRYEFAAGLNACLQQIERLITSGSSEVTAEDLAALRRLVNEFEAELATLGARVDDLEGRVEFLEDHQFSTTTKLVGEVSFNVSDAFGDGIDDAQTVFQDKVRLMLVTSFTGKDRLYTRLSAGNSGPSFTGQYDTLGSGFVPRTQEGRFSYDGERDNDVTIDRLHYAFPVGDSTTVTAMAILGAHHFYADTFNTGLEAGGGSNGALSRFGERNPIYRLGIGTSTTGIGIKHDFNDVFQLSAGYLATNGSDPSEGEGLFNGTYSAMAQLAIKPSDKFKFGVNYVRGYATDSSDFAYGGTGTGWANNLNNSGMGMAINNVETNSFGGQVQWDVTDKISLRGWVGYTDAKFDEGEADIWTWAGILALPDLGKPGNMGAIIVGSEPYATNLEIGGSTPRGFTDDMPLHIEGLYKYQLSKNISITPGVIWLINPNQNEDNEDIIIGTIRTTFSF

SEQ ID NO: 338 - protein, 952 aa, Escherichia coli str. K-12
MPQIIPATRSNRKVILIQLSPFQTRIRIDGAPRLLQLHRQAQAIALKGCGEAVHMKFKHGLMATSAALAAALGAPAYAQGSPNVIEELVVTAERREQSLQDVPVAISAFTSENRDLIGITTVQDMTNFTPGLQYSSQLDRVSLRGVGRTTNVHAADPSVSVYSDGIYTTSTVEAGKTPLFLDRTEVLRGPQATLYGRNAIAGAINLISRRPTEEWYAEARATYANYNRHLVEGAVSGPTMIPGVLFRLVANWEKQTDGWYDNIVPGMPDEGNVIDTNIVEGQLKFNFNENFEGWAKLTTIVWRNGGGGPGSRGTWTPAPYATFQVANAATTNDPGYGCSGRTTNVVNRSPLGCTNPQLDDPRKIASAVPFQVKLDDTLIFASEWTWHASNFDIKYTTGGARYHYNLNRPPNDNVAPVERFTLPGGLTIFPQQLYNYQEREEWWSHELTLSSTHDGPLQWLAGVYYWNEHYEQPTSTYLFDQTQIAQPVGASCPRFGNVCPPNTLLQRTHDEPRFHIQSKAVYGQIDYSFTDTLKFTAGLRYSEDTKTGSEEARVICFAFFACTPGLYPEQLGPFTPAVDLTQTLFVPRPTPPKGISQDFTFDPATGRARREYDGKWDQVTGNVGFQWEPDADTNAYLRYSKGYKPGGFRIGVDTALTANPYTEKETLDDVEFGVKKSFGNFQANVAFFHYWYKNAQIPLTIVDTAGGIVQANSVFYNVPKAISKGVEVETIWQPVDGLQILANYSYLDSHITRARGPVDPADPAALDPDANPIGSLADCAARQANADTTDNCAADLFSLLQGGGFQLGQDLKGQKLPHAPKHKVAVNVNYTWQLPTASLTGSVSYTWRAAQYGSIFNRSYTRSPSWDQVDARLTYKPENDKYTVILFVRNLFDDVGYEGGAGASRREGYIGPATASAPGTPVTVIPVSQGISTTYPITPPRTYGIELQYRFF

SEQ ID NO: 339 - protein, 863 aa, Escherichia coli K12
MLDYHCRRPSRVSGKAIRLGLGLALLASTALSSAFTGSAAMAQQTAAIAFAIPPSSLTSALTAFGDRANLQVLYAADLARGVQSPGVSGTLAPAQALSRLLAGTGLTYRFTSANTVTIARPAESGGAALPEGGIQLDTVTVEADGVAGPFVAVDTSTGMKMDVPLREVPQSVSVVTRQQMDDRGVQTLSDAIDYSAGVSASPYGQDNRFEQFVIRGFDENLLGVYRDGMRMPTAGFAGFRQEPYGLARVDILRGPTSTLYGLNNPGGLVNLVSKLPVVGAQFGEIWASYGSFDNLQTGFDINGAGVDGSNITYRFTGLVRGADTQVDYVSNDRIYVAPTLTWTPNANTTFTVFANLQQDRTGDTYQLLPAEGTLYPSVYGKIPPSRFLGVPDWSKYDATQYSGGYFFEHRADNGWTLRQNLRYASVDVDYRTAYPIAAYGDTTTLLRTAQENNQTLGVFTIDNQAQYDSDLGFAKNQVVFGLDYSNTQQDGTQYGGTLQSLITGSSPVGPINPYFPVYDSTVAPLINTLNTSQSLSQTGLYAQDMFKLHDKWVFTFGGRYDWVQTESSTQSPVLAQLAPLLNYYYGVNVPSTFQTSANNGAFSGRVGLSYLFDNGMTPYASYSSSFNVVPGFTQSSVTVDTDYGPLPISYSMQPLKPETGEQYEVGLKYQPNNGKSYIQTSLYQLTKQNAVSFDTTDPMQQAYYQTGEVQVRGFEVEGAVDFENGFKLLAAYTYLHAEVTADIPPVGEPSIVGNTPERVPAHLASAWLDYTFQDGALKGFGLGGGVRYVGSTWGDRENTIYVPSYTLVDAAVRYAKDSWLFSLTAKNLFDNAYVGTCSSIANTYIGCSYGQTRTITAQVTYKW

SEQ ID NO: 340 - protein, 412 aa, Escherichia coli str. K-12
MKKVSVIAAAVAATLAAGSAFAVDFNGYFRAGTGISGNGNADQAVNKAGTGRLGNENDNYYEFGFAEELKTGEQTWKVESMIAQGNSGANGWEDGDFNVAQFNVQAKGLLASDQEAVMWAGKRYYQRKDIHITDFYFLNTSGTGGGIENLSVGNQKLSVALVQDGDNTNSSGYIFDARLANIGLWENASLELAMAYNFATEKDSKNEVADDGVLVSAILHQGLSNGFNQTVFQYGTAGYGAQAANFWGAGSYYARGTEAFNDASGFRLLNWGVINLGENWEMGHQLAYLAGSDIGGQFGGDGANKNTYTGKSFDIDQYSVVVRPMYKWNDTMRTVFEAGYNAGEKISNGGLATEDFGNAKFTVAQAWAMGDSFWARPELRVYGTYLLDTENDKAFGDDDTEFVVGIQVEAWW

SEQ ID NO: 341 - protein, 502 aa, Escherichia coli str. K-12
MRKIAFSCCWLTLSSLLPGIALGATPSLEKAQTETTKADSVPEVTNKTTNGKEADKGADLVVTARQTHSEQSVSHVEIQRLLPGLNPVKAIAILPGVVFTNADPWGNNEQNSSLFIHGFSKNQLGYTMDGVPLGDQDYGNYNGLSPQRAMISENTKSASLSSGAGALGTASTSNLGGTLEFLTSDPLSRAGGQISQTFGSYSTYRTFARIDTGEFGDGNKAYVSWARQDAKAWDFNGHQGGNQVNAKFIHQDDSNKLTLYFDWSKKIEPNEDGVVMPSSIYVRPSMYPDFNYAQNYLSASGATPAAAGLNYRNYYSDAQREDFLGYIKFTHDFSDNVSWDNQFYYHHNAGVGVVAGPIQAAGLPALFEAYFPGQNLKSVFGNSGYATRTTEYLDNRGGLMSTLHYKTGKHSIEVGGWYERNDNTQARNWYALDVNSPSTPYQRPKNPLIRQYKNAFYTDTFVTHLQDTWRITHNLTLQAGFKSELVYRWEITDCSPPRLSFS

SEQ ID NO: 342 - protein, 714 aa, Escherichia coli str. K-12
MLESSGYGHFGNSGEPSDYAGPGDVALSFTDSTSDYAMKNNVYFSNSTLVGDVAFTSTWNANFDPSGHDSNGDGVKDTNAGWVDDSLNVDELNITLDNGSKWVGQATFNAETISPDTMYDVATNSLTPGGTAEANGWNRIIDNKVFQSGVFNVALNNGSEWDTTGRSVVDTLTVNNASQVNVSESKLTSDTIDLTNGSSLNIGEDGYVDTDHLTINSYSTVALTESTGWGADYNLYANTITVTNGGVLDVNVDQFDTEAFRTDKLELTSGNIADNNGNVVSGVFDIHSSDYVLNADLVNDRTWDTSKSNYGYGIVAMNSDGHLTINGNGDMNNGDELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNNMKVDGQSYDSMRYELGVDAGYTFTYSEDQALTPYFKLAYVYDDSNNHNDVNGDSIDNGTEGSAVRVGLGTQFSFTKNFSAYTDANYLGGGDVDQDWSANVGVKYTW

SEQ ID NO: 343 - protein, 883 aa, Escherichia coli str. K-12
MSNPRSPRLRLVPVLCAVGLACLGQPGESAAEEVRATSSAEIQRFDIPAGELAQVLLSIVRQSRTPIAFDQHLVEGLPAPAIQGSYSVEQALQRALQGSGLEYSRSAAGVLSLQRATAPDAALPAAKPAGTLATVVVTGTRKADVKAGESLAPIDVVSAEQLRDSGSGDLRDALVRLLPSLSRQAQAYNASALTNAQSLRGLSPNHVLVLVNGKRRHETANINVSGGLQSGSTGVDLDTIPLAAIERIEVLRDGASAQYGSDAIAGVINVILKSADHGGRLAYDNGRYGDGDGLTQNGGVNGGLRFGESGFLNLSAQFREQARTIRAGIDQRTGHYGNPSIGDPSLHRQALAYNAGVALDDNVELYSFATYTHRSVSSAQIYQLPSLAPRLYPNGFTPRITSDEDDYSLTLGARGGELFGAWDWDLSSTYGADRPEIGMDHSINLALYGETGDSPRSFDLARYKATQWTNNLDLRRDFDLAWLPAPLNFSWGLEQRRELYEVEAGDPWSYYNGGSKALPGQAPATAGQWSRDVLGAYLDLSIALDERWQLETAARYEHYSDFGSTTNGKLASRYRFSPEVSARASLSSGFRAPSLAQENYTSLGVSPTIASGLLAVNSPAARLLGAEDLEPEKSISYNLGLVLDPLPDLNLAIDAYRIEIRDRIVDGATYSGQPAIDALRAGGISIPAGLTQVSTHYMTNGADTRTHGLDLTASYLTRLGEWGRIDWRLGANVNRTKLVRNHRGRNGQPLLNDQQQAWITSSTPRSQVSLQADWSYRRWGLTLRETRYSKTVSELDYYTGEHAYSTTVFNRFENSPKYITDVALRYAASRNLTLSAGANNLFDVKPDKLPAESAYLGFNQYDTYASQISFNGAFYYLGAAYTF

SEQ ID NO: 344 - protein, 853 aa, Escherichia coli str. K-12
MRNKNIHAALIPILLGAASQTALAQEPAQAQEEEVEKISIVGSRVAGRSVEDLPVPVDILSAEALANTGQTEVGRMLQAIAPSFNFSSSSISDGTDALRPATLRGLGPDQTLVLINGRRRHQASLIHINTSVGRGTAGTDMNAIPAASIKRIEVLRDGAAAQYGSDAIAGVINIVLNDADEGGKVAVSYGEYSEGDGETTNVDISKGFSLGDNGYLNTTLNFRDRGFTNRAGLHGSCQFSGCIEQANGDLLLGDPREATATRSTFRIGDADASQFGLTINSGYELGDGELYGFLTYSNRDNESAAFFRHNNNNGGNAPLQDGDATIPAGFLPKINTEIKDISYNFGYQTEFSDGSSLDFSYTYGQNNIDYVTSNTINSSFANSLRYSSSLSADEIRASIPRQASAYGLELSLQTLNLDYTQDYEYFSLAMGAEIRTDEFKVTAGDEYSYRDYDTDELGNSLFPDDRSAGTQGFGGTAPMQAVDETRDVISFYIDAETEVTEDLIVSGAVRYDDYEGFGDSTNFKLAANWSITEDIAIRGAMSTGFRAPSMQQLYTDNISTQFQTDPANPGGDQIAVQVGTFRNDSNLAKAIGIPELKEEEATNFSLGTVINITDDINLTIDWYSIDIDDRIVLSNSLGQGLSPALDAALIASGAGAGQFFLNGADTETTGIDIIATWNTELLGGDFNLTAAANFTETDVVNIYTPPDSALGGIDPSDVFSEQAVSIIEEWQPQDRISLSGLYTIGDVSINLAFNRYGEYTVTDGGTQTYGAEVLTDLRVNYQVTESLSFNIGGNNLFDVYPDENTIGNSRSGTIVDASGDVVVSSPGVFTYSRRSAPFGFNGAFYYAGAEFKF

SEQ ID NO: 345 - protein, 796 aa, Escherichia coli K12
MHMAAGRCRTATLHRTGLAGAWAMTLLARSALAVAAEAPQVTWLDRIEVTATPIPGTTIDAAQLPYMVQSASNAELSRGRSNNLSDLLQRRFVGVDGNDVQGSAFQNDLTFHGFRASALPGASQGVSVYLDGVRFNEPFADIVSWDMLPEAAITAMTLMPGSNPLFGPNTLGGAVVLSTASGLTAPGVQGELSIGSGARKRLDAGYGVAGADGWHGFVAVTGFDENGWRAASEGRLGTVFGKVGRQGEQTDWSLSLLHGRSRLIGNGLLPDTRYTDEGPEPGLYRADRRSVYTSPDLTRNRNTLLTVQLDHRFDADTALHALAYSRVGRRDTVNGDIGEDYEAFVEECASGYAADGSALDAECDVARTDADTLHTGALNTTQMRQQAQGVALNLSMQRGAHALTAGVTFDRGHVRYRQFARDGWVQPDRSVAADPDAERAFFSGVRGSTETLGMFLADTWALSNATHLTAAVRWNRVVVDNILSTADDGDRPRERFVYAKAHPSLGLTHRLDSGLTLYGSVAQNSRAPTAIELGCADPTQPCRLPTGLQADPRLEQIISRTYELGASWTPSADRNATLSVYRADNRDDILFLRAPDTQLGYFDNVGRTRYQGVDAALHLRSGDWQWWAGYSYLDATYRSGGQLLSGERVIALRPGLRIAALPRHNLKLGMAWQRDALTLGVGVRAVSGRVASGNEDGQVDNAEEGQTAPERLDIGSAGYALVDLQARWTINARVSLFARIDNVFDRHYATYAAVAEDVFPDGELARPQDAPVETGPARFLAPGVPRQYLIGLRWAL

SEQ ID NO: 346 - protein, 828 aa, Escherichia coli str. K-12
MSTNPVLTHTFSPNDFRPVLQSAHLRHAIRAVLFGTALGLATVPQLSVAADTAEVSQHYAIPAGQLTDVLNTIARQAGITLSSTPQLTDGLHSNGLQGQYTADQALRQLLNGSGLEAVSQGGRNYVLQAQRQNAALALPDTDIRSFSLGNALGSMEGYNATHSQVATKTSMPLVETSQSVSVVTRQQMDDQGSQTVAQAMRYTPGVLTNPYGATHRYDYVAMRGFNDGSVDNIYVDGLKSMGDNGTYSTMQVDPYFLERIDILKGPSSVLYGRSSPGGLVALTTKKPLFAPYHQVQATMGTQGQRGVGFDFSGPVDDDKRIAYRLTGLADASDTQFDHNKEERYAIAPAISVDFTEDTSLTLQAYLQHDPNGGYHGGNPADGMLHKRNGLRLSDHFFEGEPSIDNYERTQQSFSYQFEHRFNDVFTARQNFRYQDSDVSMDQVYSAGWADVDSNRLNRAYTGGDERLHSYIIDNMLQAEFFTGAAKHTLLLGADYQRRKADVTWRYGTVDPLDAGNPQYGNGNLQVLGENRYQRRLQQTGVYLQDLVELDQWRFSLGLRQDWVKVSEENRDSDSKVSDQRSRFTSRAGVLYLFENGIAPYISYSESFNPNTVSDQQGRPLAPTEGTQWEAGIKYQPPGSDNLFTASVFRIEQENLASKQPDEDFYRPVGEVRSQGLELEAHVQLTDSLKLLGGYTFTDIEYSKSMPSLVSGDLDNKGNSPTQAPKQMLSLWADYNFRQGALDGLRLGGGVRYVGYSWVDAENSMKVPSYTLFDASIGYDLGKLGLTGVDVRLNANNLTNESYITSCASLNYCYMGEERNVSATVSYQF

SEQ ID NO: 347 - protein, 727 aa, Escherichia coli str. K-12
MSRIHPTAPARTCSSALPLNRLTLGLLLAGSSAVANAAGTQLPTQTVSGEEPYGYRVDSASVGGFSETPLLDTPASISVINEDMILDQQARLLSDVLKNDASVGQSYAPVGYYENFEVRGFSLNAASSYKINNRTITGEQNVALENKQRVELLKGLSGLQSGVSEPGGLINYVTKRPTDIRSVTVSTDDRGSGYLATDVGGWFGSEQQFGLRANLAHEDLHSYVEHTNGQRDFASLALDWNISPDALLQLDIEYQNKQQRSAPGYQLLGGSSLPHHASPKRLLGHQSGSKPVTNESLNIGGNFEYRFNDDWKGNLSASRSKVVIDDYSSFAWGGCTTGCINANGNYFSPEGNYDIYDFRSPDDTRRNDEVQAVLNGRFDAAGLGHELSVGTSAFRRVVDRRESINQWIGTGNIQNEPENFGRYDGALNDSHKRLDSRQYGLFLSDRISFNDQWQTVLGGREVRLDEESFDKDGVRDRHTQRYVFLPQAALIYKPISELSLYTQYSKGLSLGGQAPWFASNSGDTLAPTVSRQIETGIKYDWQRMSFTAALFQMRQAYQYSRPDAAGGFTYVQQGQQKNTGLELSANGWATQRLQIAASVAAIRSRVEGTGTPAYEGRQTLNVPRLRASLQGDYALPWLDGLALLGGMQYSGSQYADRQGNVATGAYAIFNIGSRYSTRIDGYDTVFRLTVDNLFDKRYWRDTGEYMGDDYLFQGAPLTARLSASVNF

SEQ ID NO: 348 - protein, 209 aa, Escherichia coli str. K-12
MKKSILALGISATLISSVASAHQAGSWIVRAGTAHVMPTHVENTSNTATPALGLDVNTNTQLGLTGTYMVTDNIGIELLAASPFSHEITLGGQLVGKTKHLPPSLYAQYYFLNKDSKVRPYLGAGVNYTNFFDETEKMAGVTDLKLHDSWGLALNGGLDINLTEKLIFNTAVYYAKIKTKADFKVAGTQLSQDVRLDPLIFFMGVGYRF

SEQ ID NO: 349 - protein, 181 aa, Escherichia coli str. K-12
MKRLITLILVSLAIPPIYAGGAVDTPFLNSGPYVGLHGGVALPSGSDLNAGPVVGAQVGYRMGNVRIEGALSYYSNSLEANSDAKLRMTTLMANGYYDFNFNAPLVPFVGVGVGWVHAWRTNNGVLLNRGPDNNEFAYQGIAGVSFRVSPRVTLGVDYRYLGWTDGNGSQNLIEMSVNYQF

SEQ ID NO: 350 - protein, 773 aa, Escherichia coli K12
MGTISNEYNEAVSNIHVLLSGTHIGDFTDMKGNFELRNLQLQEYRVEIVGLGFQKQIKTINFSKSKTIHLHIILKESVTNIEEVTIVGKSKTTLIEETGFNIHSIDIKKYQNKSTDAVAILNKTSGVRIRSKGGVGSNNRVSLNGLSGKQIRILVDDIPMDNQGAAYNINNISVNLIDRIDVYKGVVPVHLGVDALGGAINLVTKRKNNSFVDVSYSMGSYNTHRFNVSAQYRNKNNGFTVKLNNSYTYSDNNYTMHDVQYFETKTIIADNKEQLVDREVTGNVERFHDRFKSMFTNVGIGFLNTKWTDEFFVNLAIASVDKQVQGFNNTPIGQAYGEEENKMLRMRYKKSGLLNDRLKIDLFALYNEIKQVAVDTSSRRYRWDGSYRINIVDDPRGERLVDKTFFVADQQQSLYRANLIYKLADTHQFILNHNYSNVSRQGKNTIDLNEEQAFTSPNTLEKAITGLSHASSYFDGNLKLEIGAKYYNIQTLAKQVITFTDQSREIQNLNTKQQEMGYLIASSYFVNPNLLIKASFEKGFRMPEPIEIFGDGLSTASSPTLVPETSYNTNLGAKYTLNFKNGFLKNEIHVFRRNVKNYIRLKFLGLISGYQNDPDVLINGLEYEVSYALHNFKIRSNATWQAVLNNQDYETGSIEEAVFEKEQLPNTPKFFANLNASYNFPDLIHNINTSVYYGINYVDAFYISYEKTALLTNKNEIPPQFLNNFGVTFSTKNKKHNLNLHVENMYNSTAFDNFKQQIPGSAMYVKYRFFLDM

SEQ ID NO: 351 - protein, 878 aa, Escherichia coli str. K-12
MSEGQLFKSSLLALCIANALFGMSSTAVAAEQQEATAENMEVIQVRGIRRSIEASLNTKRFADSTVDAITSEDIGKFPDKNIGDALQRISGVTVDRQYGEVSGVTIRGTAPEQSRILLNGQTVASTSWYDLGPATRTFNMELLSAEQVNAVEVHKTPTARLEEGALGGTVDLKTRKPLDLDAHTYQVAGELSQSSLYDETDPSGSFLGSWKNDDEKFGILGAYSVEKITSGRQVLESLSGYYEYFAADPAQNQESTVGAWGIGSQAFRAERERTSAQVTLQFAPTDNTEFTLDYFNFELDIPHVNHNFLTVGARGSGSTNVVNNAQGGTASATILPAYASIIYNPVVRHAVNMKSDVLNLTGKYVGDSFTVSGVIGQSTSDGGTQGGSSSWWIPATDQGGKIGDPAFPNGQGSVDGGFSYDATGPYQVVLTSLDANDASQFKHAQEANYETTVQDHKVTYAQTDFEYQLDHDFINKIAVGIKYNTSDFERNAFNRNPAEILGFVPNGNLANWSDGVLSGLHSQSGGNVLDSYAKLDEDKWWAFISEKYANGELVEVADLGNTFTVEEDMLALYAQADFSGEFYRGNFGVRYVNTDQTSTGFADGKPYNESVNYDNWLPSINVAFDLQEDLILRASASSVMARNNYSDLKPGLAIAKNFGTATGGNPNLKPYKANQADLGIEWYFTESSMLSAALFYKDIDNVVFVTESTQYIEGCGASESEWDKCRVTAPANGGSGSVTGLEIQLQHNFESGFGFLTNYTYVDSKSTRPDGTEQMIEGVSENSFNGSLFYEDDLFSARIAYNWRSEYLGVGNIQNVLNDSYQQVDASIIWHAMENLDVSLEGVNLTNEVVQSYDVKYGLTQNTIEFGSRYFVGASYKF

SEQ ID NO: 352 - protein, 1314 aa, Escherichia coli str. K-12
MIQPHHPADLTPATSKRTLEPVWRYLGYKPCIPMKTPLRTTLGLLAVMATGPGLLAQTTAAPTPAPAEEADEVIQLSPFEVRAETDRGYAATQTLAGTRIRTNLSDVGSAISVVTRDFLTDVGATDSSTLLQYTTNAEVAGTRGTYAGLGNSSQLDETANLRSSGGAPNRVRGLAAADNTRDFFVTDIPWDSYNVERIEIQRGPNSILFGLGSPAGIVNASLRNAEFRNLGSVEARVASYGSFRASVDINQELIDDVLAIRLDGVWNDQKFQQDPAYQEDERFFGAIRFDPKLFNRRDFRTSIRAKFENGDIKANRPRIIPPNDAISPWFRARDPNSMFGGMAKLAVDNGYDSWRTDNIVVGSARGLIPTTSPNYQPWLAVPPNQQQPFWLLDGTTNQLYRVEGGWINVGARNNTGGFTGASNGLLGKRTGDQFYGLNNLPAMVSAAHSANAALFPDAIYGQYKNMSMLDPSIFNFYDTLLDGPTKWETENWNAYNIDFSQTMFDDRLGVQLSYDRQKYRRAGEALLGGSPTITMDIMKNFLDYYVSGANGTTTTNPNFGRPYVQGAGGGGTGSSYESERKYARASLFAELRASDVLDNKFLVKLLGRHRFNGVYADERYETENRGWQMYANSREWAGYWNGTDGSNSPITDRPPQAFIYLGSSVAGRDSATGAQVPGITADVKLNNAGVHVFDPTWLNFGIPFTNAAAGTTIPNWNVPANLWRVFNGQPIPASDLPQPNTVPQLTEASNPANYVGWTYFQDDLMRYNNGADDALLTNAQKSLRVTKSYAASWQGFFWNDAIVPTFGWRYDEVKGKGVSAPRVSGNRNILNVQPNTYMLPNAYPTNQIFKDHSTAGGVVVHLNRLLERDFLPINVSLSYNKSSNFQVTDVRRNVWGQPIANPTGSTKDYGVLLSTKDNRFTFRAVKYETSVAGATTDMGNPGSVGAIVQQGMRWRNVFLYKLSAYDWANRNNWATRNTWSGQTVNPQNPAVTIGADASLTPEQGRALEDAAITKWNEAQTWMTERGFFDAWGFQPQSVGVLTDRTTYENAAGGPTALDPASQYAPNPASIFAYTATAPQGFAVTSDTLSKGYEFEFTANPLPNWRISFNASKTTATRSNVGGPELDEYVNYIDELMAAPIGSFNGTNYILGNMPQFGNPGLSLLTNVWNNWRGNYAQLKLNENSDSAEVRKWRYNFVTNYTFREGKLRGLGVGGSYRWQDKVIIGYPVVATDPTRPNFDFSKPYYGPSEDAIDLWVSYERKLTNKINWRIQLNVYNVGNNEELIPISVQPDGKTWASVRIAPVQEWTVTNTFSF

SEQ ID NO: 353 - protein, 348 aa, Escherichia coli str. K-12
MNKSMIALAVLAGFAGVASAQSSVTLSGSIDAGVRRIDGVNDMAGAGSSRNNLTFSGVEDLGGGNSAFFTLNHRFNVQSGTQNGQNSVVSTTAAGLPNAADPAAQFYRNVWVGLKNNAIGDLRLGRFLYPVQELNGNYDAFGTDTVGSTHTGGLKANLRTNSSAYLRSANFAGFQLHLATGFKNNGQTNQVVAATPPATGFVTVANTKAPVGAAAVFATGPMSVALAYDSNGAELTTKALYGSYDLGVAKLMAQYEKTDVNVAQTASDKRYSFSATIPVGALSKAKVGYLHIDDTTKAGTQSKFGAGFDFGLSKRTTVYTDVAKLRGDEGLTTNNKKVRFDIGVNHKF

SEQ ID NO: 354 - protein, 441 aa, Escherichia coli str. K-12
MTGGTIRALGLAGAVAAVSMAGAGGAQAGAFGLREQSAQGLGVAFAGAASGGAGVSSIFWNPATVTMRPGFASEQSLSFINLSGEITPTVGTAPGLLPFGASGEVGQGAVVPSGATSYQLTDRLWVGIQTGAPYGLVTKPRQDWAGAVYARSSRIFSLAFNPVVGFKVNDWLSVAAGPSIEYFRLTLRAAVPVAGTFPGLYPSGFIKGESWGVGFTAGVLITPAAGTAIGVGYRSSVHHDIAGSIGFPDPRQAIALGQVRANLNTPEKVSVGLTQAINPVTRINLGFEWDNWSRLGDVGIVSRALGVTVNHLPLNFKDSFFYSIGAEYDWSPNLTLRAGFGYDNVPIDFSNRSARLPDSDRYVVSIGGSYRWSEKVLLTASYAHAFFDRGLLLAGPGRDYNIGNIPLAASTDVSADVVSVGFRYQWDAPAAVAPAPLVRKF

SEQ ID NO: 355 - protein, 242 aa, Escherichia coli str. K-12
MSDLKDELSPMLKIKYFVILSLPLSCSVLSETLWSDFSATYLKGNNYEVGDNNRQVLTLEYASGTSWGDIFTFVDRLDSSNGDLETYLEFSPRFNLTQLSNDSLLKDVLLATTVEIGEASTNYLYGIGTNLSIPHFQFFQLNFYYRNNELQSNNWQLTPAWSVPFSLGNSQWRYNGFIDWVSSTDTSASGYNFTSQLAWNAGEYFQLKDALYLGVEYVYWHNKFGIAGIDERNANILVKWHF

SEQ ID NO: 356 - protein, 456 aa, Escherichia coli str. K-12
MSKFTITIFITTLLFTGSVIALDLEQALTEGYKNNEELKAAQIKFLNAIEQFPQAFSGFMPNVGLQINRQNSKTKYNKKYVNRLGITPRETASTQGILTIEQSLFNGGASIAALKAAQSGFRASRSEYYAGEQKVLLNLITAYLDCVESKEKYDISESRVRTNIQQVKTVEEKLRLGEATAIDIAAARAGLAAAETNKLAAYADFQGKKANFIKVFGIEANDITMPDLPDRLPISLDEFTRKAAKFNPDINSARHNVTVTKALEMVQKGKLLPQVSVKLLSGGTNYNPQEPVIQNINNRIYTTTLSVNIPIYPEGGAQYSRIRSAKNQTRNSVVQLDSAIKQIKAGVVSVWEGFETAKSRIVAANQGVEAAQISYNGIVQEEIVGSKTILDVLDAEQKLYEAKITRVDAYKNSVLASYQMKLLTGELTAKSLKLKVKYFSPEEEFNNLKKKMFIGF

SEQ ID NO: 357 - protein, 432 aa, Escherichia coli str. K-12
MGQVHHGSATTTAAVRRAIQHSQESLRVLAKRYGINPKTVAKWKGRTDTSDRRTGPKVASSTILSTEEEAIVVAFRRHTLLPLDDCLYALQATIPHLTRSSLHRCFQRHGISRLPETEGDKPKRSKFKSYPIGYFHIDIAEVRTEMGRLYLLVAIDRTSKFAFVQLHEKATRRVAGDFLRALAAAVPYRIHTVLTDNGTHFTDPAGNGWTPEDIKAMRADGVLFRCHSFELACADLDIEHRLTKPRHPWTNGQVERMNRTIKDATVKRFYYETHDQLRQHLADFVTAYNFARRLKTLRGLTPYEFICQQWEKEPSRFIHNPHHQIPGQNTYSTFGARFAGTVRVGGVALTPNATLGYRHAFGLTTPTTREAFLAGGNAFDVAGVPLSTDAAVLKAGLQAKLTDRLNVGLSYVGQYGDHSTDSGLTGNVKVTF

SEQ ID NO: 358 - protein, 115 aa, Escherichia coli str. K-12
MLPSIHYEADSATDFTGLPVQGSKNGKITKTTVAPHIYGAYKVNDNLTVGLGVYVPFGSATEYEKDSVLRHNINKLGLTSIAVEPVAAWKLNERHSFGAGIIAQHNSAELRKYAD

SEQ ID NO: 359 - protein, 715 aa, Escherichia coli K12
MILARGLSGRGALLSSVAIVAMTVGADAQDRDKDRGEVYQLGEIYVSGGGRGGSGGGGVGGSTVNREQMWTFEKQTLDQAVNLVPGVSSTQSSAGQRNETDIFVRGFGRWQVPLMIDGVRVYLPADNRLDFSRFLTGDIAEIQIQKGYASVLDGPGGMGGAINLVSLKPVKPFESELRGGATFDNRGAFQGWNSYARIGSRQENFYVQGSVNQLDQNFWSLSRGYSPYPAQGPYAGSLEDGGRRNGSDTQDWRINLKAGYTPNATDEYSINYIKQSGAKGAPLNVYNNPPSSQNSFWRWPAWDVENLSFLSNTQLGDASYVRTKLYHNKFYNVLSAYDDITYSSQSNNGRFNSFYDDSARGGSVEAGTELIPMNTLKAAFFYRQDFHAEWNHNRPTHPTLDMLEPRQNQAQTTWSIAVEDTLHVTPNFDLVGGVSYDKYSIDRAEEYNSGGGFIYEYPKGGADALNWQTAAIWRYSETGQLHFSVSDRARFPTIFELYSQRFGTAIPNPNLGPERATNYELGWKGQIVSNLRGTAAIFYSDVRDLIQAVRVSPTQSQTQNVNQGHFYGFEASLEAQLSAQFMIGGNYTFIERNVSDVSIPEFRPVGVPTQKAFIYATWRPIEPLAITPSLEVASDRWSDVFVGTQGPNAPIRAAFPDLYIRTGAYTLANINVNYKVTANVEVAGGVRNLLDQNYELAWGLPQPGRTFYVKARATF

SEQ ID NO: 360 - protein, 208 aa, Escherichia coli str. K-12
MNYIDLRYQFTPSLKGEYYFGNLEDLYNKHYVGLEHTWKQPTFALTSKFKYFNAKDDGNTFDIDAQNIGLLETVKVKNHTFGLGYQQIIGESAYPLPDGFLPETYFINWNATGFFKEDEKSYHVMYGYDFKDYVPGLNAMVKYVYGHDFKAANGEKNHETESNVILNYAFQQPFLKGVALQYIRIDYNVKHGNDFGEDRLFVNYTKKF

SEQ ID NO: 361 - protein, 942 aa, Escherichia coli K12
MLQDTGLVAHRDVSGAILLQPARPKAPARAQPPQAANSLPPAPVALEPVQVTGSRIARAQVEGSAPLAVITAEQIQAGAFATVPDVLRAMTQNIGQTQSEQSFGSADYSPGSQQVNLRGLGPNHTLVLVNGRRIADFPMPFQGRSNFADVSNLPLGLVDRIEILTGSGSAVYGSDAVAGVVNILLKQRADGTTVDARVGQTDRGDAQSSQLAISSGYSHGAFDGVFGLAAVSQQPLWAYERTRQDSTRDAPAERAAAPRRTFLRTDASGTYLDPGEAACAPLAELNGGSTGYSARAGQGALDPATGQRGPGHYCGSSTSIGYGTVVNRRRGFNAHASMRYTFGDSLQWFADLQLGVHAVSLLRDVPGWSYMAADGNEQGEFYNRATGQVEYWSRQFTPEEMGGLNRNMIETRQKTLGITTGFKGAFGEAWSYETALSHAQYRARISWPRIVAARANALFLGQPAGTDPDSGHAAFDADPARLYTPLRRAEYDAIAARTEYAPRSRTDTLSATLTNAQWWSLPGGQAALSMTAEVGGQSYDLRPDPLATQYYYYSWRDADGSGDRDRWAIASELRLPVAERVNLGMAARFDQYRYAGRRTGRFTWNAGWEWRPRDSQLLRGSYGPGFRAPDLHYLFAGEGNDEATGVDYYRCATQDGQASIAACRFNDEALVRRRRGNRALRPETSTAWTAGVVWSPRQGLDLSADYYAIDMRDQVQDLSVDRVLRDEADCRLEQRDADSIACREAMGRVERRADGALSAVSVAPINIARETTSGVDAALHYETQTRWGAFDLLINYTWVHRHRIQRDDGAALESAFAVNSGYDAPRTKANAALRWSRNAWSASLQGQRLGRLPSADSYLEIQAPDSETGPWIAATYRFNGTLQYRVTDRAQVSLAVTNLLDAMPPVDRSATIYPYYDASWFDTTGRRFALQYTHKFGGAPGH

SEQ ID NO: 362 - protein, 831 aa, Escherichia coli str. K-12
MSQMWRFGVIFRCGRASVGNMEEKYRLDIACPRAVLRAFLEMIDMPANVAGEGIRTSSQPEGVRAALMGSLHLTVGMASVMVAGPALAQQAAAPSTEVDLPTVQVQGDGTSFSSNSTGVTRLPVPIFDMPQTVNVITEEVMREQNTVTLEQALRNVSGITFSAGEGGQQGDNPIIRGFSARGDIYRDGIRDPGWYTRDMFDIEQVDVFLGPSSFAFGRGSTGGAINMVSKLPKNATFVNADVSAYTSQGWRTTLDANGKYNDNIYARINLMAQDIDTADRDNVNATRWGVAPSITAKLNDKTTATLSYYYQHEESVPDYGVPYYPAPVVSTALGTFGQPQGGYFGNGAATPPVNVPRNTWYGVTNGPYKDQVTTDTNMVTLQLQYELNDYVTLTNGTRYTANDRLARVTAPRALGTSGNVSFASPLPASQYYYPTSAMTIGMQRFQTETDNTQFTNITDMVAKFKWGQFEHTLNAGIEVTSEGRYQQRYNLCNQTVVACRVSLINPLDVSANFGLGGYTNYLPTSTVTTDMTDVGFYAADQIKINQYWQIMGGFRLDAASTNYNSFAITTSGSSITGTQTTLQNSETMFNYKVGTIFTPIEPLNLYVTYGTSSNPSSEYGVLDSGTATLAPESNTTAEAGFKAMLLNNQLTVTGAIFQTMKTNTRVATDTAAGLPPTVLGGEQRVQGYTLGATGNLTKDWNITASFTHLDSEIMSVGPAPTVANLQTLGKQLPNTPPNSFSFWTSYNVTKELLVGFGGTYNDNTFANATNTVYVPSYWAFDAMASYQISKNFQVQLNVYNLTDELYYAQYYGGQAVPAAGRTGTLTARATF

SEQ ID NO: 363 - protein, 595 aa, Escherichia coli str. K-12
MEQILKFFLYFYILFSKFIYEVRNIYIYDLQKIVLIQFFYCKKYTTIFYKTFIIVFICSCVYIFIIYKYTFATDSTYSNNTYESQDEILSEMSMQLELSALEYVEQQYIQQQEQELIQQQLLQQLMSLYGQLGDLENQAMSLKVQQQQLSEQYRTLLHIPIVEQSAETIEQALSITHQQEQLEEQVNSTQSQIEVLQEQILQTLYQLGMIAPPGGNAGQEEDGFNIQGPGGAGGIATFTHGYGYLDQFRSLQGLQYVLFDTSSHVSHALRDIVSKIQMSSNFSKVNTIYLPQDLRRHKKFHRNTKVVEKKEKLHYFLYPITFSCNLFTSLEEYNIYLDKQHSTQVGIVVNPIPNVTMGFSYNYKDLSNKYKIVETDTSINKVNTKSNITKFLATVAWNTDGQGFTGFFSSCYGWGHIKTIRSFNPSGTSFKGNSEATIYGALVRLGYNVRIVEDILLTPYVEGVMSIVERKPYEEQRGYLLSKINNNKEVQLERGIGITSFWKCTYNSALQTWLGFGLNTCKINKLTSRLSYGPFYLCSLSVPSVRKTSFWKEIGMSYDIQLSDRTHINISGNHRLEADKQPGNSSIRMHLQYNF

SEQ ID NO: 364 - protein, 137 aa, Escherichia coli str. K-12
MSDMNNPADDNNGAMDDLWAEALSEQKSTSSKSAAETVFQQFGGGDVSGTLQDIDLIMDIPVKLTVELGRTRMTIKELLRLTQGSVVALDGLAGEPLDILINGYLIAQGEVVVVADKYGVRITDIITPSERMRRLSR

SEQ ID NO: 365 - protein, 368 aa, Escherichia coli str. K-12
MKAPCQFIVSASLLATCAGVSAQSSVTVYGLMDLAIERVTNLGPLHGQVTRMPSLTGSLPSRLGFRATEDLGGGLSAGFTLEMGIAPDSGALNQGGRSFGRQSFVSVGGPWGTVGMGRQYTALYWSLLGSDVMGPSLHTFANLDSYIPNTRTDNSISYRGNFFDGLSVGATYSLGRDVVNAGPSPAGTNCPGESATDQRACRGWSAYAKHDKPTWGVAIAIDAIRGGPGAFGGFILSAMKDTRSTLNGHLKFGEMKIGGGLIRRNNDASVATPRSDLWFIGLSYPLTPVLILDAQYSQLKFDRSANKATHPVARMTYFLSKRTAVYASVGHITNRGSLALAVSAAQPGSAPVAGGSQNGVGFGLRHSF

SEQ ID NO: 366 - protein, 986 aa, Escherichia coli str. K-12
MAVMNNLTFKKTHLASTLALLMGTSWIGVSQAEETQQVEPQKDVEVIEVSGVRGSLIKSMDLKRATFGVMDAISAEEMGKFPDTNLAESLQRITGVSVSRTNGEGSQITVRGFGPSFNLITLNGRQMPGTGNSRSYNLENLSSEGVSTLEVYKTARAEMPTGGLGATVNIVTLKPLNKPGQHYSVSAKGINDTSNEKGSDITPELAAVYSNTFADDRFGVSVSLSHQERDFQRQEANIQGWQANVDLPDLAESKVIDPRGVDADGKRIGNHFFPKDMNYSINDVQRERTNAQVTFQYKPIDGLVATLDFTGSKAITGQETTGWGIWNEFGGNINAYELDENGTALFADIGGNDGSFTASKNTTEVEARSVGFNLDWEINSIWKVAVDYHDSSNKTDNGADKGLGSDGQVILGSDQLISKIYDYRSGEVPHAMINWRNGTNILSPGEIDSNFSQFIHSPGESDIQQLQVDARWYNEIIDIPLVSVKFGGSRTEQTMGGLSAWSGLRGGPGFNPAYPQIFPDGMFELHNTNNLLDQFTGGGSSLNPNYYYSFDFDEAVARQLAFLTQDVMGSDVYSINPYFDGIDSQSSVTENTTAVYIQTEWDFKVADYQVQVNAGLRYEETDVTSTVRQRVERQVNWESASEWIMQYEQGGTDNFLTQEGKHDVLLPMIDVKVDVTDDVVARASWGKTISRAPLGDLAGGRSLTGSPKPGSRIGSQGNTNLLPFESTNLDFTVEYYYGEGSYAAIGYFKKDVDNFIQTSITQTSIDGLNDIFNGPRYLQAIADIEARGDQATSTAIFDQMLANGNGNAEGKIEPNSNDPLIVWNISQPTNTDSKSVDGIEMAVQHLFGESGFGLGINATFVDGDVKFDVNSLVQQAPLTGLSDSANFQAFYEKDGLSVKLTYAWRDEYLIGVGQAQGSADAPPQFAKSFGQWDMSVNYDVNENLTVFFEGVNLNNETEQGYGRYEEQFLFARQYGPRYAIGARYNF

SEQ ID NO: 367 - protein, 136 aa, Escherichia coli str. K-12
MLYLNGFNTDLLINWKNDKLSSGRNSNDLRRLSQTQGGGAILEDLQRYPNPFSAMIGAKVFQNRNVHLFRKSLGLVVGMDIGASAWFQNSNFNLFDQVNNRTIFQLSGKYQENLASVGILKNTALIKMVVNPSWRQ

SEQ ID NO: 368 - protein, 1247 aa, Escherichia coli str. K-12
MNTRNRRRIVTLAALITHGLIAQTVTPSNTPAAGANTPEEDLVVLSPFEVRAETDRGYAATETLAGTRIRTELKDVGSAISVITKELLGDIGATDNGTLLQYTTNAEVGLTRGTYAGLENAGTVNEGTTLVSRNSANRVRGLSAADNTRDFFVTDIPWDSYNVDRIDIQRGPNAMLFGLGKPAGIINAAMRNADFKNSAQVAARYGSYGSWRASLDVNQELVDNVLAVRFATVKDDEKFQQEPAYEDDERYYGTIRFEPKQGPGSRMSLKLKYEHGEIDANRPRTVTPMDAVSVWFKPLPTTRRTNGQYNWTINDGMGKKLFDNPYDVFATELSSGNAEYIPWLNGGPLNAQQPFWLIDGASATVYNIRAGIINNGARRTDGTTLGTSDTFPGKRYATPFLGINTLNGATAVNLNLPNANYGQYRANSMLDPSIFDFYGQLIDGDTKHEFERWDSFNFDLSQTVLDDRLGLQLSYDSQNYTRGGESFLGWQPTIQMDVLQRWDDLGANPNVGRPYVVSGGGGTGNSYQSEREYYRGSLFGELRASDFLDERGFWAKLLGTHRLNAVYSDEKYVVENRTWQRKAFDTDWAGYWTMTNGLTTPIDDRNPVGIIYLGDSIANLSSAAGANIPRITGRPDLTDGNVYLFDTIWTAPASVALNAPWTVPADLAPMFSTTLPTHPSPTPAGYYQNSNPSNYKGWNKDQMLNLWSYDGGEDMRLLTRRQFADRQTKSQVVSWQSFWWDGALVGTLGWRKDEIQSLYWGHTQNGANRKILSDSPTYTPLRNESAETTSGGVVLHVNKLFRNDRWLPVNVSLSYNTSKNFDVTGIRNDLYGRQIPNPTGETKDYGVLISTKDGKYSLRVIKYEATVKGDNAGLDSGFGGVISNGLNWRNVFLYDLAAYDWSGRESPSYRNNWANAFPETGTGPWGVVNGSAEEAAVEDEAIAQWNQIQTWLTEKGFFQAWGFTPVPTANLTTRSTYAASLNGGRDPAAQYVPPSGTLYSYTATAPQNFAVTADTLSKGYEFELVANPTSNWRIAFNASKTEAFKNNVGGAAMQEFVDYMDSMLIDDEGTAHGPGRTSNGYTAAGNLPRWGGAGSAIGPSVWAPWKANYNRLKLNEGAAVPELRKWRFNVMTNYTFREGFLKGVGVGGSYRWQDKVAIGYPLIPNGPYYGFDIANPIFGPAEDAVDLWTSYERKLTNRINWKIQLNVRNAFADNGLIPISVQPDNTTWASVRVKPVQEWFVTNTFTF

SEQ ID NO: 369 - protein, 688 aa, Escherichia coli str. K-12
MKRHYLPPLLLLSQLPLIAIAKQNDAQPIERITTTASRVEALSTQLPVIISVLNEAQLNAIAPTHIEEAMQRVAGANIQRGNGQEYLPALRSPVLSGAGACGGLLTLEDGIALRAAGFCNINELFEAHSEMAQRIEVLKGPGSALYGSNAVHGVINVITPDTTQDGGLIGLDYGSFGYNRYKLRAGHDMGSSGLGINASITDDSGYRDDESVKQQKVNLRHRYNNSDLALTSGLTYTHLDQQTAGFITGLKSYKDESIAQQNFDPDAFRKARSLRVWSNATWQLNDDTLSTTVYLRNQSMDFFKHFLPGTPLEYNSQTGVGLQSLYQHQLEDNIKLNVGLDGEYTRADFLQSQNKPTQGSAFLVATVPQGKHYDYDVNATLYAPFASVDLQLNDWLVTLGARYEHMQYDYTNNMLAGRTKEDGTECGFGGCRYSRPASTKNNFSNLSPKLGVSYQYTVNNLLYANFSRGYRAPQAAELYQLQRQQNTTNLSAEIANNAEFGLKGVYQNSRYNLSVYAMSKHHTIYRDSDFFTVNNGSSRHRGIELELEHALTSTWSVNFAASYAKHSYTNEQILNNINIKDNDVDTAPRKIANLDLTWQAFNNANVALQWHHVGRYYTDPENLHSYDGHDILSLRAQWQITNNLALAARIINLTDTAYAERADYTSFTGDRYFPGRPRNAMISATYSW

SEQ ID NO: 370 - protein, 1063 aa, Escherichia coli str. K-12
MIVIMKSRILLFLGLLSCIGLQMFAQVSVSGKVVDAGGIEMPGVNIAIKGTMVGTMTGADGTFTLSSIPGGKDAVLVFSFIGFRSQEVKVGNQTFINVKLEEDTEQLEEVVVIGYGTARKKDLSGAISNVQMTDELAALPNPNVMGSLSSKVAGFRYSPTNSAGGDNFSSLNIRGKNAIPADVSAGQQSVNQPLLIVDGVISFGSINEINTNDIQSVDVLKDASAAAIYGSRAANGVIIITTKRGLSERPVINVNSSWNFSGWSRMPKMVTDEEKFFRNRFYAKQAGGSIPSDAVWSSDFDRAQLMNTVEYDAYNEGVYTDWLDEISRTGFGQKYDVSVSGRSKIVNYYISGDYTRQKGIRKGDDYEKYNIMTKLDIQAKEWLKIGLKGNYLGAKEWGVPARIQNATWMTPYSYTHARQPGYENWPNSRPDGNSASPFWGSGAGDSHLWTDDQKRNYNINGVAYAQVDFPFLQGLSYRISLNARRNSAMRDVFNDPRIWVNTDNTADMDNPDKFGVNVEGYSYTQLSSTWNVDNIFTYTRDFKNHHVDAMIGYTREASNSELLRTDFKGFSVPTTLGVYKQDLANTRTIRRERTSSSAIGILTRVNYNYKSTYYANFTFRRDGYSAFSAGNKWGNFYGASAAWVLSNENFVKDNADWLDYLKLRFSWGQNGSRSVSPYATIGSVGTTYTWFGDSASGSAFGLVPSSLPNRSLTWATVEKFNVGIDYNVLAGRLGGAVDVYAGKTTDMLMDRSVPYPTGFQTAKANAGKVTNKGIEITLNSVNIDGDGKEKFRWETNVVFDLNRNEIKSLYGKNYKGEEADDVANAVAYGFDSYYALIIGKPIGAAYDLKKVGVFQSQEEVDNYVDKDGNKIMPNAVPGDLKFEDFNEDGKIDANDRQYLGSMDPLFTINLGNTLSYKNFSLYFNFRWMQGNDTHFLGYNPHAYSIGGSGAQLDAVDPWTPTNHTNDYPRYGYNNSLNYQYWSPRSFLKLKDLVFSYNFDQKLIKPYGIEGLRLYVSGTDLFTITGWTGLDPEDGGTIAGGPTSSSMGSKGTYRTFTAGINLTF

SEQ ID NO: 371 - protein, 467 aa, Escherichia coli str. K-12
MVTHGAKRKTLALAVAGALLGTGFMAAPEAKAEGFVDDSSLTGGIYYWQRQRDRKDLTPGSAEYGKYVANLHHSTFNANLDFSSGYAADMFGIDLAAFGAVEMTNSGPAAPNEIGFSDAKTRWDEKWTGDKSGVSIYKAAAKFKLGDFWARGGYIQPTGQTLLAPHWSFMPGTYRGAEGGAKFDFDTAGALSMSYMWTDEYKAPWYQNMYNFRQADGKTGISYLHSIGAKYDFKNKLVLEAAFGQAKDYMDQYFAKASYAFPVAGNDLRTSYQFYGAKDKVDGGFKDVNDVYDGLAWLQALTLGYTTGPFDLRLEGTWAKADGNQGYFLQRMTPGYATSNGRLDVWWDSRSDFNANGEKALFGGVMYDLKNWNLAGWSVGTSYAYGWDAKPSTNPIYDQNTRLKESAWNFDILYTLQEGRAKGTLFKLHYTMYDNHTNIPSYGGGFGNVFQDEKDVKFIVIAPFTIF

SEQ ID NO: 372 - protein, 336 aa, Escherichia coli str. K-12
MQKPSRLLLATLALLGTSAVFAQSSVTLYGRVNTSVERQKVGGTSNTVMQNNASRFGFKGTEDLGGGLKAGFQLESGFNSDTGTGSGWTHPTTGMSFARQSEVNLSGGFGMIRLGNFMPESYYATADYVSMHNHDTGTSSDALYYDPVWFGGLSTTNKIGYRTPSFGGLTVDASVSLHEKNAAIPQKNGYDLAANYNIGALNLGAGYSQVDSNRQLGLRALYTFGQFVVGGYYQRNKDDNQLLATGAGNRNNFRLAGAYMMGASEFHVNVGRAGKWSDIADSSATQWTLGYNYNFSKRTKVYAFYTKVDNKAGATYMTGAAGQDFSSLALGVRHNF

SEQ ID NO: 373 - protein, 730 aa, Escherichia coli str. K-12
MFRPHPLALAASLALLGTQAGAAPAGTDAPSLPTVTVGASADASAQGLSPAYPGGQVARGGRAGILGTKDAMDTPFSITSYTNELIQDKQAKSVGEVLQNDSGVRLARGFGNFQEAYFIRGFVLGSDDTAYNGLYSLLPRQYIATELFERVEVLRGASTFLSGATPSGGGIGGAVNLLPKRAPNEPLSRVTVGTGSGGRIETAVDIGRRFGPDGSTGIRFNAAYQDGDTAVDHEKSRLGLMALGLDWRSRDVRLSGDIGWQDHRLKGTRPNVSLSGATAVPAAPDAAANFSQPWAYSNERDVFGTFRGEVDLSPGMTAWGAWGMRRGKEANSLANLTVADAATGAGTAYRFDNTRKDRVDTGELGLRGKLRTGAVGHEWVAAVSYFEAEKDNAYAMDWRNTIASNLYQYRPTAQPAFSAATLYGGTLSSPNLTGRTRLLSYALGDTLSFVDDTVLLTLGLRHQRLDTSDFAYGTSALLARYEQSRNSPMAGLVFKMAPRWSLYGNYIESLSQGQTAPATANGAPVANSGQQLAPYVAKQKEVGVKYDGGRLRGSLALFSTTKPRAYVDASNVFGASGRDRHQGVELDVQGEAMRGLRLLGGVTWLDAKQQRTGSAATDGRRVIGVPRLQANAGVEWDVPGMPGLALDTRAVYTGASYADGANALRVPGWTRLDLGVRYATEWSGRLVTLRARVDNVADRNYWASSGGYPGSGYLVVGAPRTFTLSASVDF

SEQ ID NO: 374 - protein, 394 aa, Escherichia coli str. K-12
MMKDVVIVGALRTPIGCFRGALAGHSAVELGSLVVKALIERTGVPAYAVDEVILGQVLTAGAGQNPARQSAIKGGLPNSVSAITINDVCGSGLKALHLATQAIQCGEADIVIAGGQENMSRAPHVLTDSRTGAQLGNSQLVDSLVHDGLWDAFNDYHIGVTAENLAREYGISRQLQDAYALSSQQKARAAIDAGRFKDEIVPVMTQSNGQTLVVDTDEQPRTDASAEGLARLNPSFDSLGSVTAGNASSINDGAAAVMMMSEAKARALNLPVLARIRAFASVGVDPALMGIAPVYATRRCLERVGWQLAEVDLIEANEAFAAQALSVGKMLEWDERRVNVNGGAIALGHPIGASGCRILVSLVHEMVKRNARKGLATLCIGGGQGVALTIERDE

SEQ ID NO: 375 - protein, 806 aa, Escherichia coli str. K-12
MQLRILISIFLLVLNFHAFGQYSISGTIDSAIDQLPIANAEVYNITLSTSVKTNENGEYIFQNLPAGTYTIAAFAFAFDVFEVSKEIDTNTRLNFELQPLGESLSEVVITKRKERIFALKQLRDVEGTAIYAGKKSEVVVVDNLTVNLASGNARQIYAQVMGLNIYENNDAGLQLNIGARGLNPNRTANFNTRQNGYDISADVLGYPESYYTPPAEALEEIQIVRGAASLQYGTQFGGLINFKLKQPNPNKKIEWISRQSVGSYDLFTSFNSVSGTVGKFSYYAFGNYKNGNDFRPNSQFESFTGFAHLGYQFSEKTKAVFEFSSLNYLAQQPGGLTDAQFEEDPSFSNRTRNWFEVDWKLYALKLTHDFSTKTRASLNIFALDASRESVGFRENRVSQVDDLEAPRELIVGAFKNWGAEGRFLTEYSLFDMQTTALLGAKFYQSNNVSQQGPGTTNSDADFNFALDEFPDYERQNQFTFPNTNIALFGEQIFNIAEGFKVTPGARFEYINTNAEGFYKNINLDNAGNPILNETIEENRNFERNFLLLGLGISYDASRSMEFYGNVSQNYRSVTFDDIRVDNPSLIIDENIRDENGYTFDIGTRGTFRRLVRYDIGAFLLSYTDRLGVVGQGLDLFRSNIGDAVSYGIESFVDWNINETFFKKEDYKFNLFSNLSITESEYIRSDFNNVTGNKVEFIPLVNFKTGMSFGYKNFLGSIQYTYLSSQFTDASNAERDFTLPSGIVGEIPAYGILDASFQYTYNQFTLETGVNNVLNNSYFTRRATGYPGPGIIPSQPRTFYALLEFRL

SEQ ID NO: 376 - protein, 710 aa, Escherichia coli str. K-12
MEIVMSRFSAVPRPASAPASFALNESRVRFRHATAVLCGVLLSPLVHADEHAGHADELSPTVITAIAPSSPLTIVTNPKDPRQPVPASDGGDYLKTIPGFALVRNGGTNGDPVLRGMFGSRLNILTNGSMMLGACPGRMDAPTSYISPETYDKLTVIKGPQTVLYGPGASAGTILFDREPESFGELGTRVNASVLAGSHGRFDKVVDAAAGGSLGYVRVIGNTAHSDDYRDGNNDIVASRYDKWNGDVALGWTPDADTLIELTAGKGDGEARYAGRGMDGSQFLRESLGLRVEKSNITDVLEKLEAQIYYNYADHVMDNYTLRTPSGTGMMAGPMASNVDRRTLGARIKATWRWADIQLITGLDAQTNEHRQRSGMGIDTYKDQPYTKDADFHNYGVFSEMTWYAADRDRLITGARVDRASARDFRQTTGSGMMSRPNPTAGDTRADTLPSGFVRYEHDLADSPTTLYAGLGHAQRFPDYWELFSPKSGPAGSVNAFDSIKPEKTTQLDFGVNYKDANLEAWASGYIGVVRDYILFDYTPTMMGMSTSRAENIDARIMGGELGAAYKLTDNWKADATLAYAWGKNSSDGKALPQMPPLDARFGLTYSEDNWSAGALWRVVAAQNRIDQNKGNVVGKDYDKSSGFGVFSLNGAYRINKHWKVSTGVDNLFGKAYAEHLNLAGNAGFGYPANDPQAINEPGRTLWTKVDMSF

SEQ ID NO: 377 - protein, 1502 aa, Escherichia coli str. K-12
MAKNINSKLIKLFLLSCANAAIMTAMAGEARADIEIHDILNHTPEYEALAPAQKLNIIKGIQAREDFGDLFDDLMPGERRLFNNEIIEVKKLQAVAPVLNGARERREARAAGVEVVDLIGNTAVETGRNEQEMALENRLQVLEILAKTEGTNAVSVNDKIKKAIHFNNIENLNTPLEQLKYITMAGGVDANDNLKVVNNYVEAPLTKEAFEHIYFSTNITDPTVRSADIAPDYYKPGQSDLLKKFKSVATPETKRKLLNQFENYVTQNLVELEANKSNIPTRQAIIKLADPARLVTYLEKMAELKTSYIDNGKKKVVNEEGKLLDEAGLKNYNKILKDAGLITKDLTGKKMQALIDNFNAFTMSDLALVLTKTVGEIKIDNERLVGLNNTMPPFRGTGARPVRNLNNLDAITDLNPELKLAGHDLKAKEEAAPVVRGPAPVIGRAVEEALVAPNTDEGTFHNEMYLVKNTKNPEKLEVRTLGAENDLGITIRTLLTLEERKVPHESLALFSEANPDKAQLIIKAKNIWNRLKNDDLIKQTSRQALTLNNKIANGTFFEELFNEEEHNAIGRLNYTFGKLPLDLQNHITAKSNEIKIKDELQGKKTIISRIDYIAKNENVLGANSLNNEIERIVDNFNSLKLSDILDIALNKENVRDNIALTTKANEVNIQVNNWINNNIVNLTVDDSLGNGKGKLDKADLTSLQNKAAPATLSKIYEIGVDTKAKLLKKVLADNAADLSKASKNITEKNIADVVQNNFNAKMKALTPGTKDFSKEQIVKFLNVISDAKIKAVLKEVKTAKAASAPVAAPIIVVAGGPPPPPPLPTRVIGYNGLGMDGLVRKMNILKPIENLFPKKPDADAGEVVYIAPTSELGKKYEDAVKVIAASDDKFKKELAIKTKGKEKLKALIVEEVFEKYTTKNADALDGDINQLAQAIKEGTNIEFIGPKREVESGIDQETRNLCVRMNQDAGLMQQLKTNNPRLAAIIEAAAVNEEEVATRLPESAAAQAVENGDVNYGGVVVVAPAAAPVAPVAPLVLPADPEEDPEEVAVPAALAINMEDVVVVPPPVEEAPQADAEIMIVRAIDRIVPVEGNIEDFDDEDDDEDFEDDDDDIIQEQTKLEISSSTTVVVNKSESKDSEDSFENLKQEEAKVAASIKEAEEARIAEAVRVEAAEVAEMQNAVKQDEEMIGAIYNPIHGIITQMSRNIISHRMFSSAAVAAGDEDEKVLDKGLWIAGTIGTNKQKGTSGYRGHASGGTIGFDVGSDNFKDLVGIAYTKLDSKFKSSGSRSNTTVDSHILALYGQKELPKNFMIQAMFAYNHNIVKSKINRLGTIAIGKYKNNNYNFETLLSYNHLMNGGITLTPNLGIRYGHSKDGSYQESDVGIQHLSIASKKQHLWSGILGTKVALAPQKIAEGLSITPALQASVENYFNNKSKKLNAKVKWKDREVNETIALLKQPKVGYNIGTSVLTEKGNISVTLEYNCHLQKKYQSHQGFVKLKVKL

SEQ ID NO: 378 - protein, 743 aa, Escherichia coli str. K-12
MHNPSRLTPLSNALLLRQMFRSRPSMAAMGLALCMPVATQAQEAAADGSTQTATVNLAPTAIDSQYLGTATDGTGSYTTGAVSIGKGAPQSLRETPQSVSVMTRQVMDDNNLNSLSKVLEDTPGISFQYRNFGGHVYTSRGFSLLAESFLVDGIGGQGYQITGWMQPDMAIYDRVEVLRGASGLLVGAGQPGGAVNLVRKRPTADNKFSITTRAGSWDQYRVDLDGSGKLNDSGTVRGRMVAAYDDSGSYLDGRDSRTPLLYGIVEADVSDDTTLTMSLRRQEQVINGYSIYGLPRYSNGQSLGLSRSTNLAQKWNRLESDMTEVFTEVAHRFNEDWISKTSLTYSQGGFDQAIAFARGAVNPTTLAGSTFQNTLFRRDEVDSTGLNTQLEGNFNAFGLEHQVTLGADWSKQNANTHQATAPTRSAINIFDVNQNAFAKPARPAWTTDIDTTEERAGLYANTRIHLSEPLSVVLGTRLSWYDYTYDVKTGAANSYESKQTQEFTPFAGVIYDINDSWSWYASYADIFTPQANYVTAGGSPLDPAIGSNYETGFKGELFDKRMNLSMALFYIKQKDVAGVDVNTTQLCPTSSDGSCYLQDGISRSKGVDVEASGEVLPGLQVFGGYTFNMLRNNGDSDVAYETPKHMLRLNTSYNLPGAWNRLTLGTGVSADSGYEVPSNKQLGVAGKAVWDARASWKLDENWKVSLNAENLFDRKYYSTSIANDRSNVYGEPRSYVLTLRGDF

SEQ ID NO: 379 - protein, 714 aa, Escherichia coli str. K-12
MNTCLSRFSLTSLSLAVALASQTSFANDKLEEIIVTGELRDANALSVANSVSIVNASTLAARNTQHLEDVFNLAPNVNYSTGASRGRFILIRGIGERSQFVDPVNPSVGVMLDGIDMTGISTGITALDTKQVEIFRGPQGTLFGANALAGLVNVVSNDVSDAPSGKISAGFGTYGAFDAGLTLSSPINDVAGWRAAVKQTNSDGFIENTHLDRKDTNNIDEFSAKNLLTFDFGKSLAMRWVTYYIDVDNGYDAFSLDNNRKTLSDEPGHDRQTTLATALHTTYSGSDMIDLEVVASVAESEIEYGYDEDWAYRDICPIDSECEGQQYSTTDNYERDNSNTALDVRLISKGDSKFAWVAGAYVRSQDVELTRTHVNNDSTYDFYSLPRVPEVTPYTSDYTTTNSAIYGEVRSTLSATTTLVTGLRLERISSDFIDSNGSTFNPGETLWGGKMALEVQISDHEMVYGLVSRGYKGNGFNTEVDLEEEDKTFDTETMVNFELGTKGQWLDNTVTGQFALFYQLRNDIQVKQSNAYEEDGTIQFIDSINNAAEGVNYGAEMELLWSPVENITLFSNVGLLQTSFKEFSNTSHVDGTKDMDGRDQPHAPNYQYSTGATFQFGDLLSARFEIEGKDDFYFSANHEEKAGAYTLLNARIAYQLDEIEFALWAKNLTDVTVETRGFYFDHEFGNDPRKFYAAEPYSQKGAPRTVGVSASLSF

SEQ ID NO: 380 - protein, 726 aa, Escherichia coli str. K-12
MKKLPSAAYLAVALPLSAVAQTDPSVTLGSIKVEASADASAQGLAPAFAGGQVATGARAGILGTKENLATPFSITSYTSDLIADRQARSVADVLQNDPGVRVARGFGNFQESYFVRGFLLSSEDIAYNGLYGLMPRQYISSEFFERVEVLRGASNFLTGTPPTGGGIGGAINLVPKRAPNEPLTRFTTGISSSGAAQAAADIARRFGPDDSTGIRINVGQRGGESAVDGEFGRTTAALLGLDWHNDRARLSADIGYQFNRIKRGRPNVTLNSSIKSVPSAPSSTTNYAQDWTYSNERDVFGTLRGEYDISDKLTAYAAYGHRNSKEKNSLANIGSVDASGNGTFYRFDNVRKDTVNTGELGLRAKLETGPVKHDLVVSGSYFELEKKNAYAMDWRNTTATNIYHPVRIPQPAFSPNTLFGNDLGDPALSGRVRMTSLALGDTLSVLDDRVQLTLGVRHQRLYSRDFAYNTGVGGKAYDQSRNSPAAGIVWRLTPEVSLYANYIEALTAGETAPNNSNGLPVRNAGEMLSPYVAKQKELGLKVERDGLGAGIAVFTTEKPRAYVNSDQVFSEAGRDRHDGLELTFYGQATQSVRLLGGMTWLNAKQRDTGSATTDGKRVIGVPQYQANLGAEWDIPGVEGLTLDGRLVYTGASYADAANRLKVPGWTRVDAGLRYSTDISGHSVIWRARVENIANRGYWSSVGGYPNNGYLVQGAPRTFTLTAAIEF

SEQ ID NO: 381 - protein, 736 aa, Escherichia coli str. K-12
MALLPVTGPQKLTLLPTFVRLRTTFRCRRGDEARRNAARSFAFQVSLMIVRRRPARPTSARRDFGSRELSTPHNRISLRPSASALIAGAATAAALLLPQGAAAGGIGKQRPDPAYDWSGFYVGAHAGYVRGHAGATLQDATSVAQNSNGAGGITAGAQAGYNFVTGSNLLLGVEADISFPSYLPQNAVLSEFDNGTANTLQHLDYYGTVRARLGVIAGRWLGYVTGGLAFEHERYLTDPDVGRVMNARIGWAAGAGVEYGFTPNWSARVEYLYSQYQNATVDLPTGASYATSLNLQTVRVGVNRKMDWFGTGSTDAFPSLAAVADPESGRWEIHGQTTFIGQGYPSFRAPYSGTNSLFPGAQFKNTWSTSLFANVRLWDGGEFYFNPEFLQGYGLSDTVGAGGFPNGEAQKSGFAYPHFSPSRFYLRQTFGLGGEQEQLASSGSQLSGKADISRLTLQVGRFSVIDVFDGNSYAHDPRRDFMNWSIWASGAFDYAADKLGLGYGATAELNQKQWAIRAGYFLVDAESNSNNYDMKLLRRGEYVAELETRYSLFGLPGKLRTLGFINSTYSGSYRETLNDPSLNLDITQTRRGRIKYGYALNLEQAVTDDIGVFGRWSWNDGKNEIMAFTDIDSSLSGGVSIRGQRWGRPDDVIGIAGALNGLSRDHRDFLAAGGLGPLIGDGALNYRRERVFESYYALALNSSWTATADYQLIANPAYNADRGPVSVFSGRVHGEF

SEQ ID NO: 382 - protein, 1128 aa, Escherichia coli str. K-12
MDYFRRKQISAMLLFFALLLPISMVAMEQNNGVFSFKLQDVTVKDIFKYIEKNSEYIFLYSTDKNLLKKINVDVNKKDITQVLDEILKNTTLIYDIDGKQIIIREKNASEKSQQKTTQKKKTIRGIVSDDSTQEPIIGATIRVNGSMTGTTSNIEGDFVLECAVGDTLTVSFVGYQDRSVLVKSGNIYAIALKESAAELGEVVVTAFGVGQKKESLVGSIQQIKPQELKVPSSSLSTAFAGRMAGVIAVQRSGEPGADGANFWIRGKSTFNGNTSALIIMDGVEISSTELNALDPEVIESFSILKDATATALYGTRGANGVMIVATKNGKNLDKPIINFRLEGAISTMTRVPNMVDGPTYMKMFNEAVSRPGCDVSPYSQEKIDGTIAGLNPYIYPNVDWFDEIFNKSAFSERANFNIRGGSSKMDYFMSASFKHSNGHLKSLSKDYFSYNNNVRNYNYDFINNLNISATRTTKISLGLNLSVADKKSPLMDVNDIFQLSMEANPVDFPVRFPANMSDRDFVLWGDKPGGIHGQGWYRNPVAEYVTGYKTNLRTTITANFKLAQELDMITKGLKFTGLFSFKNYSSSSTERSASYNHYYMSSYDPSSMEYKITRIGDEQSTALTNDGSRNGDRKMYFQAILDYNRIFKEVHDLNIMFLYNQEQYDINGPTTLFSSLPQRKQGVAGRVSYSYDGRYYIEGNFGYNGSENFAKGHRFGFFPSIAVGYNISNEKFWQPIKPVISNLKIRGSWGLVGNDATNAGRFAYMEDLVLGGSDSYTTGIRQDTYYSGPSWNRYFNPDLTWEVGEKINLGLDLQLFNDFNLTFDIFREKRRDIFMTRENSIPEIVGTGETKITSNNGEMENKGLDLAIDYNKQITKDFFLSFKSTLTFARNKVLKMDEPPYFEYPGLSDVGHPLGTYWGYVADGLFPDQETIDNSPRQDLGYTPQPGDIKYVNQPNAKGEYDNVINSNDRVAIGHPYDPELVYGFGPSMKWKNWDFSFFFQGVARTSFMMYGMHPFGTTSIKNMLQFVADDHWSVDNPNPNAAYPRLTKDSNGNNDQYSTYWLRNAAFLKLKNAEIGYTYKGMRFYLSGVNLLTFSPFKHWDPEMGGGNGLYYPTQRVFNIGFQMTIQ

SEQ ID NO: 383 - protein, 1077 aa, Escherichia coli str. K-12
MRLTRVLRETGVVLLAALMFGSAAMAQSSSSVIIGTVVNADPSANKAPLADVAVTATSPNLQGEQTVVTDAQGQYRIPQLPPGVYTLRFDSQGFKPFARSDIQLRLNRTIRVNVELLPDSFTEVIELTGAPPTIDIGSTTQGVNVDQEFVRRIAVNRPGGKGGAARSFDSLAELAPGAQNDQFGVSVNGASSPENGFTVDGLSTNDPAFGINGSALSVEFVQDVNIITGGYLPEFGRATGGVINAVTRSGSNEFHGSVFGNWTPGALEGNRTIALNAGSVITGNNELKNLGDFGATLGGPIIKDRLWFFAGVIPSFTRYTHTRGINYFQYDAEGNPILDENGDQEVLPIEGAERKYFADSRSIQYMGKLTYLINQDHNVALSVNGTPASTGGRGKLTISPQSGGLPGAQAVRPSDIGQREITSGATSVGLKYSGSFNEKKLLLDVNAGWFHQVASTLPVDGSEVGDIYGDGLAGYSAVDYQKTRSLAYFENLGATAAVCDAADSTDPILCPVNTYRVGGPSLLTDGSLNRYQANAKATYLLNALGSHVFKAGVDVELLGYSQKKSYSGGVYFNETNLGGRVDPRTNGTIANGTYGWIDARRYGIQTRPDSAEVLPFLQSDTKSNTVGGFLQDSWTLANRVTLNLGLRYDVQQIYGADGDLAMVLGNQWSPRLGAIVDPLANGRMKFFFNFARYYEQVPLNLADRQFPPERQYTAYRVAPTEPGGTDGCDPSTLEGQRSGCANTAYLAPSAETGRNPSRLYGGGKTEPTPVDPDLKAQSSDEYVVGGEYEVVANTRFGANYTHRNLGTVMEDMSRDNGATYFIGNPGEGFATEFPKAQRDYDAVTLYLNRNFAGGWLAQASYTWSRLYGNYPGLFRPETGQLDPNITADFDLIDLLDNRTGLLPFDRTHSVKLFGAKEINFTNIFSANIGLSYRGNSGTPINYLGAHPVYLDDEAFVLPRGAGGRTPWVNIIDTNVGVNYRINKDNVVSLTMDVFNLFNFQTATAVDETYTRQSVYPLKDGTPADLPGKVQINTGDSAYDAENPEYLTDSADDVNPNFRNARTYQAPRQFRFGIRYTF

SEQ ID NO: 384 - protein, 363 aa, Escherichia coli str. K-12
MTIYGTFKKDGSPQPTDASTSETAFINDGAPSSISMYGTIDSGIRHVTNTTASGGSTTKLGSNGEYYNNRLGIKGMENLGGGLNMHFHLESGFNTGTGELDNKANRLFNRISSIGIAGSFGSLDFGRQPSVACKAVYAYEPFQYRYVHIIPLAGAVAGNLDGRVSRPFGTVDGPRFSNGAQYFGKFGSFTASAEYIMGEVPGSNRNQAAKAVGLVYNDGTFTVGGAYTRQNPNIGTVAASDYREQNQTTFGGGYKIDALRITGGYLKTTTAITSQAKNIWLGARYDFTPAASLTAGYYRTTLETAQSEIARRNLLIVGATYALSPRTSLYADIDQAVLHGLASLPSGSQTRQTGISAGISHIF

SEQ ID NO: 385 - protein, 765 aa, Escherichia coli str. K-12
MPTKGKKCIFSKNSPPLLFLLKFRLSKRKRMKSVLIIASTLMALSAEGKTTGPADSLKISKDISLDEVVVTATKVAKGTPVAYSELTKDELNRRNDGQGIPFLILQSPSVIMTSDAGTGIGYSGFRIRGTDANRINITVNGVPVNDSESHTVFWVNMPDFASSVDNIQIQRGAGTSTNGAAAFGATVAMQTQKSELKPYAEYSVSAGSFGTVKNTVKLGTGLLQDHFVFDARYSNIQSDGYIDRAKANMHSYFASAAYYGNNTLIRFQTFGSIEKTYQAWTGVPSYLLDSDRTYNPCGEYKEDGVTKYYKNQTDNYRQQNYHLTASQRLSDLWNMNLTLHYTHGAGYYEDYKGGAKVKDYKLPPYIDSQGDTIAKTDLVRRKWLENDFYGAIYSANYRGERLQFSAGAAINRYDGDHFGRVMWAKQSNNLPEPDYEYYRNTGDKLDYNMYAKANYQLHPNLNGYLDMQYRGIHYTIEGSDDKAGDHVNVDKHWNFFNPKAGINFQKGGHNAFVSFSVANREPNRDNFTEAGRDERPQHETLYDYEAGYGFGNSRFHVGANLYFMDYSNQLILTGKISEIGEALTSNIKDSYRMGIELTGGVEIARWLDWSGNLTLSRNKIKNFIESIEVYDADWNFLREDHNDLGTTDIAFSPDIIANSMFNFSWKQFSASFNSQFVGRQYIDNTSCKDRSIDPYFVSNLRVGYVFKPKFMKEIALDVTINNLFNEQYETNAWVYSAMVDGERYKEDGYFTQAGTNAMARVTFKF

SEQ ID NO: 386 - protein, 78 aa, Escherichia coli K12
MSTIEERVKKIIGEQLGVKQEEVTNNASFVEDLGADSLDTVELVMALEEEFDTEIPDEEAEKITTVQAAIDYINGHQA

SEQ ID NO: 387 - protein, 719 aa, Escherichia coli str. K-12
MKQLVLITVILISTIAHSQTKVSGTVTDSKNNPVIGANVYLEGTYDGSSTDDNGNFEFETMESGSQTLIVSAITYETHYEMGDVSYFKDLKIKMIEAINHLSGVTLTAGSFEAGDNSKVSVLKPLDIVTTAGAAGDFVGALQTLPGTSTVSEDGRLFVRGGAAGETQVFIDGLRVFQPFSATANNIPTRGRFSPFLFKGITFSTGGYSAEYGQALSSVLLLNTTDEPEQEKTDISVMSVGGGVGHTEIWGDESLSINTSYINLAPYEKLVPSTQGTKWNRPYESISGEAVFRSKGEKNIFKLYTGFNHSNLDISQEDINYEDFVRFKLKNNNLYFNSSYKHYLENDWTLSTGASISMDKNKIEIISDDIETKEIGAHLKLKLRKNFSNRFQLNFGGEYFNMNYDDLFTTQNGSSFESKFNDDLFAVFSEADIFFSNRFAMKLGLRAENSNAMNLFNVSPRVSLAYKSSDKGQFSLAYGDFYQNPSVEYLKFDEALDSEKTSHYIFNYQYLDNGKTFRAEAYYKDYDKLVKYNTLRPQFNSEYNNLGSGYAAGLDVFWRDNKNIKNLDYWVSYSYLDTERDYLNFEEKATPNFAPKHNLSLVTKYWVEDLRSQVGFSYNYASGRPYNNPNSNTFLTGKTKSYNNLSFNWAYLVSQQKILYFSINNALGFNNVNGYQYANEAKMNGVFERRTIRPSAETFFFVGFFWTISNDKNSNQLDNL

SEQ ID NO: 388 - protein, 466 aa, Escherichia coli str. K-12
MQKEKLPSLFGFKVSFLIGIVFVSPLLGVGIFQPSHNTRYAGMAGVNLAIGGSPMDVATNPANLTRSQKGGLEFGIGLPYIRSKYTDRLTDASPETAYSNSQNYNILAPLPYFGLNLPITDRLNYGAGIYVPGGGSGHVNGILRVTPDGRSLRDWSGLDIPGPIGDSRKIKEDLSTTFYVVKMTNALAYRLGNFSVGLGIETIYSKQIAYQKLYDITHTLEIPGQGFDYKSRNAYSMGAIFGLSYTFTERFRIAYSYQARNILPLDGGMQIGINNANHYRRTGVSATFNLPEKHGLGFSFGGESLRVGLDFLYYNYNSYNQTFKQTLEDSWFSTPFGKTNTISQNIAYHDSWAAAIGLEYKTDFFMYRGGYRYNTGVVRSEGISALQAGIMVQQLSTLGISFLLGKWSIDLAVNYLFSKKIIANQGNDWAVLHSVFGPNDIRVLNYSQSLQSDVPAILLGASYRFD

SEQ ID NO: 389 - protein, 297 aa, Escherichia coli K12
MANCFPRFINSKAPPPKGEGKPLHSGLLGSGLGFHTHQKSKQDLHGFSSRAFGYSTQSLLSSETHHLISLSFAQVLGKIKELKSQNKVSSHNYSLGLALQFPWLDENFITSASLGYCYGAHHMTSFYPQNKKSETHFRNQALSASLACCFPEMFSFFGLYLTPFIQANAVRAEQSKVQETGDFSRKASNQHPLINVTLPVGMHTTWHSETKLPNIWEVQLAYQPAIYRQNPKVLMTLVQSNGSWTTSGTPVARHALHAEGKNSVYLFKHMLVFLDYQVDLASSTITHYVNCGSEIAF

SEQ ID NO: 390 - protein, 609 aa, Escherichia coli str. K-12
MIKGPSGTDYGRSAPTGSINMISKQPRNDFGIDASASIGSAWFRRGTLDVNQVIGDTTAARLNVMGEKTHDAGRDKVKNERYGIAPSVAFGLGTANRLYLNYLHVTQHNTPDGGIPTIGLPGYSAPSAGTVTLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYNSATACGGSGRGAITCPAGVAKGSPATTVDTAKSGNLVNWKAGALYHLTENGNVYINYAVSQQPPGSNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATEDISVGAGARYIGSMHKGSDGAVETPAFTEGYWVADAKLGYRVNRNLDFQLNVYNLFDTDYVASINKSGYRYHPGEPRTFLLTANMHF

SEQ ID NO: 391 - protein, 285 aa, Escherichia coli str. K-12
MNNRKSFFIIGASLLASLLFTSEASSTGNVSNHTYFKPRLYISGQYRPGVSHFSKFSVKETNYNTTQLVGLKKDISVIGNSNITTYTNFNFPYIAEFQDNAISFSGAIGYLYSENFRIEVEASYEEFDVKNPEGSATDAYRYFALARAMDGTNKSSPDDTRKFTVMRNDGLSISSVMINGCYNFTLDDIPVVPYVCAGIGGDFIEFFNDLHVKFAHQGKVGISYSISPEVSLFLNGYYHKVTGNRFKNLHVQHVSDLSDAPKFTSAVATLNVGYFGGEIGVRFIF

SEQ ID NO: 392 - protein, 417 aa, Escherichia coli str. K-12
MKIRRKTAVPRSAGAVLPMLACLAAQAAEGGFLEDAKTDLVLRNYYFNRDFRDHDAGKSLVDEWAQGFILKFSSGYTPGTVGVGLDAIGLFGVKLNSGRGTSNSELLPLHDDGRAADNYGRVGLAAKLRVSASELKIGEMLPDIPLLRYDDGRLLPQTFRGFAVVSRELPGLALQAGRFDAVSLRNSADMQDLSAWSAPTQNSDGFNYAGAEYRFNRERTQVGLWHGQLEDIYRQSYANLLHKQRVGDWTLGANLGLFVDRDDGAARAGEIDSHTLYGLFSAGIGLHTFYLGLQKVGGDSGWQSVYGSSGRSMGNDMFNGNFTNADERSWQVRYDYDFVGLGWPGLIGMVRYGHGSNATTRVGSGGKEWERDVELGYTVQSGPLARLNVRLNHASNRRSFNSDFDQTRVVVSYPLSW

SEQ ID NO: 393 - protein, 188 aa, Escherichia coli str. K-12
MNTLNKTLLAVAAGTLMTAGAQAAVSYGNGMTAQPYIGAKVGQYDLDGAKDKGTSYGVYGGAKFTPNLGVEAEYLTTSDEDFGPGTEYSADVYGLYGTYDYAFPNTGGLYAKGRVGVAKNEVDVESKNSNLYKDSGSETGIAGGLGLGFNVAQNASIEAMYNWYPSIENTRGDDIDASGVTLGAHVKF

SEQ ID NO: 394 - protein, 1571 aa, Escherichia coli K12
MNTIHLRCLFRMNPLVWCLWADVAAKLRSLKRYSVFTFQRMKFMNRTSPYYCRRSVLSLLISALIYAPPGMAAFTPDVIGVVNDETVDGSQRVDERGTTNNTHIINHGQQNVYGGVSNGSLIESGGYQDVGRHNNYVGQSNNTTINGGRQSIHDGGISTGTIIESGNQDVYKGGISNGTTIKGGASRVEGGSANGTLIDGGSQIVKVQGHADGTTINKSGSQDVVQGSLATNTTINGGRQYVEQSTVETTTIKNGGEQRVYESRALDTTIEGGTQSLNSKSTAKNTQIYSGGTQIIDNTSSSDVIEVYSGGVLDVSGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDAGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQIVNEGGLAENSVLNDGGTLDVREKGSATGIQQSSQGALVATTRATRVTGTRADGVAFSIEQGAANNILLANGGVLTVESDTSSDKTQVNTGGREIVKTKATATGTTLTGGEQIVEGVANETTINDGGIQTVSANGEAIKTTINEGGTLTVNDNGKATDIVQNSGAALQTSTANGIEISGTHQYGTFSISGNLATNMLLENGGNLLVLAGTEARDSTVGKGGAMQNQGQDSATKVNSGGQYTLGRSKDEFQALARAEDLQVAGGTAIVYAGTLADASVSGATGSLSLMTPRDNVTPVKLEGAIRITDSATLTIGNGVDTTLADLTAASRGSVWLNSNNSCAGTSNCEYRVNSLLLNDGNVYLSAQTAAPATTNGIYNTLTTNELSGSGNFYLHTNVAGSRGDQLVVNNNATGNFKIFVQDTGVSPQSDDAMTLVKTGGGDASFSLGNTGGFVDLGTYEYVLKSDGNSNWNLTNDVKPNPDPNPNPNPNPKPDPKPDPKPDPKPDPTPEPTPTPVPEKRITPSTAAVLNMAATLPLVFDAELNSIRERLNIMKASPHNNNVWGATYNTRNNVTTDAGAGFEQTLTGMTVGIDSPNDIPEGIATLGAFMGYSHSHIGFDRGGHGSVGSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEIEPWLKAAVRKEFVDDNRVKVNNDGNFVNDLSGRRGIYQAGIKASFSSTLSGHLGVGYSHGAGVESPWNAVAGVNWSF

SEQ ID NO: 395 - protein, 1296 aa, Escherichia coli K12
MESQQTHRKINRPLVSLALVGALVSITPQQSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQESSQNNSSTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTHFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFVNNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFARYALIKNAPFAQTNATPNLVAINKHDFGTIESVFELANRSKDIDTLYAHSGAQGRDLLQTLLIDSHNAGYARTMIDATSANEITKQLNTATDALNNIASLEHKTNGLQTLSLSNAMILNSRLVNLSRRHTNNIDSFAQRLQALKDQKFASLESAAEVLYQFAPKYEKPTNVWANAIGGASLNSGGNTSLYGTSAGVDAYLNEKVEAIVGGFGSYGYSSFNNQANSLNSGANNANFGVYSRIFANKHEFDFEAQGAVGSDQSSLNFKGALLRDLNQSYNYLAYGASTRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFIYLHNLISNAGYFASNLGMRYSF

SEQ ID NO: 396 - protein, 236 aa, Escherichia coli K12
MPKTKTTYAFAFAAGLTLAFGSIGAYAQSEDAANTLKIGYAGITFNTKSGHLIGPPGTTPPGIQTDLRDARTFALIYERRISGPWSVVVQAATPPVVKVDGAGTGAPLGSVETTKAWFPAVLATYTFAGLPGIRPYVGAGVNYAFFTDPQVSAAYTGAFGGTSSSSTLKNSWGPVVKLGAEFPIAKNWVLDVGYSRYWIKTTATITTTTPGVGDIARTINVKVDPGVFGLLVGYRF

SEQ ID NO: 397 - protein, 571 aa, Escherichia coli str. K-12
MSVLLSVLFLAFLLAVAPSGLSAQQKDEKLVITAEEIRTMNVQKIDDLLNRIPGVKAGDSSVSIRGSSNVKVMLDGRSINDPTSHSGSVKWSMISLEAIERIVVIKGGGSTSYGDNTGGGVIVITSRRSDHFRGTAGGYLGNHGQQKATLDVQGGTERLSAGFSAGYENSDGFTLNDDKRRRRMGARAEYRFSDDFSLFLSGDYNDEHKGLRGYPERRTPNSRKEYDDVSLLFGQDVGAVSGKTWYCVARTLSTDPDRELSASLEVTRAGQSVEGPLSLPLAGNVDSGIGYEWQEASGSSVGKADEEQAWVFMSKTMQLGNGPWFVTAGARGNIYSEYSAAVNPEMKARYRTSKLSVELAYSRASNLPAFRKRFYESSVTKPNPDLQMEKATNYALSLSVVPDSSLSFDASLFYRDIKDRITYVRDLETNTGRYENFGEVTYKGVEVSASWSPSSLFEFTPSYSYLHALNEETGFWLPAKPFHTIMADVVFRPLDGWSFRAVVKYNGKTYVDSQNTRTLAAYTVVDARADYSLGDLTLYCDIDNLLDENYFYVDGYDAPPREWVVGMNYNF

SEQ ID NO: 398 - protein, 195 aa, Escherichia coli str. K-12
MSQLPIPLPLNESRWRYVTASGGGMTVAFLAGSGGSITLLSPEGENVSFRYGGVGGGIGLGMRLPRFGKVNLNVKGKSVGGAGALEALPSTGTVLVADGLVGRDLSRGDFTGPCMYVELGAGVIAGGSGTAILFGLDPKLLAAVALASASPLTAALGASMSRQLLQSSRGALLMAGVNVGAQFGGGAAAYLGALF

SEQ ID NO: 399 - protein, 1087 aa, Escherichia coli str. K-12
MSALTRKLILLLVVCITAIGAAAQTRTLSGEVVEKSGDPLVGVSVFNREYKIGTTTDIDGKFEITLPSGVKKLTFSYIGFQPLEIDLKPDENKITVTMTEDAQALDEVVVVGYGTQKKVNLTGAVSVITDKELSDRPSQSLTSMLQGTTPGLNITTGSGLPNKSPSINVRGTTSVNATNPLVLVDGVESDLSQVNPSDVKSISVIKDASAAAIYGARAAFGVILVTTKAGESDDATGKRARTTVRYSGRFGWEANTNSTDYEDRGYWAVYTANLFARAKDGKNIIDYTDKDMAELLARVNDRTEHPDRPWIVEDVRNGKKQWVYYGNYDHYHMNFSDNRPKMQHNISLSGGIGDVNYFVSGAYEYRKGILKVNPDTYNKYNLRSKIEFPVTKWARFSNNTSLYSTSYKSQGNGSIEDTFGYSANGAFACYPNKNPDGTWIYSVPYQSTKMANGRHIMIGEGSHRNLERNMSFINTSRFIVTPIKQLSITGDFSYKFDQDRNYWRSNHLNFRMYPDSEMDFYGIGAGQNKLTEQVYTSNYISVNAYANYNQSWNDKHNLAATFGFNYEHWHKKNLSAVGYELSSDDLDDLNLATTMFSMGGGQNEYKLAGWFGRVNYDYDGRYFAEISGRYDGTSRFASNNRWGCFPSGSVGWRISEEKFMEWARPSLSNLKFRVSYGSLGNQNVSSFYTFLRMITLSDFDTFNFGSDTKAKYSSIGAPIAQNLTWETARQWNIGADLAMFNNRLNFTGDIYVRNTVNMLTDGIELPGVYGATPPQMNTADLRTKGYELSATWHDNLKIFGHNLSYSVSANLSNYDARITRYDNPEKVFAKSYYPGMKLGEIWGYHVDGLFASDEEAAQYSSQVDLGVVAKNLPQGTWRAGDLKFADLDGDGKISVGEDSALNPGDMKIIGNELPTLQYGFSGSLNYMGFDIYAFFQGTGNHYWYPNGYNYQFWGSFSDPVAGYIPRNFIDQCWSKDNPGAYFPRPLGQSAKNGQLSFVNDRYLQNIRYMRFKNLTIGYSIPGKILSKVSIQQLRVYFTAENLCYWSPIKKHSKYIDPEAAFSRSSNQLNAMYYPWAKTYMFGIDITL

SEQ ID NO: 400 - protein, 764 aa, Escherichia coli str. K-12
MNQTVKPWGVAAAAVMAGGTLGAAQADADDGSSRLLDRIMITGGPDRVQDTAGSAQVLSREDIDRQGYSDPHRILRQIPGVNVAEEEGYGQFPHISMRGVNPERNGRITVMEDGVLTASPAPYAAPAAYYFPPMGRMDNVEVRKGSSAIKHGPYTVGGALNMTSTPIPQETSGKVEGRLGSDNGRRTHAHIGGREGQFGWLLESYTEQSDGFKELDHPLSGDQSNKPNNPVPNTGFDRNNFVAKGLWASDPTAEVYQELEFKYARDRRTIYDTYLGLLPGDFDDNPHRRYAGSQLDEINTENDLYQVRHYIQPTVDTDVTTTVYRTDTVRNWYKLHEVDGDGTGDFTGISDILRDPGDHEDELAWILGGFDTAYDGDLSIDDDARGNVRANNREYYAQGIQVQVGHLFEAFGWDHDMEVGFRYHEDEEDREQWQDSFEMTDDGYMVLDEQENPGETTNRVTSAEAYAFHVQNTMERGSWTLVPGVRYEHIDMERKQWADLGRANLDADGSYSNTYRVWVPGIGATYAIDDQWSVLGGVHRGFAPSGANPDADEERSVNYEAGFRFNDQYTQAEVIGFFNDYSNINYECTNVGGACETEDDLVSAGEVHIWGLEALWLHDLGESQGLDVQLPVRIGYTWTDSEFRQDIDDGPNQLANAREGDRLPEIPEHQLNLSAGVGQADWRVNLNANYVSETRALADRDYSDLKMDARWLFDLSAHYQLKDNVRLLGSIENLTDETYVAHHRPAGARPGAPRTYWAGMRVDF

SEQ ID NO: 401 - protein, 721 aa, Escherichia coli str. K-12
MSNGAEIEVNDNIIATDIAGENENDGTLKLNNKAPINITGTIGNNNSLGIVEVAGKDVTITGELKAQAINFSNAGQEAILTLQAAGGVTNITTAGNNLHTLAITDFDTGNGAIGAEDHRLKAIELTENGLVTINTKNFYSDVTTANNGQGNVKLNIEGGTTYNLGSKNNSLASVQVSKNSTIKGDVYSKEINIDAGKNIDFERGNNRNAKNIIIQDVLVDRDLLPRSLQLFTYLTDIKVDKLNFADAAASIHFKDAVLVNAEIDGGGAIKFDENVWLKEEIKNVERLEFGPEKFAILEKNIKAANLVANKANIVLLDNLGIDADSQFTDSALDLATYELKHTGNVTYNGTLEIITYFDVTAKSGGHILVGNGANVNMSALDSLVIKVKSRSDITKITPDTKHEVILKEAGGNFTPVAQNKVTVDTGGELNRLIRWVRWVSDENGVVLLNNNDNGGGNPENPDPGGGDPENPGDGDNGGGNPGDGESGVIVPIFDPKPIRDEVTGPIAPGLVEQLIGIGIGNESDAGKVLNDLGSTKNVSETLNRLGGRMDIREVSEGLGEFNIEEIQDILTDISVNMDSVVSSGINARLGEVNNKDEGTFKLNGLNKPNASESLNNQAAVAAGDEDNIGTGIWGVPFYGKATQKSRNDGASGYKSKSQGGIIGFDYALSDSVIVGAAYTRADSKLRHQNYKVGDKTKAISDIYILSMDFIIVGQVISLLRL

SEQ ID NO: 402 - protein, 220 aa, Escherichia coli str. K-12
MKTGIVTTLIALCLPVSVFATTLRLSTDVDLLVLDGKKVSSSLLRGADSIELDNGPHQLVFRVEKTIHLSNSEERLYISPPLVVSFNTQLINQVNFRLPRLENEREANHFDAAPRLELLDGDATPIPVKLDILAITSTAKTIDYEVEVERYNKSAKRASLPQFATMMADDSTLLSGVSELDAIPPQSQVLTEQRLKYWFKLADPQTRNTFLQWAEKQPSS

SEQ ID NO: 403 - protein, 657 aa, Escherichia coli str. K-12
MSQNSSATKFTHDVLDVPFNRAYLSKQIMEQQDVQRIDDALTLVSGVFHQNSFGGGFWDNYSFRGFSTDPNLGAAMIRNGLSVNRGINAPKDVVNIESLEFLKGPMAALYGRGETGGLLNLNSKKPQWESESELNLRANTQEQYRISLEHTAPINDELAYRLAVAHEDNQSFRDHVSSERWFFSPQLTWKISDQTQLDFDSEFTEHKGTFDRGVSTVNHQFVMDPKTFTGEPDDGDLKIKDYFYQLRLSHEFNPDWKLNSAVSYKDAKMVGFATEPRRMQADGRTLERQRRYRDYTSEDVLAQTELLGKIDTSWARHEILLSTELGQLDYKQNQLRRNHDSNSPTTVNTIDIYQPEYGKYLPNLTPFTDTKERQRYFAFNVQDQIFFNDQWSVLFGNRFDQVEQDFKNHIKQTEDNQTLHQNSPRFGVNFKASEQWAFYTNYGRSFAMNSGMNRNGQTFAPEKGKSYEVGTKYKINDQSVLSLALFKMKKQNVLTTDPIDKDFQTAAGELSSKGVEFDLNSQINDRWFVNANYSYTDAQIEKDQDLAKGARLSNVPKHQGSVSTNYEFLQDGARKAGVGANLTYVGERSGHNLDNGFNLPSYTLVNLNGYYAPSDRLRYQLNINNLFDKTYYVSSYSDLWVQPGEPLNASISAQWKF

SEQ ID NO: 404 - protein, 652 aa, Escherichia coli str. K-12
MSAGRLAWAYSSVLSMSPQSSSLRLAQVASRARASCFVLRPTLLASALAMAFAAQAQSTAQADPVHMKETVVTANRIEQPLSDLVADMSVVGRETIETAGAVGVADVLSRLPGVQIVRNGGAGSNTSVYLRGADTRFTAVYIDGVRVDSQSTGGASWQDIPLEAIDRIEVLRGPAAAVYGSDAMGGVVQIFTKKGEGKAKPYVGLGWGSRGTVKAQAGISGGVAGWDYSLGVSHASSNGFNAKTSAGFNPDADGYRSNAFNGRVGYQINSNQRVEATALTSYMNAGYDATVSKTSPMADDRSIYKMNAVGLNWLAKWSDVYSTRLQYTQSRDFYQTKPSVYETDTRLHSYLFQNEWRLGAQTVTAALERREDKLVNNGLDIGSRNRSQNALALGYGLHAGKHTLQLNARHDRDSEFGGHTTGSAAYGYEFMPNWRATASAGTAFRAPTLYQRFSQYGDASLSPEKGRNVELGLKWGKGSDSFSATLYRNNVSNLINYVGGTGTCAGNTGLYGGCYANVAKARYEGITLAATTRLGMVNLQGSVDFQDPRDTDKDLQLARRSKRYANLSADTTLAGWRLGVEMQAAGRRFDDAANKTVLGGYTLWNLSAQKQLTREWSLVTRINNLADKRYELARTYATEGRSGYIGVKWEAN

SEQ ID NO: 405 - protein, 800 aa, Escherichia coli str. K-12
MGKLACWGRGEGRHFHRLHSSILLFGLTVLGTELGASPGWAQSESVLLEAVTVTSPPPRATTVVRTAPTARAKQSRRRAHSEVAAQTVTAVRVGIASVPNPASFEAQQQRLLRRPGAESAVSVVQQDPGKKSNLRDVLQLTPGIYMSDRGENSQGTISIRGSDISQTGPRSGRGVRGYIDGIPLGRIESGISLPILDLSVADYLEIYRGAASLRYGALATGGALNLISKTGLTAPGARLSGYVGSYGVRQSQMEYGGAKGNVDYYAQVNGFRNDGYEYHSANDTLRFSGNVGWRPTDNIENRTSVAVGSTRQELATQVPLDQIVTYRRSGYDPTNASFPYDTRANLDYQRVVNKTIFRNDTTSFEITPYFLATSFDHLPSPRAGIVDVKWQDVGISTRLEHRADLWGLPTELVAGYRPTYETANYRSWQWAAGSGGTVKNRLVQDDQFKSWLHEAYGEAAVEVLPQVRAFVGLQAFQTSRVYKDDYAGPVIPSAGLMGPGSSSGRRNYDRSFEALNPKFGMNWEYASRHFLFGNISRSTEVPNSGDIFALLSVETATNLKVIQDLQMQQAWTYEGSVRGSWDRFQYDLTLYHMNLRNEILSQCALGLIPKAQQTPAIRGQFACNLVGSLVPFNADRTVHRGIETVFRTKPFIDLFTPGDNIFLNAAWTYNDFYFDGDRLYGNSHLPVIPRHNLYGEVGYRHASGFYASANLRYVGERATTFDGSGGENFKIPSYNLFGAKIGWRAPDDSASLWFEARNITDVAYAGDFTALRTAADASGGVTVMPGTGRAFYAGFSKRFD

SEQ ID NO: 406 - protein, 373 aa, Escherichia coli str. K-12
MNTAFPNQIVYPIGNANFPDGFKFSASMASRQTHGEFSGFYRGFDKHLLRVGTGYQYIDYYKLEPLAIFGETVTDLSDSAASYGRELIRNNWHIFIQDTWSFLPNWELTAGVRYDEYSDFGNTTNPRLALVWQTRPNLTTKLLYGQAFRAPTFNQINDSESNPFALGNPNLKPETIETWELAFDYRAAGNLHFGLNLFTYFIEDKVIFVSEFGNDEIRRAQNVGEQEGQGFELETRWQVTKKIKLLFNYAFQDSTDKTNNHTVGNAPQHQVYLRSDWLLIPDWFLNGQVNWIGKRERPFGDPRDNLEGYTTVDLTLRHKNPQKPWSIAVSVRNLFDEDVREPSYGPDSSGIINMPYDIPMAGRSFFGEVRYQF

SEQ ID NO: 407 - protein, 802 aa, Escherichia coli str. K-12
MADATATNIYMDGHRKSGDTQSLTVSGTNMSGHYIQGSNGGTVNITLNNGATADMIEAGKVEATTNTTVNVDHSTLNGESSTGKYDNHNKDYMMGSAIFLDPMDKGYHTVNITNGSALHGSIVSAGEGAQAISMSNSAMDKGGIYAGSLTSDTTVSLTSATVDASQSLIAKNIDSLAEALFEKTGIKINNPDEFNDLAVALYGTTNTTLAMNNSTVTGDVAILNDKGTTTVTMTNKSVVNGDVTVDGSTATTLLVDNSTVNGDVDTSHNSGNTTVTLQNNATVNGDVKTGSGDDTLVLTNNSHVNGNVDGGAGSDTLSMDAGSSITGQISQFETVNTTSDNSITIDKINDATTWSLQDGSTLVASTTGSNARVSMSTDSFVNFGTITGANNAIMVTSITPTAQNKSNVILGTFSTASSTAPQNYAAATFTNGENSVENRSGAYNYDNSLDIVPADAAPQTMLAADNSYNWNVVFNSAQGSLASDVQGLIAGLDAAEQAGHQVADDISNHMNQVHLANLLGQQQDGAQVWGDFLYQNGNFSNDVDYKSITQGAQGGVDWTAHMDNGDSVTGGIALAWTRSRVQNTSDGVDSFKDSVYGNYYSVYGGWQQALNGKSWGMFADGSFSYGDMRYTLSANNVTGNTSGMTEALNGSTDGNLYIAQARTGVNVLLPGETLLQPYATLGWDQTKANGFSDSEVTFADSQVSSWNGGAGVRLTTTLTDLNKNVQVMPWIDARFQKEFSDDTDIKAADYHNTSGHNNAMGIFGAGINATIAHNFSLNTGVYVGTGDVDNDASVQAGMSYSF

SEQ ID NO: 408 - protein, 96 aa, Escherichia coli K12
MASGDLVRYVITVMLHEDTLTEINELNNYLTRDGFLLTMTDDEGNIHELGTNTFGLISTQSEEEIRELVSGLTQSATGKDPEITITTWEEWNSNRK

SEQ ID NO: 409 - protein, 917 aa, Escherichia coli str. K-12
MSSVTLTAKAVRRSLIAAAATSVALSGFVFAEEATADNSAENKVERIQVTGSRIKRADMESASPVTVIDASAIIASGATSIDDVLQNMTVSGGAMTNAAVNNGSGGNAHVNLRGLGTNRTLVLVNGRRMIASGTGAASSVDLNTIPVSMIQRVEVLKDGASAVYGTDAIAGVVNVILKRDFEGFEMNVQTGVTGQGDADESSVDFTIGNTFEKGNVVINAQYTKRGEASQADRSFSECPITETSDGSELYCGGSSYSEGGHIWGDSHHDLVGSGEDGAYEIGDSGYYGHYVAGDDGKATFEYHDENVTEANLSGRGGEYHDFTNEDKYNYSEDSYLSTPMERLNLSFSGTYELSDSILFFSEAMYSKRWSEQQMAPQPIWNSTAWAYDSTWMTDDLVGLVQEGEMLDYGRRVVESGTRNFSQVVDTVRLVVGLEGEFDNGWTWDASYNKGKNDSVDTLANLHNLGSINDAVLAKEFDPFSQESWVGESIEPFIYTEINSGGSELDVIAATLSGEIMDLPAGTLGFAAGYEYRKESAHYTPDSLTSQGLANDPRQEATAGSFDVNEVYAELAIPLLSDLPMAEQVDLSAAIRYFDYSTFGSDSTWKLGLTWRVIDDLMLRGVMSTAFRAPTVSELYGGKSPSFDQIKHAATEQTQAEVTVGGNPDLTPEEADITTLGLVYSPSFVEGLSLTLDYYNIEITNTITAVDSNYIANQCMDATGNKINNDTALCQSANIAIDGTGRISFDNGLQNLGQTNTAGYDINVAYTFEGLGLDWKAGLDTSIIDKYEEFDQDGVAVDYLGFITSGSGSYAKFKSNLNLTATGDDWSATYEARYIDGMDSFSCNDDPSECYAPSVDSVVYHDLSANYDLTSTVRLSGGVNNIFDEEPPYYSGNNDSNTDPYTYDVLGRFFFVRASVKF

SEQ ID NO: 410 - protein, 362 aa, Escherichia coli K12
MMKKSTLSAVILAALTSSSAFAAHTFVNDAGDSLTIDGRFDLRYQDRGGDDNGEWNSGSSRFGLKGQMGLDNGWTGFGHAEWGYNSGANGDNIYDRLLYAGVDHEKYGKIAAGTKQWSTFYDVAWYTDLGRVFGTRGSGVYNLADWGIASGAGRAENSITYRNSINEKVSYGFTYQTTREDVALASNATASLKNGMGASITYKPVDGVTLGAAYHQNEVADLDASVVGVENGDNMRIMLLGANYSNGGFYAGATFHVGENWEAVSQGGTDVMFDTLGGEIYTYYHFDNGLRPTLNYNYMEDRGDETQGYERNLLIPGLEYHFQKNKFLVWTEYQFDLGKDQYDGSKFENRDDQFAAGIRYYF

SEQ ID NO: 411 - protein, 383 aa, Escherichia coli str. K-12
MKGRSLIAASILSACTVSAMAQSSVTLYGVIDEGFDFTNNVRGSKAYELESGYVQGSRWGLKGAEDLGGGLLAVFQLENGFNINNGRLGQGGLMFGRQAYVGVASDKYGTVTLGRQYDSLVDFLAQTTANGNWAGALFAHPYDNDNTDNTFRVNNTAKYTSPTFAGFQFGGTYSFSNDTNFSNNRQYSVGAQYTNGAVLIAASYLQANNPSATATGAINNGGDENFLAKRLRIFGAGVNYTVGSATLGFAYTNTDVTDPVSSGYVGAITPPAGSSLSSLRFQNFEVNGKYQFTPAFFVGAMYAYTRTDFNATAGKLHPNYQTIGLMADYNLSKRTDFYLQGAYQHVGGDKTQTVLDVAYVPGATDVSSNSNQFVIRAAIRHKF

SEQ ID NO: 412 - protein, 687 aa, Escherichia coli str. K-12
MPRSTSDRFRWSPLSLAIACTLSLAVQAADTSSTQTNSKKRIADTMVVTATGNERSSFEAPMMVTVVEADTPTSETATSATDMLRNIPGLTVTGSGRVNGQDVTLRGYGKQGVLTLVDGIRQGTDTGHLNSTFLDPALVKRVEIVRGPSALLYGSGALGGVISYETVDAADLLLPGQNSGYRVYSAAATGDHSFGLGASAFGRTDDVDGILSFGTRDIGNIRQSDGFNAPNDETISNVLAKGTWRIDQIQSLSANLRYYNNSALEPKNPQTSAASSTNLMTDRSTIQRDAQLKYNIKPLDQEWLNATAQVYYSEVEINARPQGTPEEGRKQTTKGGKLENRTRLFTDSFASHLLTYGTEAYKQEQTPSGATESFPQADIRFGSGWLQDEITLRDLPVSILAGTRYDNYRGSSEGYADVDADKWSSRGAVSVTPTDWLMLFGSYAQAFRAPTMGEMYNDSKHFSMNIMGNTLTNYWVPNPNLKPETNETQEYGFGLRFNDLMMAEDDLQFKASYFDTNAKDYISTGVTMDFGFGPGGLYCKNCSTYSTNIDRAKIWGWDATMTYQTQWFNLGLAYNRTRGKNQNTNEWLDTINPDTVTSTLDVPVANSGFAVGWIGTFADRSSRVSSSGTPQAGYGVNDFYVSYKGQEQFKGMTTTVVLGNAFDKGYYGPQGVPQDGRNAKFFVSYQW

SEQ ID NO: 413 - protein, 704 aa, Escherichia coli str. K-12
MPHSKFLVQPLWVAMLAVSHSGLVFAESEKNDAETNTLHSLAPIVVTAQQGNDANGLIVHADPKQPIQPVPATDGADYLQSIMGFNSIQSGGTNGDVTFRGMFGSRIKILTDGTENLGACPNRMDAPTSYISPESYDRISVIKGPQTVQYANTGSAATVLFERQPEKLTSEKPYRGQASVLLGSYGRIDHNVEAAIGDEKKYIRLNANRSESNSYQDGDGNTVPSAWKKWNADVALGFTPDENTWVEITGGKSDGESLYAGRSMDGSQFAHESLGLRFEKKNITDVIKKIEGQVNYSYNDHIMDNFSLRTPPLVEMNHGGMTMLMPNAMAMQVTRRTLNSRLAMTSEWNKWSLITGVDSQFNKHGGSMSSPTMPSMNVPYRQDMRFQSYGAFGELGYQWNDQNKLVTGARLDRVTVEDERADSQAKGFNTKLEKNLPSAFVRWENQYPEHDFKSYIGLGYVERMPDYWELFSPKHGNAGSTNTFNGVNPEKTLQLDLGFQQQHGALNTWASAYAGLVDDYILMSYHHHPSMGMDGHDMSHDITAGAKNVDATIAGAEAGIGYQFTDRIQADLSAMYAWGKNTTDDKPLPQISPLEGRLNIRYVADKYNLGLLWRAVAEQNRVSLHQGNIVGYDLKPSKGFSTLSLNGSYNLRKDIDVSVGIDNVLDKTYTEHLNKAGSAGFGFASEEQFNNIGRNYWVRMSMKF

SEQ ID NO: 414 - protein, 958 aa, Escherichia coli str. K-12
MAAVLASAISANSAFAQNAQPNNDVEVIEVSGIRSSVAKSMDVKRSSAGVVDAISAEDIGDFPDTNLAESLQRITGVSIDRSGGEGQLITVRGFGPQFNTVLVNGRQMASENDSRAFSFDTIASELVSSLDVHKTSTATMQSGGVGSTININTARPFALNGFKMAGSVKGVYDENSEETTPQFSGLISNTFNDDTFGVLLAVSHQERETRLNQAQMDGWLENVGVPNPVTQSGEAWTGNVFSPRNYDHKVTFEERTRTNANLVFQYAPNDKLVVTADALYSDFDVESEATSYGHWFTAPNIQGVGDDGSLFDENGNRRSPTVDANGTIIDLYQEVGLATDMHAKTFDRLTDTYAIGLNFDYQYSDNLNLSFDLSHSEAEREANNGGGDQLSLIGYANRVRFQVDDNILPVASMFASPDANIYSGQQELDGAIVTGPDGFPAYNGALTPDGVSNHLDEANSRAHVMLRRGWAVEDEVSQLRFDGEYVTDGSGLTEIRFGAQYSTETKSLTRWDNEGVGIHCTYCGYPDLPEIPAGSQYVFDAGSDFLSDVSGSGRMPTSWLAHDGEANFAFLESYYQSVNGEAISFDAVRRNNSFEVEEDIISTYLEFDFEGEVADMFLSATAGVRYESTDVTVNGTQAPITGLTILDQTEMLAGFGDAQSIATESDYDVLLPNFSVRLEITDDLIARFAASSTITRPTLNSMSPVTVITTTRQGGDLTSTSGNPALEPFKSDNLDLSLEYYYDEASYASIGYFRKLVSNFIVNSQEDKTFELADGSLLTDPSTGANASAPDAGDDVAVFTNTLPNNGEDATVDGFELALQHTFDNGFGVLANGTIVDSDAELDPFDINQVFALTGLSDSYNLVAFYETDDYQIRLAYNWRDKFVQSLTQGQGDGPTIVESYQQLDISGSYSVTDNVEIFFEGINLTEEFVHKRGRFSNHLLLVEDSGRRWAFGVRGNF

SEQ ID NO: 415 - protein, 978 aa, Escherichia coli str. K-12
MILRSIFIKGIFFVLVSCVFQVTTAQEGKKSAVSLSGLLDKIGNKYQIFFTYKANLISNKYLQEEGFTNLSLSASISLLEKLTPFFFDDLGNNYYVIYLKKTANKNRSVNREKIISSNIIGLNTFFKGERITVRGIVLSSDSTPLVGAALQEEQSLSGTTTDLDGTFEFEIQKGNMVTVSFLGHRSKAQKLNSEIFHTLVLVSGQDLDEVQVVGSRNKNRMATDTPVAIDFIDIEKASSKSSQVEINQFLQYTIPSFNASKQSGADGADHIDPATIRGLGPDQTLVLVNGKRRHQTSLINLYGTRGRGNSGTDLNAIPISAIKRIELLRDGASAQYGSDAIAGVLNIVLKDTDNELNVTSTLGFNNADSEGIFPNSVDGFTYKFGLNYGTKINEGGFINFSSEVLSTENTIRPGTSAREKYGQAAVRNASIFLNAEIPLHRSAKLYVNGGFNFKNTAAFAFTRNPNSKRNVKAIYPNGFNPLITSNIIDNSLSIGIRTYLKGWSTDLNNVVGRNNFQYFIKNTLNATLKEYSPTEFDAGGHQLIQNTTSIDFSKYFSKKIIGFNIAVGSEYRLDKYRIFSGEEASYGSYDVQGDFVNSETPPSDYTSFNGQIVPGGSQGFPGYSPENEVNRNRSNISFYLDTEIDFSKRFMLGTAVRFEYYSDFGSTLNYKLASRYRLSNKLNMRSSFSTGFRAPSLVQSYYNLKFTNFIGDAPSESLLVANNSPIARRFGIENLKEEKARNFSFGLATKLGAAFNATIDAYYVAVKDRIILSGNFDASDLNIDVDNVQFFANGVDTKTTGVDLVLNWGKKWDHSELTLNLSGNVNEMSITKIKNKNLDKETFFGARDRQFLIASAPKNKFNLGIHYQYKKLKTSLNFTRFSSVQLIDWKITQSLSKFNNSEIERLAAATDIYRAKLTTDLHFSYQLNRLINLQIGTNNLFNIYPTKQDSFTDSGGLWDATQMGTNGAFYYTKLNIKL

SEQ ID NO: 416 - protein, 921 aa, Escherichia coli K12
MMKAQMKGISLMIILLMLVLTVQAAALRGTVTDKATKEPLIGAAVQLSGTNTGTITDVDGNFELAGLRNGTYKLIISYVSYCTQTVEVTINGMFEIKVELEQDNQQLGEVVVVADAKKNTENAIITQQRTSLVMQTGVSAQQITKTQDKDASEVIRRVPGISIIEEKFVMVRGLSQRYNNVWINNSAVPSSEADARAFSFDIIPSSQLDNMLVVKSPAPEYPADFSGGFILVNTKDVPSSNLFTISVGTSLNDQTHFKKFLYNKGSGTDFLGFDNGFRSLKGGINAVLSPMNNGYDLLNNGLNNDWTVKDRRPLADLSLNMNFSRRWVDSSGRTLAILGTVNYSNSYRTYLDMDNNLFGAYDMTHDCSNYLRKSIDDQYNHSVRIGTMLNFTYIPASGNSRYEFKNIFNQLGKDRYTYRKGTDAQSDYEESAEYYYQSRTTYNGQFTGKHTLGNTDKLDWSAGYSYANRNMPDRRRYTTVLNEETNQLEVENLNEINREFSRLDEHILSANINYQHDFSFGIFTPSLKVGAYTEHRAREYNTRFFIYSWKNGLPGAYKVMNVPNELLQEKNYGENGLYLLEQVDWRNNYEGNNLLSAGYVGGNLPLGKLNVYAGVRFEYNRMELVSHTQKNEESPTSVFYTYDDFFPSVNAAYRLNDKHQFRLSYGRTVNRPEFREVSSSVYYDFDLASNVQGNYNLKPAYIDNLDFGYEFYPSSGELISVSLFYKRFKNPIEWTYTVSGGTDLIYSYVNAKGADNYGVEVDIRKNLDFIGMRNFSLSLNGALIKSKVKFEPGAKEKDRPMQGQSPYLINAGFFYQHADSGWNAALLYNRIGKRIIGVGCSLGTADNEVRVPDSYEMPRNAVDLSVSKKIGNLEIKVAVRDLLAEKVSFKQFEETRHGKVAQITRQYKSGRNFNLNINYTF

SEQ ID NO: 417 - protein, 829 aa, Escherichia coli K12
MRYSTLYKIPIRIVTIFLLLSSLHPGNYLHGQEQPDTLSFYLPNILVTAIESKTPGTVSLLPASTLEHTQPITIADLTQLLPGGLTNNSGVTDAQYFSVREVSLKNGVNQFHKNAAMGAQIWVDGSPLHFNTGINEPYEGYDARFLSLNQVKEAEIIRGIPSARYGNLTNSVLLLKTHQGRMPLSTSIRYNPKLKQYMLGKGFCISPQGHTLNLLADYTSQGDFHTGGIRLANLYHWLPAGKKLELSLTYTSRIGKEKQFVNEQNHTQRQRLDQRFSIQGEWQPDRRWLKKLSLRIDGSLQKSKQTKSQVNNASSQLYTDQKESGEWEAHVLSSNYMYTLVNESRPFYVETEMLASTSFPLRQRREISLAAGFSWRGEGNEGRGRDFDRQRPPSTSIRPRSFREIPSLHTFGGFIEATYRTPNLHVEAGLRNQGLKSRDYALIYQTEPRLNLLWSLCSSPSGYTLSLKAGVGWISFMPTLEKLYPEAIYNDKVSFYYNDSNESGNTLGILTTHAPGMERNMKLKPTVNRKIEVGLIGKTPAIRLDMTVFFEKQTDGFSSSAQYIPFSYREYDYLSTAQLRPEYKDGQVWVNGKAVPYQEKYSYTPVSVPVNTLHRKKHGIEMVADLGTFSPLRTSLIVDGIWLYVREKNTVLNGIWPIQYTDKTEYPYVGFYDRQGGPGNESRSEIISTNFRFITRIPRIGLVTTLTWQMIWLYKYRTLYNGSTGENVWPLYWCGTDGIIHPFTEAQKEDPAFAPLLSTTAPERFLPNSYKPYGMLNIRVNKAFGEHITLAFFANNLADLRPTRYSASTRSYLQQNTQPFFGLELQIKL

SEQ ID NO: 418 - protein, 666 aa, Escherichia coli K12
MKPRAFYRNATAISLALAAMTTGAAAQDAAVSDTHYLGRIVLGYSEDGTPVYAGENISRLEGSAVTAQGGTATIDDVLRQVPGVQTRLNPGQPGVAVSIRGQQGQGRVAMTVEGVPQNFRFNGHASEGYANFDPLFLQGIDVTRGAVLTAGGSGSAGAVDFRLIDAEDIVDGYGAGGRVRLTYGDNGDNFGRMAAAGYVDERVSLLGAYARTTADAFEDGAGNTVDNTDRDLDSYLLRGAYQLTETQSLEFLATRMNADYASNSYYQEMTSDIYKLSYHLDHSPAINLTANLYRAVTDNEYTGSITGTGSYVGRQMETITTGIDVTNVSDFMLGGWSVTSTNGFEYIEDVLGGAEGGANPTYGESKKLGIFTENVFSNGPWEIMAGLRYSDYSLHGRLDNELQSGDVDIDDSSIDPKISIAYQVNDWLQPYVSYSRSTRSPSLQETLQESFHGYGFFNLYLGPNPDLETETSEGGEIGVNIAKQNLFTAGDNLTARIAYYKMNVDNYVAYVQEDGFTSVGPTTLAFYDNIPGTTVTQGIEIEAAYDTELWSAAMSYTNSDSTPPSGYDDYELQPPETFSATVARRFLNGDLTTGATYSYTAAGESLDSESDSDDYGLWDVFASYEAMDNLFVSAKVSNLTDEEYAPWASSGNGPGRTYYVGLELTF

SEQ ID NO: 419 - protein, 761 aa, Escherichia coli str. K-12
MTNLHFKLSTLAISLAVAGLCTGVVAAEAPNVQVAKTQEPKKAKEYIEQIVVTGTASGKSMKKVDASYAITTIDAESIERLAPKSTADLFKAVPGVWAESSGGVSGANVFVRGFPGGGDAPFLTVQLQGVPVYQPSTLSFLENSSLFRIDETVQFMDALRGGPSSVVSAGQPGLTTNFILKEGSDATEGRFKYSTSDYGLQRVDAVVSGSLAEDLYFMAGGYAQESSGIRDAGFNSEKGQQFTVNITKVLDNGKLNLFTRVTDDHGAWYLPTPLVAGVDNSYTQVGPLNRQATIEFGPNGESKAIDISDGRGWKGAISGGSLDLDFDGGWSLVDRFAYTSGDANTLGLVPNGSPVALSTVADNGVSAIGAVSQKTYGGDTLVQQLGRWAVLKNIEALTNDLAMTKKSDSYQATLGLYRSDYSVKDWWSIGNQAYYLVQAGGEALTGIDCNDNKDSCDWNYDISAVGDGKTSAFYGAFEYTFSDQWSADIGLRNENHQIDYTVDEGLDGVINKSVDYDQTDLSWTAGINWQFSDNAGVFLRASEGSKMPSFDDFRDNYDAYTKGENLIKDVTQYELGYKLALDNLNLYATGFFNEVKGDTFVRKPGDPAEVLTNEAYGLELDAAYFNDSGFSINMNGTLQSTEITESPINKGNEAQRQPKWQIRLTPSYDFEVAGLDSTLYGTLSAVGDRYGNNENTVVLDGYEKLDIGLIVRTDGGLKFELGMQNVTDEDALTEGDPRSADAANGRYIMPRTTTFNVSYDF

SEQ ID NO: 420 - protein, 739 aa, Escherichia coli K12
MTSGAKVTGANSAIINDGTFYLGSATDAKNASMLEINDFAQFFNTGTLILDNNKNAIHLNANNGTLYNTGTMELTATSNKGAINYWGAGAAFINDGTVNATTAALAYAGGGAGSAPEKHAFFWNQSNGVINYDADNGRAVDFSAYNNYVAVNDGTMNISGNNAYGMYGGKNAQLVNNNTINLGTEGTTDTGMVAMALDKNATADAVIENNGTINIYANNSYAFSVAGAGHVVNNGTVVIADGVTGSGIIKQGDSVNVEGTNGNNGNSDEAHYADYTLPGTPVEPGSNTTSGSAAGDTSGASNDLNGYVVGTSADGSAGKLKVSNASMEGVGINTGFTAGTADTTVSFDNVVEGSNLTDASAIQSTSVVWNAQGSQDSDGNVDVTMTKNAYADVATDGSVSDVAQALDAGYTNNELYTSLNVGTTAELNSALKQVSGSQATTVFREARVLSNRFNMLADAAPQIKDGLAFNVVAKGDPRAELGNDTQYDMLALRQKLDLTANQNLTLEYGIARLDGDGSQKAGDNGLTGGYSQFFGLKHSMAFDEGLAWNNSLRYDVHNLDSSRSVAYGDVNKIADSDARQQYMEFRSEGAKTFSLMDDALKVTPYAGVKFRHTMEDGYKERNAGDFNLSMNSGSETAVDSIVGMKLDYAGKDGWSATATLEGGPNLSYSKSQRTASLQGAAGQSFGVDDGQKGGGINGLATIGVKYSSNDTALHLDAYQWKEDGISDKGFMLNVKKTFR

SEQ ID NO: 421 - protein, 730 aa, Escherichia coli str. K-12
MIENKSNSILIFVLFCFAFLTQVHSQNTNSEIKELEEVVIKDQSEKRAKKEASLNTETVNSNFIQRNLGGSLMQSLQRIPGVKTISIGSGGSKPLIRGLSFNQVIVVENGIKHEGQQWGADHGLEIDQYAVNRVEIIKGPLSFIYGSDAIGGAVNIKPVPFPKKNTLGGNVDFTAKNNNEQIGSSLNLFGRNENWFFDTRITSQDYGDYRVPADKVQVYNYTVPLYKNHLRNTAGRELDLHASTGFVGEKFKSVLYFSNIHTKSGFFANAHGLEPRNVNLELHDKSSRDILMPFQEVNHTKISNTTSFEIGNHQLQTQLGFQKNFRREWSHYVNHGYMPPIYPADMYAPQDLERQYDKDVFSVSVKDGFSVDRHQFTVGLNGEKQQNEINGWSFLIPAFNQLNTGLYAYDKIQLNDLWILHGAVRMDYGQIEMKQHTDWFKSDVTQNGQTTQEYLKRSEDLNKTFKSFTWSAGINYNPGKFSFKANAGTSFRMPIAKELASNGVNYHYFRFEKGNPNLDAERSYQLDLGIDWQESKWSVQLSPFFNYFPNFIYLNPTSQHDIYYGAGNQVFEYQQSKVMRYGSELQIHYQFLKNLSGEILAEYLYSEQLSGSKKGYTLPFSPPASVLFGLSYNPEIKNLRETYFSLDYRFTAQQNQIVPPEKKTESSHVFNLALGTKLQAEKQDFAVSLQVQNLFNTRYLNHTSFYRLIELPEMGRNIILSVKVPFLIHQ

SEQ ID NO: 422 - protein, 691 aa, Escherichia coli str. K-12
MFEIIHCGDVRPQNNARIMNKPILNHLPLASVLALLGCSFTGFVHAEEVLGENVNLSNAIVITAPQLKSPVTTNIDLDETPALQSASDGASVLTQIPGFSALGNGGTNADPTFRGMFGSRLAILTDGAQMLGACPNRMDNPSSYISPASYDAVSVVKGPQTVLWGGGNSAATVRFERKREDFTNKNSRFEASSMVGTYGRFDRRLEGAVGNEKGYIRVEANESEANDYKDGNGDVVASAWDKWNANIALGWTPDEDTLLEAEFGRGDGYAKYAGRGMDGTKFLRETAALRFEKKNLSSNWSKVEAQLNYGYADHVMDNYSLRPVSSMGGMGGMSMSGKMRSELDRRTRSGRVASTWDWDAVSVIAGVDAKHEVHRKGITSNSDGKEDYSQHQAGVFSEVTWFLEDERRVVTGLRFDHFRVTDENDSTATAGETRRKNLTNGFVRMEKDLSSLPATTYIGLGYAERFPDYWEIKPSNSSLSGALNAFDGVQPEKTTQIDVGLNYKTKAVSWWVSGYAGIIQDYIIFDYSGSTKVGNVDAYIAGAETGVRYQLDDLWSANASLAYAWGEDSDNNDPLPQISPLESKFGLTYEQSAWTANAVLRLVAAQNRISEDRGNVVGYDFSKSAGFGTMDINAEYRVTKNVTWRAGIDNLLDKAYTEHLNKAGNSVFGYAADESFYQPGRMIWMSISAKF

SEQ ID NO: 423 - protein, 594 aa, Escherichia coli str. K-12
MAIAIALAATPAMAESAFDRTVFFGDSLTDSGYYNPLLPAASRAVTGKFTTNPGWVWAEYVADHFGTNAAPNGNGQIGDNYAAGGARIQASAVSALGAAPSVSSQINTYLTANGGRADPNALYTVWGGANDLLAAATVPAQAQAIIGSAVTAQVGAVAALQNAGARYVMVPTIPDVGLTPRFRAGGAVGMAQGTGAATAYNNALFNGLQSAGLRVIPVDTFHMLQEIVASPGTYGFSNVTNTACNPAVPLPACNPTSLVAANAQNTYVFADGVHPTTAVHQILGEYAISLLEAPRLQQVLIHSAQAVGRARADQVAWHLDGKPDADGMRWWGSVRGDMQRYDHADLYDGMAPAGLFGVDWTAGDMVFGGFAGFGRMDADFGHRNGSFKQDDSTLGGFFGWYTGPVWVNAQVSYSWLSYDVDREVQLGPATRVHRGSPDGSNLTAALNAGYSLGEGNVKYGPVAGLTWQKIKLDGYTESNDTSTALGYASQDVDSLVGRVGFQVRLDGAMVKPYLQATYDHEFKEGGEASAWLQSMPDVGMYTVPGQDFDRNYATVVLGARTGLWGLQSNVGLSTTTARRSARDATLFVNFSGNF

SEQ ID NO: 424 - protein, 342 aa, Escherichia coli str. K-12
MSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 425 - protein, 828 aa, Escherichia coli str. K-12
MKFKVALSAAVAAIALSAVSAPVMAQEQEDEAARTLDTVVTVGTRVANRSALDTAAPVDVVSSEAIQNIGVGELNQSLSVNLPALNFPRPALTDGTDSVRPAALRGLSPDQTLVLVNGKRRHTASLVNVNGSIGRGASAVDLNTIPNLAVGGVEVLRDGASALYGSDAIAGVVNVRLREANTGGAVSVSYGWRETEYTTPVVAPTAAGVPDPGREVTRERSDGHVATVAGWKGFSLGQDGFLTLTGEYKDQNHTERSGYDFRQQYPGSQPAAEAEIGRFNAWTGEPDLEQISLFANAGYGLANGAELYGWASFQDRETVSAGFFRRALDDRNTIEIYPNGFLPKINPTTTDYSALGGIRFDFAGWDADASLGYGSNKMEFQIIDTLNRSLGTASGTEFDAGGFEHSQLVANIGFVKGFAVDGLASDLNVAWGAEARQENYEIFAGEPDSYRNGGVLLPGGGSTASGAQVFPGFQPANELEEDRTAVGVYLDVEANVTDALLLSGAVRGESYSDFGEALTGKLAARYDFNDAFALRGSIQNGFRAPSLQQQYYTTTSTNFINGVPFDVTTFRVDDPIARALGAQDLDAEKSINYAIGAVFQAGAFNMTVDAYRIDVEDRIVLSENLTAGNVQDFLVSQGFIGSGGGRFFINGVETETTGVDIIANYAFPETEFGSFTATAGANFNKTEVTGVPAIPVLTGLTPPPVLFARTNILTLEEGTPKDKFTGQVNWEHGPFAGTLRAVRYGEVLVPSNTPALDYTLDPQTLIDLEARYTWNDMLTLAVGADNILDEYPDAAPLGLNSTGNTPFSSYSPFGYSGRFVYTKATLNF

SEQ ID NO: 426 - protein, 506 aa, Escherichia coli str. K-12
MSGTKRLLSYQATLTGPCTNTRSNGYFYNTQSHKYTFIFKSISQIGPGRLTLFFFQNNQTWNFYNGATKQETAEYGRRYSGNSADPGSPDYYGDNFKTFLNWQSYVKYAFHIGRLELSDQYYYFSGKGGGTFTQNNRAAPGGFYLATKLFPVHEFGNIFKARYPLGSGSLEAGVWADSDNETAFQYQSNLYNRFTGALVSAPVSQPVVTESVQPYVQGEWSPITTLRLTTGVKLLNLHRTWRDYVSKMERAANFNQWLPSFGVNYALQPNWHLYFNYTRSAEAPSSSQLTASYFNSGLQPEIANSYEAGTYWHQGAWGGRFTAFRTNFENYILSTPVVIGNQVFSTQSNAGAAIYQGLEFSNTYQITPWLSAFANFGILDARMTSKNQPALQAPHHTEAVGLNVKTAHWQGMLAVQQIGSRYYATGATGNSKLDGYVAGSLSVAYDTGELSLWKGYILPNLQISAHVNNLFNNDYALSASPSTSSAGAAYQLAQPINAFAEISTTF

SEQ ID NO: 427 - protein, 630 aa, Escherichia coli str. K-12
MEFFGEVGFVKDRSVSQIAESGAFFPQVDLSCDNPFLSPQQASVLCGPGGPATVSGDPNVWEGVYIGKRNVEGGPRQNDIQHLSYRGVFGIRGYLNDTWSYDVSANFGNVTLSSTYLNDFSITNIGRALNVTTDPDTGEAVCTAALSGVDPNCVPWNIFAPNITQDALDYLTLPLYANGETNLREYTAYVIGNLGDYGIRSPYAVGGVELLLGATTRSEELVFQPDSGFTSGDGAGQGGPTIGVSGSLSVDEIFSEAKIYLVEGADWADTLTMDLGYRYSEYSTAKETDTYKLALGWDINEMWKVRGSFQRSARHANIRELYQAQSIGLYDMDSDPCGGADPEATLEECQRTGVTSAQYGNIPQSPANQYNSISGGNPDLEPETSDTISVGFVYRTMEGDFDVSLDYFDIKVEDAIGIVAAETTLDLCLDTGDAQFCDLINRGPETGSLWLGQDNIIATNVNIGFEQRSGFDLNSSYTIRFDNDFGKLKFNLVGTYFTKFDTQPVVGLRVYECAGYWGGVCGAPNPEWQHNLRATWENNDGLAVSANWRYLGETQQLDSGPQDIDAENYLDLTARYRWGDNTTISVGVNNVLENDPPYLTGAPGSNGNTYPGYFDALGRYVFASISYQFM

SEQ ID NO: 428 - protein, 363 aa, Escherichia coli K12
MMKKVMLAAVLATAGVAAHAQSSVTLYGRLDAGIEYMNGLPSANGGSTSRWRAESGNWGTSLWGLKGSEDIGGGNKIVFQLEGSFDTMNGNGPGAGSIWNRWATIGISNDTYGTLLLGRELAIANGVWDFDPFGQSSWSTASLVRGRNWNKTSNNISYQSPKFYGFDVYGQYALSNATNWNGNGSTSQGRSAGLQLTYTTSLFQIRGLYDEARDPANGKLDDVFNYSREYFAGVNVFLGQFKLQAAYQASHADGGPVVNNGITTTQQVWGGVTWQATPAAALIAAVYHVNANHGGGNANIFTVGGSYNLSKRTLLDVQVATVRNSKTANFGLNANPAGTDISTGNPKFGGSQTGVYAGIQHLF

SEQ ID NO: 429 - protein, 927 aa, Escherichia coli str. K-12
MLRAVRRLALILSLIAAVLGTATALGPGTAHAGAGEGEGELAPAEEASPESELVPPTAKGSVAIQYPEALLEREEPPGGTVIVQYVVGVDGQTKELEVLQSVDPELDRIVVEAVDALEFEPALYRGQPVEVVLSVAVEIGPPEPAPEPDTDTETETGEGTLPGAFDSDGTQAPGDAEAPVAIRGRIREAGQRTPIEGATVIAVPAPEGWPLGQIRGKRYEEAVEPQWQVQATTDAEGRFELRGVPPGRVRIIALSRGYERLDSIEELAGGGAILELEYFDRRLPSNPYRTEVTVDRELPEVTRRTITPEEINLLPGTQGDALKSIQNFPGVARPPFGAGLIVVRGSAPSDTKTYLGYHEIPQLFHFGALTSVFNSDILAQIDFIPGNFDARFGNAIGGIINVQPRKGRRDGYHGYIDSDLFDTGVLVEGPIGKGSFALSARRSYIDALLLAVIPAGSGIDFNVAPRYYDYQALFDYPVGPGNFSVRVFGSDDQLEVVAPSVNEEEADANDGFDTQIAFHRVDMVYEAEQGPWSFLFTPSYRHEQLGGVGGDIFSFRVTRDVFNLRAELGYRLSKRAGLRIGTEVAAGEYSLEARAPGFPQPGQGDNGEFLAADLGGAFGSFSLYSTATIAASDRLVLYPGVRLAYNGVVLNRAGLDPRFRLAWKLTEDTTFKAGVGLFSQYPDVFELNDVWGNPNIALERSIHTSAGVAHMFDSIDLLVEGTAFYKYVYDLAVPTDVLLINNGAGATIVPERFDNAGYGHVAGVELLVRKNLTNNLFGWVSYTFSRALYDLDDGWGLIPFDFDQPHILTAIAVYKLPRGWSLGGRFRLVSGNPYIPVYNGIDDVSTGGTFPLEGPRNSERNPAFHQLDVRVDKKWTWRYVGLNAYVDIQNIYNRRNIEGRTYAYDYTQFNVLAGLPILPSVGLKLDW

SEQ ID NO: 430 - protein, 661 aa, Escherichia coli K12
MIHPRRCATMRPIVTTALMLGGLVLPQAASAADALKALPSPAMDWSGFYVGAHAGYVRGHADARLQDPTFAASQSSGSGGVTAGAQAGYNILTRAGVLFGVEADISFPSYLPANAVLSEFDNATSTAQQHIDFYGTLRARLGVAAGRWLGYVTGGLAYEHERYLTEPGAGKVLNGRIGWAAGAGLEYGFTPNWSARIEYLYSDFGNASVGLPTGARYDTAMNLQTVRIGVNRRIDWLGSGETAPFATVADPDSDRWEIHGQTTVVGQGYPSFRAPYSGANSLTPNAQFKSTWSSGLFANVRLWDGGELYLGPEFLQGFGLSDTVGVAGFPNGEGQKSGFAFPHISPSRFYLRQTFGLGGEQEQLASSASQLSGKADISRLTLQVGRFSVLDAFDGNAYAHDPRRDFMNWSIWASGAFDYAADKLGLTYGATAELNQKQWALRAGYFLMDAESNSNNFDMRLGQRGQYVAELETRYALFGQPGKLRTLAFLNSVYAGSYRETLDNPLLNLDISQTRRGRIKYGYALNLEQAVSDDIGVFGRWSWNDGKNEIMAFTDIDDSLSGGVSIRGLRWGRPDDVIGIAGATNGLSRDHRDFLAAGGLGPLIGDGALNYRRENLLETYYAYAINRAWTATADYQFIVNPAYNADRGPVSVFSARLHGEF

SEQ ID NO: 431 - protein, 616 aa, Escherichia coli K12
MFWKSLLVSPAILGATLVASANASSFDPVKSTSVSTEFNNLEIAQVQNTGAGTGELLNQIEQYGNEGQVAPVQGNTIDQVTSVNQLRDVSPTAWAYEALRSLVERYGCIVGYPDRTFRGDRALTRWEFAAGLNACLNVMERLIQDGVNVLKEDLDALKRLMDEFQAELAALGARVDNLESRVSFLENNQFSTTTKLAGEVIFAVTDTVGAGSPASQAAMQYRARLLLNTSFTGQDVLKTRLAAGSATPFGFDYKSTTTLQNGDPASVRFDNLQSPSLFQTWTAAGNGSNVVLDWLAYYTPIDLGYFGRFNTYVAAWGGIWNDFVPTTNPFFEDFDGGNGALSTFASENPIYRIGGGSGAGVSLQLGFLQSIVGPTSLSLGYLAGGGGSSSAANPNPGNGLFNGDYAALAQINANLFNFLNVGFTYVNAYQGADTAIFGNGGSFGVTGTSAANLSQTQLNTLLNVNGNDPDSVTLQDEVGFFNFGAKVSNSYGLTGAVDIGFASLSAFGSYSTVRLLGLGDAEVWTYGAGIAFPDLGKEGNILGLFAGAQPYIGHLSFRDMGLKVSNIVPYHVELFYKYQVTDNISITPGVIWISAPEQFKGTGNEWIGTLRGTFTF

SEQ ID NO: 432 - protein, 195 aa, Escherichia coli str. K-12
MSIKPLVFALLSVVSAVSFADENKAGKFYLGLDAGSGKVKKDPLTPNYRITSETDRVDGGRLYIGYQITPKLSVELGAVRPSDYKQSATNGVLSYNARVETKNHDLTLFYKVPELLPGLFVLGGVTYSKVVTSAQFTSVLLPSLRVSGSTRKTDTDFAWGGGYEARLFGNVDGRIMYARYAGTNLVTVGLKYRFQ

SEQ ID NO: 433 - protein, 1085 aa, Escherichia coli str. K-12
MKDAKVLIRDWNRHQCLMLFLCLFFLSAGVAPTAHAASEVTMGVDQELRITGVVKDTSGETMIGVTVMVKGTGTGAITDIDGKYSVTVPGSKSVLSFSFVGYTTKEVTVGNQKTINVTLSEDSKMIDEVVVIGFQSQKKGNLTASVASVGAETLENRPVANIGQALQGLVPGLNVSIDGGDPNKVPALNIRGATTFRQRGTSNDDKNKFDVVSGSPLILLDGVEITATDLNQLNPNDIDNMSFLKDASAAAIYGTRATFGVVLVTTKGGTFNQKAKIEYSYNLAFDQPYELPDILDSYHIYKAGLDKKLWTGDITEYSQHDKDMLDHMMAYINDPKNNKPYFMEGEAIQWVGNTNPYKELVKDWTPTQKHNLSISGGGERMSYYISLGMQDQKGMYEIRTDKLKRYNAMLSLNAKVTDWFNVGAKASYNVFDYDSPTQQTDGMNLWSYAKSYYPENYIYQPVLTGPDDPLPNHPTENTVSYLYANGRNITSRRKTILSLSPEFIILPKILKVKADLSVTPTTYQREKTHPMQERVNTSWTALENRWATENTGYIERSSTDQYSINVYADYNQTFAQKHNVSALIGFNQEQEKYAYSSISLVKMIDPYILNPTLVEDVTANTSGNGHHEISARALFGRIMYNYMSKYLIEVDARYDGSSKFPKDSRYQFFPTVSLGWRISEEKFMDWSKSWLDNFKVRASWGRLGSQPSKNYPYQSVFNIESGYFLFDGTRYPTGITTPSLTNPSLTWEKSTTKNLGFDFIFLQNRLSFTADIFERKVTDILIPGGKEYPALIGDDNLPLENAGVLKTTGFELQAKWSDKLANGLRYSVGVALSDDKAKVVSYPSNPTNSIGDGKLYKGFTVGDIWGYETGGILQEGDFDGVGANGKPLYHGPYFKGGQAYPGYVWYQDLNHDGVITGGLGTVDNPGDRKVIGNNAPRYRYNITANVQYKGFDLDVMFQGVGKRDYWLSSSSSYWGGGAGSWETYNDSWTPERTNAKFPMYGYGLGSYTQSGYLLDASYIKLKQVILGYTFPKNMINKIGLEKLRLNIAAYNLFTISDVPKYYDSDYISDAYPPKRTFSVGIQVGF

SEQ ID NO: 434 - protein, 723 aa, Escherichia coli str. K-12
MKTIFTTFALIGLTMGISAQETQQDSLEGKKITLDEVFVSGVRVTKESPVTFSNLTKEDVKSRNLGQDIPILMNFLPSVVTTSDAGAGIGYTSLRVRGSDATRVNVTINGIPYNDPESHGTFWVNMPDFSSSTESLQLQRGVGTSTNGAGAFGASLNVLTDGYAEEAFGQISSSIGSFNTLKNSVKFSTGLLNDHIEIAGRLSRITSDGYIDRASSELDSYFLQGAYKSDNTLVKALLFGGHEITYQAWYGIDAATLETDRTFNPSGIHTDENGNTRFYEKEEDNYKQNHAQLLWNQKLNNDWSTNLAFHYTKGRGYFEQFKEEEDFSTYGFQPFTVDGEEINTTDLIRRRWLDNDFYGAVFSTKYSNEELDFILGGAWNKYEGGHFGEVIWAEYAPGSRIRNRYYDNDSEKTDFNIYAKANYKLDENWSLFGDLQYRAVGYQANGEDTGLVDDTFNFFNPKAGITFDLNQNNNFYFSYAQANREPNKNDYENGSPKPEKLNDFELGWRYVSPSVKVNTNVYYMGYKDQLVLTGELNDVGAPLRSNVGDSYRLGLEIDANVSLGNKFAIGPNIAISSNKNRDIVFQRDGVLQELGNTNIAFSPGIIVGNRFDYLPNEKLQLSLLSKYVGEQYMGNIDSDGSKLESYSQTDLNVQYLIETNSFIKSIALSLLVNNILDKEYVSNGYFYTYDDTWSVPNSTTTIEGAGYYPQAGINMLLGATLSF

SEQ ID NO: 435 - protein, 909 aa, Escherichia coli str. K-12
MSLSRIVKAAPLRRTTLAMALGALGAAPAAYADWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQTSIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKCLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIANSGFYLDATLRASRLENDFKVAGSDGYAVKGKYRTHGVGASLEAGRRFAHADGWFLEPQAELAVFRVGGGSYRAANGLRVRDEGGSSVLGRLGLEVGKRIELAGGRQVQPYIKASVLQEFDGAGTVRTNGIAHHTELRGTRAELGLGMAAALGRGHSLYASYEYSKGPKLAMPWTFHAGYRYSW

SEQ ID NO: 436 - protein, 680 aa, Escherichia coli str. K-12
MYTPNHPRALLGVALLALSAGARAEDETMTVVGKRSQHEEVATATRTNTPAKLVPQAIDSVKASELTAFGQPTLSEALTGIPGVNASGDTRFDSVNIRGFSASNDFYLDGFRDDMQYTRDLGNIERVEVLKGPAAVLYGRGSTGGIINRVSKKPQKGQESSVTALVGSFDTRRVAADLNAEAGERVQLRLNLAQEDKDSFRNDVTSKRTLLAPSANWEISDKLNWLVQYERNAHDRTPDRGIPGVNGRPADVPKEYVYSDTRRDFIDDVAQSTRSRLSWDLNDQWQLRQQLGYSTLDSQFDNTYVTSVKGDQVTRARWQQDLKANSLISNTEAEGQLQTGPVEHRLLIGFEQNWQERTPKLYQNASPIPAGNLYDPGSLPTYDGAMKLSSDANHKVRGYGLYLQDQLSLGDWHLVGGLRRDDFTVTSRRNDLNKEETLSVTSLSPRLGLVWNPLEDHAFYTSYSKTFTPVGGELIGITPGDKNNALDPQNTRLYEGGVKSDWLDGRLATTLSLYRLEMYNKRSKDPLDPTKVTLTGLQRTNGIELSARAQLTDELYLRGGIAIQDAEQVKADADLQGKRPMNVSRQNGQLFAGYESGQQGWFGETGVTAVGDRFADNANTTILPGYARFDARAGYRWQQWEAQLSAENLTDHDYFVSATSASQILPGTPRQLNLSAAYRF

SEQ ID NO: 437 - protein, 1076 aa, Escherichia coli str. K-12
MKKEVKRSWLFFLWVLCFMIPIEALAQRITVEGIVTDSNGEPIIGATVIEKGNKTNGVVTDLDGKFSITVSEKKKVLVITYIGMKPQEVVSQPGKLLKVKMEDESQLLDEVVVVSVGYGNARKRDLTGAISSVGENTLKNIPVTSASSALTGRLAGVSVITSEGSPDASVSIRVRGGGSITQSNEPLFIVDGFEVSGIDDIPPTDIESIDVLKDASSTAIYGAKGANGVILVTTKSGRTGRTEVSFNASVGFSRMYNQTEVLSPYEYVYLQRELDSSDNAGFFDKFGRWEDINNYKARVGTNWQDMLFGNTGIKQNYNLNISGGSKDLIYSLSYTHDDESYIMSVSNFKRDNLNLKLTKKFGDKLRLDFNAKMTNRVVDGPSVSSGSKLRDAIKYPNIGTLTDLSDEDLAGDDEILIENISNLNDPMFNITNEYKKQTKFNNNYNVALIWNIIKGLEWRAEGTYGYSYDRTDNIWLANTGEANSKAGQPVARRQYWNGNNWALRTILNYKFDIQKKHRFGIMAGWEAKHSQRDEMEINADYYPADYTVDNILAMWNNGTSEPTYTTIEEPSRSMSYFGRLNYIFNDRYYLTFTLRSDGTNVFAPGNKWGIFPAGSLAWRISDEKFMDSVRNWFNNLKLRASYGKSGNARVGSYWRQTYSPVTNTKNLYYQNEIGQSSLQPSTRLRNENLTWESKYSTNLGLDMTFWNRLNVTFDFYNDVTKDLIMEIQLPSVSGYRTQYQNLGQTTNRGVELSLNANLINKKDFFLDFNFNIAFNKNRVDALYGSEDTEMIIKGDKVEVGSDNYRVFVGQEVGLMYGYVCDGMYTFDDFNFDETTQRWVLKEGVPDVTEELLTNSGQYFGPGHLKLKDLNGDGHLDADNDRQVIGHALPKHTGGFGISAGWKGFDLTALFNWSYGNDVFNANKIDYTSFVGSKRYQNMSSEMSLANRFATIDPETGYNIYYGAHADPVRLQELNANATIWHPLMNNSIMTDWAIEDGSFLRLGTLTLGYTLPQNLTRKFGVRNLRLYATGSNLLCITGYSGQDPEVNTSSNKMVMGFDYSAYPKSRSYIVGVNVTF

SEQ ID NO: 438 - protein, 495 aa, Escherichia coli K12
MQMKKLLPILIGLSLSGFSSLSQAENLMQVYQQARLSNPELRKSAADRDAAFEKINEARSPLLPQLGLGADYTYSNGYRDANGINSNATSASLQLTQSIFDMSKWRALTLQEKAAGIQDVTYQTDQQTLILNTATAYFNVLNAIDVLSYTQAQKEAIYRQLDQTTQRFNVGLVAITDVQNARAQYDTVLANEVTARNNLDNAVEQLRQITGNYYPELAALNVENFKTDKPQPVNALLKEAEKRNLSLLQARLSQDLAREQIRQAQDGHLPTLDLTASSGISDTSYSGSKTRGAAGTQYDDSNMGQNKVGLSFSLPIYQGGMVNSQVKQAQYNFVGASEQLESAHRSVVQTVRSSFNNINASISSINAYKQAVVSAQSSLDAMEAGYSVGTRTIVDVLDATTTLYNAKQELANARYNYLINQLNIKSALGTLNEQDLLALNNALSKPVSTNPENVAPQTPEQNAIADGYAPDSPAPVVQQTSARTTTSNGHNPFRN

SEQ ID NO: 439 - protein, 245 aa, Escherichia coli K12
MGIYFRERSDIIMKKQLVLAVAAGLGIACMGAQAYEQGDIIFRGGIATVAPSGDSDPIELPTDPPTVLPGGVDVDDGTAISLMGVWMMSDNWGVELLAATPFEHDIDLADLPVAAGSTKHLPPTVSIQWYPRGGMQGWQPYLGLGVNYTTFFSEKVDNELGAVLGDLLDVTSAKLSLDDSVGLAAQAGVDIPLNDKWALNLGVWYIDIGTTADIDVTTGSGANATVSFDVDIDPWVYNVGVAYKF

SEQ ID NO: 440 - protein, 1147 aa, Escherichia coli str. K-12
MSAFHLRKRNLTRYLPQSNRILNLGTAFTFLTAFQLYAGTSYSQTTTLSLSLKNATLEQAIDRIEEETGYSFLYADHVLDVSRIVNLEANNKDINLVLSRVFDNMNVDYKIVDKQIILSRKLESIPLAQQQGRMVQGVVLDSNQEPVIGANVLVKGTTVGTITDIEGRFTLEVPNNAVLVVSYIGYLSTELVPGSKTDLTISLKEDSQNLDEIVVVGYGVSRKKDLTGAVSVLKIDDLKDTPVSSVDQMMQGKLSGVNVMPDNMPGGGVAVRIRGFSTIRNNDPLYIIDGIPVDGGINFLNPNDIESMQVLKDASSASIYGARAANGVVIINTKRGKEGEFNVNLDAYFGVQKAAKQLRMLNAQQFGDMLWQAMKNDGKTPSHDIYGNGDQAVVPEYLDSDHLIPSDDVDWVDEILRAAVVQSYNLSFTKADKKSNQLFSLGYYDQQGLVKFSDFKRVSGRFNSEYKLFDDHFRIGENISLSHSWGTSVSNNAALGGTLYEAYKFQSITPVKNLEDEYAGNVFSDIPNPMGKLYRNKDNQDKKSRLVGNLYAELHLFDGLMFKTSFGVDYNNLYRRSFSPKYDELNASEKLSSLSNRNAWNFNWVFTNTLTYNKTFGDHTINALLGMESLRNRYEYFTASRDGFPSDDPNFRFLDAGDVGTQKNSGAATEYSMVSYFGKLDYNYHDRYLVAFTLRRDGSSRLGNNKWGNFPAASVGWRISNEPFFDVEAISNLKVRVGWGQNGNSDVPSYATIDSYKSNSTNSNYPIDGNQSGVDLGLVQTRNGNVNLKWETTTQTNVGVDLGFLNGDLNLTLDYFNKDTKDLLWRRALPASIGGTNMTVWDNVGKMNNKGFEMEINYQKQINQDFGFSVAYNFSVIKNKMTELNGVDYIGLSSSELHGRNFDQETSRSAVGQPIGSFFVYEADGLFQSDAEIQNYKNDRGELLQPNAKPGDIRFKDLNGDGVINSDDRDFKGSPLPDCSMGLTLGFNYKNFDVSAFFQGVFGNEVYNLTNYLGEFYNQAQYNKNSTILDAWRPDNTDTDIPRVTLDDPNNNIRPSTYYIHNASFVRLKNLKVGYTLPDKVASKLKLKRTYIYLQGQNLFTITGYEGIDPEVGLQSYSSENRNLDMGVDRGVYPLPRTFTLGVNVSL

SEQ ID NO: 441 - protein, 949 aa, Escherichia coli str. K-12
MDDIIVTAQKREQSVQDVPIAVTALSAEALQSRQIDGGSELLRAVPNVTFSKSNFSMYNFSIRGIGTKAVSASSDPAVAVSFNNTPLIRNRLFEQEYLDVARVEVLRGPQGTLYGRNATGGVVNMFPELPKFRSEGFAAGELGNYDSRRGQAMLNVPFGDTFAVRGAFGFTQRDGFDYNSFNDTHVNDRDLFTTRLSARWEPTARFRANAIWEHFEEDDNRSRTGKQLCTTDPGPTQVGSASITTAYTQDQLSQGCLPGSLYADAAYGAPNGGSFGPVRLLGTAPNLGFGPNFESINLIPLGFDPYEGVVQSRDLREIATSYDPVFRAENDVVQVNLEFDLSDTLTLYSQTAYAKDDYYASQDYARYVSNPAFVDSNSVLDIFGDPAPSTATPGGVYTDPQLGPSDRILAVDISQSDNRQWYQEFRLQSKGEGRFNFSLGANYLDFKSQDDYYVLNNTFSLIAEYFYNFDYLPNGGIGTRPCDDTQPFECVYVDPNPLSEINGEGHNYFRSKNVIHTRSWAVFGEGYWDLTPELRLTTGLRYTEDRKDTTPYPSQLLLGANLNGDPGLATGGYVRSGYYALPDVEQKWEAVTGRIVLDWTPDLSFTNDTLVYASLSRGYKGGGTNPPRLDLNPTVVQYQPLAGTFEPEYVNAFEIGTKNSLLDGMLRLNATAFYYDYKDYQVSQIVDRISLNENFDAKIWGLELETVYKPTPNFQIDANFGYLKTRVADGEGSIDVMNRTQGNEDWITLRPWIQVPSNCIAPRDLAEQILNSPFGTELAIFSLSALCAGSSRFGTFNPDLASSLPFWQFYGFTYDPLTEAPNGGRGFEADLSGNELPNSPNWTANIGAQYSWFLGDWDLTLRGDYYRQGESFFRVYNTEYDRLEGWDNLNLSVSLTNEARGLKLQAYVKNVFDDAPIVDAFTNSDDTGLTTNVFTLDPRLFAVRLTKSF

SEQ ID NO: 442 - protein, 313 aa, Escherichia coli str. K-12
MKVTHQLGSGLSAVSGLEIRFDSEDNVFSSGKFGNPTTNKLFAGLAYEGIGTLTLGKQATNGDDVQLNDNAYAWGADNNLLISAEKSIKFRSVEWHGFSLGLDYVFGNANKKTSVKDNPLGNYEDKYAYQTSLFYSRALAQDLMLNLAAGYGVNKYDYESTRTAYTNITWRTAAQVVYGSMSFGAEYGKMISKEHDTKEKTIQTLLVSASYQVTEPSKVYVQWNNLKVKNHLAFGTEVDYLVVHNWKKSVDTLIVGADYKLHKNVLAYVEYAYEKAKATSDIYDYQVNPTVKVFSTNHQVKNNKLGVGLRVFF

SEQ ID NO: 443 - protein, 880 aa, Escherichia coli K12
MMDINKKAFLKITGIGRAVFKKSLMTISILLLNLVVPAFATPELDDEVITERSIERIEVRGIRTSMKDSINSKRFSDAVVDAVTAEDIGKFPDSDVGESLGRIPGVAVNRQFGQGQQVSIRGASNQLTSTLLNGHSVASTGWFDQQTTDRSFNYSLLPPEMVGDIEVYKSSQADITEGGVGGTVIINTRKPFELDANSLFFSHKQDYGSVSEEIDPEFSGLYSWKNSAESVGILLAVADGKTHYQRNGIESNIGWGDIVPTTFEQQRERTAINAVLQYRPTDNVELGFNMMHLDMQANNANTSLFLMFPDDKEAACEQRNQAGTCIFYRRDANDANPGWAQTWVREASMDSKTFDLDFTYEADNYTLEGLVGNTKSEGGTNTTANYGAWLGQARDFAGTYDATGDVIDIDIANPSFGVEDFNGPLAPEAWSLRKQPNSDEETYIKFDIDFPVDYGFITAIKTGVSWANHDVKQESFEGIASPNVIAKDASAYYSGSVSSGGGFTLPKPILDAMLNDAKAAITHFDRDGQVYKSGYGTINEENLALYLMANFASERIRGNVGLRFISTDAESDFYQLKPDGSYADELSTLTASYSDLLPSINLAFDLAPDIIIRASASKVISRPNYDDMFSASALSGYADGIPDNEVLDRGNIALTPFKATQADLGIEWYFAAEGLLSATYFIKDIGSFITSEQLLDQSIGIIDPDSGEDSWTVSTKKNGSGGQIQGLELQLQNGFENGLGYAVNYTFADSNAPAGHYPDQVSVFSDSSKHTVNLVGYYEMDSFSARLAYNWRSEYMIRELPGYYGNREHQAYGTVDLSSRYNITEHLAISFEVVNLLAEDSIQLGVAADSAEVKPELQNNYPVFSAEGEARYKLGITVRF

SEQ ID NO: 444 - protein, 575 aa, Escherichia coli str. K-12
MKLISNSIYVGSSFLMASSLAIKPALSDQYFQSVKTDAGKTYCIGIERGFLDWPGPQFSDGGNQGKWSLDDQDWYVGYQTSKRGALAKELSNKSGFLYAFGTNVDNNIEWRNSGFRQQTYYSNSNNSEPGLKNVGNFAKAFDSEQCESPDPILPINPGDITVPLDPANPDNEVQPSQPTLIDYLSGIDRETRLRNLGRAVNALVIPRNVTASGLATQAYVNDLSDTILERLPSRQLKTELSEVNSQNQDSNQEFEIGGKKYFESSDLQSSFLESAGTRGWVRGFGGSNSPSKTGGLTRNNIEYPDVYNNFYSTHGGFVVGIDTSITENIQLGFFGNYGNISLQQFSGDYTGGGSWNPEGWGGGISASYWTESFYIQGLFGATSFSGTNIREVKIPRIINENYRATKNTTSYMGALRIGAPLTSGRTIIEPQFTAIWNGIQNSEFTESGRFDSLALKTNSYYEQFLQTALGAKLSWPIPQKNGNLFTPTVRVAWLADWNTGNGDISFELANAKNSVKAKIPSNQTNENGVLLEGGIDYAIFNGPTSGWKLYFKGGAKIWANRSTDWRTSGGLTFQF

SEQ ID NO: 445 - protein, 1066 aa, Escherichia coli str. K-12
MKIKTFSALRASAAPLALVVAGFTASTAFVAPAMAQDYTRGNLVGEVLDGNGAPVSGAQVTIRSNEQGFTNTTTTDSSGQFRVTALPTGTYSVTVTVDGAVVVQDNSASVVAGSNNSYRYSTGEAAAGGAIVVTGSRIKTNDFAQNTSGLTLNVQEVAESVPIARSQSALILLAPGTNAGDTGFGDCPDCVSFGGASIAENSYYVNGLNTTNFRTFVGNNVVPFEFYRTFDVKTGGWSAEYGRALGGVTSAVTKSGSNNFEYGAVVAYTPDFLSEDSPNTYLDDTGSLKSLNSRDYRERLEANFYLSGPIIKDRLFFYGLVTPRYSVSEDTSPSSGYRVRAKSNTPFYGGKLDFIPFDGHRIEGTFWSDERTINYDYYNVDALGNEKTGIITGINREGREINKIGGKNWIVQYTGQFTDFFTLSGAYGENRYKRYDVISGGDSAVPTIQTQLAYDGNGEPVTSLKTIAGVPVSPTDGQDLRKVMRIDADLYVNLLGSHHFRFGFDREDLSVTEDTFYTGDRTYRFTANYIRTRTYLNEGSFKTKQTAFYIQDSWDLLNDRLNLQLGVRNDQFQNYGITGGKYLDLKNQWAPRLGASFDVFGDKLTKIQAFWGRYYLPVATNTNIRLAGAETYYEQRFGYAPGVVGSNYDTNGVPIGQQFDSSGAPILGSLTGANSLNCPDFGPGAGQKCRTVFSDGLPGPTDTLVSSTLKPMYQDELIFGITHRMEDWTFGLRYINRRLKQTLEDIAIDEAVNRYCEQQNLDCATSSGSPIWSGFHQYVLANPGEAVTVRLDGDPTKPGTTDVVTLSPELLGYPKAVRKYDSIEFTASKAFNGTWGFDFSYTWQKLRGNYEGSVKSDNNQDDAGLTQDFDVPGLTTGSYGTLANNREHTFKLFGSWQPVDWLRIGANLTVQSPRSFSCIGVAIPDYIKLLQAGESAVLNGGAASQYGAASFYCRNPKGNQNGTTVTNDITGETSVLVNRGTAFKSDWSKNLDLGFQFKLGEALGNSNFRIDVFNVFNWKSKTDFVEFGETDSGATRADYRLPTGYQAPRQVRFTWTMRFGANNGAD

SEQ ID NO: 446 - protein, 906 aa, Escherichia coli K12
MEGSERVMNTKCGPRPCLWLMVPIALGFSLSDTAVTAQPTVRTAIAPQSTSAQIGGEGAKALLRSAAGTAADLEHRPALWDWTRPLSAPAKVSQAGGAASTAPAAVSQGAAAPGESADILDEVSVTATRRPTRQRDTTATTYTVKRADFQVQGARTVTDALVLIPGFEGPPSLGGVRNSGFNFLRGFDDQRFLVLRDGVSLQRSGNNRSDITRFNVDELESIEVVTGGATLRYGSGAVGGVINLITETPRGLPKLTLAYEAGSYGFSRYLAKYGGGDDTLSYNLIFASLVAFNNYPYSFTLPNQARFYGPTVNPNAAASGLAFDADGNPISSFGQPNPDPENSGDIDLYGYLKPEVGPPITVKGVADNAFNANDSYAGKLVFKPDPANKLTLSLHQQNSKFSNDGPGAYGFIPCFGGALPPGVDNGTLSFSRFLPLNPDGSESACTVTPYIVNTASVNLGINSLLGNYAAPYTTSLDGRVNFPAGSAYPNAEPATGTQVSYRVDNQTQTEAALFWDYTLTPTASINSYISYYRLTSTAFIAPLFFNTNFFGAGESPFAVFQPSQPYNEGNKLEIQSALNTQLSAGQTLSFGINFVQDRSYAQVGGGTRFVDSAISRTSAFLIDDISFSDQLKANLGFRYTYSTQFGSVGTPAVGIRYTPTNFLSLRANGSYVFNAPSIADLTVTGGFLLANPGLRPESGVTYDVGVDITPAQNLGVQVTYFNTYLDGFIGFAALIQDGNLRFQRQNQNTRIASGIEVAANWQLTDQLRLRVAYTNTDARNVGAVDSVEQSTYPYFFQFQDQSIPFNKIAAALSYANQRLNASLLFRYDDGKRRGVTGLGGSTDFTPSFATLDLNVEVPIAQNFTLTGSVFNLTDTQYEYLSGIPAPGTTFRIGGRIEFGGGAQGSN

SEQ ID NO: 447 - protein, 472 aa, Escherichia coli str. K-12
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 448 - protein, 689 aa, Escherichia coli str. K-12
MNKVLPIKVLIMSMFSTSTLLAGDLGLQGIDVTAPASTYSNSYSGSATKTNTRLIDLPQSVNVINQEQLKDQQATSLGQSITYAPGIDLDQGEGNRDAFIIRGNKTTADLFLDGVKDDAEYYRDLYNIERVDVLMGANGILFGKGGSGGIVNRVSKQASFTDFNSYSLQLGSFDSKRATLDINRKITDRFAVRLNVLADKGDSFIKGVNYEKQGINPVFTYLLDDKTTVKFGREYFHDQRIGYRGIPSKNGRPYNGNRGTYYGAASASPNEVSVNSTFFNIEHYFSDNVMIKNTTRYTDYDKYYQNVYAGSSVSSSDTLTLKGYYDNTQRQNFFNQTDVTWNFEMGGLEHTLLTGLEVGSQDNRRYRLTAANQTVSIHNPVSSGWNFNTYARDKRTDIRYTSLYIQDQIKINDQHQFVMGLRKDHYETDFNNVKDSTKFNIKDNMLSSRIGYIFKPSENISYYVSYSNAYQPRNGDQLDGISNDNVNQDPEKFVNYEVGTKIQFHEQLFGTFALYQLERERMQITDPDDVTKKIIVDGQRSRGLELTLNGNLTDRYSVLAGYNYVNAEITKDQGVGSSAISKGTRLGNVASHNFSIWNKYEFNSTWSAAIGMIGRGEMYAATPTRSTSVTIPGWVRMDAAAYARIDERTRVQFNLENLLDKTYYSSAHNVNNIMVGMPLNAKITWIRDF

SEQ ID NO: 449 - protein, 612 aa, Escherichia coli str. K-12
MSKRSLNLWLLSPAVLGASLLASLPAVAEISATETGETELTTNNAITIASIEDVTAELPQQLAQVPVNPHAGGVFSQGNSVADRGTEIPLADLDAPSSDGNTLNQLNQYGREGQSRRQSQVTSVSQLSDVQPTDWAFQALQSLVERYGCIAGYPDGTFRGNRALTRFEFAAGVNACLERVNELINAATADLVTREDLAKMQRLMEEFAAELASIRGRVTVLEARTAELEANQFSTTTRLHGEVVFWPGDSFGDRARHNAAGGPFSRRNSDPTETYLGYRARLNFDTSFTGQDLLRTRLQALDIPNLSNDELTNSLMARTAIDGDSNGVELDALFYRFPAFNRRAQFFIGANGLALDDTMEVITPLNSDSTGSISLFGQRNPATFRGPEGAGVGANFAFGNQDRYRLNLSYLAANASDATAGNGLFNGSNTASAQFVFEPTEKLVFAVEYARKHFTNGGVEVVEVAGGTGSWIADRPFGDNATTSDNLGFQFNWRVANSFQLGGWFGATWANQQNNGSDSAAILNWAVTLGFPDLLREGDTGALIVGMPPKVIFHDRPSLENRDTSLHIEAFYHFPFSEYISITPGGYFITNPGHNDRNANIFVGTLRTTFQF

SEQ ID NO: 450 - protein, 1097 aa, Escherichia coli str. K-12
MPQQILENKNLILFLNLKFNVMKRRGLIFNSQPNKAVIVALGLMLMLCPASRTWAYANVNDSRTIAQSQKQVKGQVVDATGEPVIGASILEKGTTNGVISDIDGNFSLNVSSPNAVIVISYIGFKSMELPASDPKLRKIIMKEDTEVLDEVVVVGYGTQKKESLTGAVTVVGAKQLENKGTMSSPLQAMQGTVPGVLITRNSGAPGDESWGMKLRGASSSNSTDPLIIVDGVEYSDGINGMRNLNPDDIESINFLKDASAAIYGSKAAGGVVLITTKKAKAGKTVVQYNGSFTGKVVGLQPELMSLDQWADAVITAQTNDGYSDSNWIRYARLAKLYKNQYIDLSHSAHPIPEGFKDVEDFVFMDNDWQDILWGNSWSTQHDLSVSGGTEKNLFRLSLGYMYDNSTLKWGNNNNQRYNMRLNNQFKLSDAVMLTSSIGYNRQDQVSPSMIGKVLSQSSPQPGLPASTIDGRPYGWGTWRALNWWAEEGGDNKLKVSAINISESLNWKIYSDLDAVVNVGYNTSTATREKVEKSIDWYNYAGTKLLATEPTQEKSKYSDSFSRTDYYMVSGYLNWHKTLAEVHNLSAMAGTQYNYTQYKYTFVSVKDINPSLEIPNGAGEVLIKDGDSKPAKWHEAMMSYFGRLNYDYKQRYLVEGNLRYDGSSKFRPENRWQFFWGVSGGWRLSEESFMQPLSSLVSNLKLRLSYGVLGNQSGVDRYDGTQLYNFSSSSGAYIGSGKVSTIDTNGKIVTTDRTWERIHSYNLGLDFGFFNNRLTGTVELFMKKNNNMLIDAQYPGVLGDNAPTMNLGKFEAKGWEGNMTWSDKIGPVQYHIGGTITYTTNKLIDLGATSVLKSGFVGKQQGYPLNSYFGLRYVGKIQTQEELEKYKYYYLDGNGIGMQDNLRLGDHMFEDVNGDGKLDQNDYVYLGTDDPKLSYSINIGLEWKGFDLSAIFQGVGRRTVFRGGEGNETWRVPMSAIYLNTTTQSIGNTWNPENRNAYYPSYTSIGSINNYNYQCSSWSVENGAYLRLKNLTLGYTLPASWLAKTNAISKLRIYFTGADLWEHSKLRDGWDPEASRKTKDLGRYPFNRTFTVGVNATF

SEQ ID NO: 451 - protein, 730 aa, Escherichia coli str. K-12
MKRANMKTHLLCSAGLLAITAMGHSLPAIAQENDTSADEVSRTLETVTVTAQFRDQQLQDVPNSIVAFTAQDIEDAGIRSTEDFIALTPNVSFDNSFTYLNSFVVVRGVTQINNADSPVAIIVDGVPQNNQKQFKMPLFDVEQIEVLKGPQGSLYGRNAIGGAINIVTRQPTNEIEGFVSGGLSNGSGYRMEGGISGPVIKDQLMFRLSGSYYETDGLIENAYLGRTVDTVDHDYSIRGKLAYTPNDVFSLDLRAAYTDARAGAAYDAVVNSQLNPDFRSGNDSNDIFAPASNLAGITEADILDLSGKASLDMGFATATYILGYTDLTETYRSDLDFSNPDQPTFGPFGQLGQGQNLSLDLLSQELRFVSPDERTFRWIAGGYYLETDRSLLTRGFLDLTGSVDQFDTGIAIIDRSEDNDNTAWALFGQAEFDLNDRTVLQLGARYDEDERNQTQGAAGPVRTRSFSAFQPKITLSYDILPDVLGYATYSTGFRSGGFNAPGVVLDSFGDETLTNYEAGLKTGFADGNGTLNIAAFSSESEGFQFFFVDASTVSQIISNLDKVDLRGFDADFRYRVSESFTLSGGVGYTDSEIRSIGNAQLESYLTASGVDTDAVIGSRSPKTTDWSVSLSGQYVRPVRSGLDAVLRADYEYQGNKYWQIDNLDVRDPVNLLSLRFSLESDIWSASLWGKNILDEEYYADFNPAEYAGAPFDLGSQARPATYGVDFKYRF

SEQ ID NO: 452 - protein, 481 aa, Escherichia coli str. K-12
MVPKLTPWIALGLSVVPATAQQRVPSAFEGAGADPRISVSQPETTSQASGGYVRSVEPYLGPLGDPLALRPALKARGIEYSLTYIVDVLGNPVGGLRQGAIVEDRLNLRLNLDLDRLVGWQGATVHANAYFIHGTGLSRYYVGNLLTTSVIEALPSSRLYVLWLDQSLMDGQLGIRIGQQAADTEFFVSQTATLFVNSTFGWPAITGLDLPSGGPAYPLAAPAIRAKYVPGNGFSLQVGLYDGDPAGANRPGDDPEAQRLDRTGTNFRLRDPALVIAEATYAYNIAPGSKGLPGDITLGGWQHFGRFDSLRFDITGVPLADPNATGIGRPVRGNAGLYAIYDQTLYRESGKDDEGLGFFVRAAWSPTRSSLIDAYVDTGLAYKGLFDGRDDDTIGLSFAYARIGDEAQRADRDTILYTGLPMPRRRAEAVIEATYQAVVVPGFTVQPDAQYVIRPGAGIAGPDGRRLRNAAVLGLRATVQY

SEQ ID NO: 453 - protein, 251 aa, Escherichia coli str. K-12 [sequence omitted]

SEQ ID NO: 454 - protein, 338 aa, Escherichia coli str. K-12
MKALPSIAAVCSLSIAALGHPIAHAQDMQVYGQIRLTVNHLKTGNAGSTMEERDNASRLGFRGKEELGGGLQALFGMEMGLDADTGSLTTPAFRNSYVALRGSLGTVALGRLDSANPTGSPLYSQVTGITSFAANDAGATAIGTSMLNARNRTSNSLGYQSPSWGGTVFRARYYLRGDAKAPGLEDDARSLDLGLSYAAGPWTAGLGYAKDTRAGGLLANEFDSKWQMGLRYSFGAIEPYVLLGRDRFNHKPGVSRADVDYWMLGTRLRHGAHAVVLNLMQRDVQTSLTGKRRRQQLAYTYALSKRTELQAFVDHDGVDSSRPNVAVRAIGAGVRHDF

SEQ ID NO: 455 - protein, 1083 aa, Escherichia coli str. K-12
METKFFEEGKITSKRIASMLLAGICCISTFAEEGNSRTVVGKVLDNSGFGLPGVTILQKNTTNGTVTDIDGNFTINVSDPTKSTLVVSFIGYDTKEIKLTGNEPVSIVLHEDVQALDEVVVTALGIKREKKSLGYAQQVVEGNNMNVGNDANVLNKLAGKVSGVQIISGNSGAGSSTRVVIRGESSLSNNNQPLYVVDGVPINNNIYSNLSGTPQEIDYGNGAGELNADDIESISVLKGANAAALYGSRAANGVVLITTKSGKTKNKFQIAVNSTTTFEQVSRLPKYQNSYSQGLDGEFEYWDGNNGHGTQDHQDMSWGRPLDGSLVPQFDSPSIGADGTIYRGGDVAARNGAAIQGTPLIAHPDNVKDFFETGITYNNNIALSASNDKGDIRISYTNLYSQGVLPNVDLRRNTVSINAGYHFTDKFSAKTSVTYMNAASSNRPSMGYGTENPMYTFTWFGRQVNIDSLRDYWQRGYEGTKQFHFNSGWNDNPFFTMYENTNGYDKNRMFGNISLSYDFLPNLKLTARSGIDFFYDLRQSKRAYSTKNFPTGAYKRENVFFSEWNTDVLLQWNQTFNEIWRVDLTGGANSMIQKNMYDYAFANGLSIPGVYNLGNASSNVSVIQKDSKKRINSILFTGQLSYHDYLFLNITARNDWSSSLTRSDGSGNNSYFYPSASISAVLSDIFELPQPITYWSLRGGYAEVGSDTEPYRLENTYSYSNPYGSQSGVTMPSTLSNNDLKPERMHSYEIGTDFRIFDNRLEIDFTYYNTLNKNQIVQIPISSTSGYDTRYINAGAIRNYGFEATLSYTPIKTKTGFQWDGSINFSMNKSKVEEISDEYDQYVYSWAAIYSDQDARVYAIAKEGEPMGNLYGTGFKRTEKGEIIVDATGLPIADPTLVKLGNYNPDFIMGFYNKFTYKNFSLDFLIDWHQGGVFVSRTFGMGMESGVLDKTENRNPEDMVIDGVIWDETKEEYVKNTIQVSPRDYYRNLYRRYHETQSTFSATYVKLREVKLGYQFPSKWLSKTPIKNLGLSFVARNLFMWTKDQDYVDPEAITYEGASATPGVEEMSYPSTRSFGFNINVVF

SEQ ID NO: 456 - protein, 927 aa, Escherichia coli str. K-12
MTPVATDSQRYIARNLLCASISGVLLVAAVSVQAQETNAASNLERITVTGSNIPRTDTETASPVQIVTREDIARSGRATVGEYLQTLTSDGQGSIPKNFGNGFAMGGSGISLRGLGAGSTLVLINGRRIASYGLADDGQKLFADLSSIPMDAVERVEVLKDGASSIYGSDAIAGVVNIILRNDFQGALVSASYGLSGYGDGHTPKATMTAGVGNLASDGWNALVSVDVGKSDGIMTSDRKDRKWIGTGDIRPWGYDLANSQQFLRGAITGKGTAADSSPVGAVRNPSNNQFSSLPGCSNFSSVSPQDPGGGCLWDVAQFRSLTPDEKYANVFTRGTFTLFDTTELYTELSYSKKKSEFSNLPSAVSGAWGYPGGAVNASSGDGATVLAPGHPDNPYNVPARVRYAAFDVGPRVKEYTNDFMRVVLGIKGGVAGWDYDVSALHSQSQMDRKFTGYLRYSAVRCVLGNLACPAGVWNIGKGSETNPRSLYDFISPVLSSQAKTKLDVFDARLSRALADLSGGAMGLAMGVEYRRDQASLTPATYTDIGDIIGLGYSAYSGEEKVSAAYAELAAPFTKAFETTVAARVDHYSGGSTAVTPKFGMKWKPFDWFALRGTYAQGFRAPNAAESGKGGLAAFASVSDPVRCAAAGGSGVECAPRLVSVITTPNPDLKPEKSKSYTLGMVFQPTSSTSMTVDGWQIKRTKEIAQIGTVDAIKAGDVIRDDNLLNGVAGTGQLLGVKAKYVNLNATTARGVDTDVQQRIAMGGLGDLILDLQWSRMLKFQREEANGNISEYAGTHGNCDVSNCIGTPKDRINFGATWKLNNISVSALGHYRGPMENRLFKGGACVSHFADGSDAPIDCRLNAFTSVDLSANWQATEALAVFGSVQNLFDRIAPLDPLTGGAMNYNPLDSAGAVGRFFTVGARYAFK

SEQ ID NO: 457 - protein, 746 aa, Escherichia coli str. K-12
MKPFKLSGVCLSVVGALLAGSALAEEATNVGTINVQGQPLGAGLMVQEDSAKSRSTVTKDALDKMPAAGNAIDKLKYTAGLNVSSNDASGLSGVSYTMRGMSADQVGLSSDGIPVNDSGDYAVYPNGMGDPENLEQIFVTQGSSEMDGPHIGASGGNIGLVSHRPAKEFGGFVKQTFGSNNLSKTFARLETGKHNGFSSWLSYSYTDSDKWRGAGYSRADKVEWNGLYEHENGHSSNLIVKYNQQDTINYSTLSKRQFEQNGRKMDYAMTPVYNSRGQISQSYKLNRNNFETLNVTFTQKLQLRDNLALTLQPYYFSTNGGSFGSGSASVLSATSDRAGNYDLRNLTSNTYYRPSWTETWRPGITTKLKWDLNDEHSLDIGYWFERARQRQTQPFIPIQSDGNPVNVSGKPGDANQITDANGKVVQGRNQFTVTPAHKIWVQDTWFFSPEWTFTGGLAYQHVERDGTNLGSLYNVAEKKNKKYHEFLPSFNAAYRINTENQVFYNITRNMRTPPNYVLYNVGDSINTKPELSWNQELGWRFQDEDMLLSASLFFIRFTDRQISSRNADGDYEMINAGKVENKGLELEWSGKLPHNFNYFAAYTYTDTEQKNNLATSGSQLPTTGKQAANAPKNMLNLGLGYDDGLYYAGVNSRYVGSFYGDMTNDEKIGGRTVFDLSAGVYLPVDKKIVKSATLRVGVSNLFDKEYLDSARSVSFNSRSYNGVSAGTPFYNVGEERTFSASLEATF

SEQ ID NO: 458 - protein, 625 aa, Escherichia coli str. K-12
MSLSSVSPRRAVLVVGLSLCAATAAQAEAAIDLDQVVVTASRTAQTQDQALAPVTVIDRAQIERRQVNSLQDLLRGEAGVSLANNGGPGKATSLFLRGTEADQVVVLIDGVRIGSATAGGAALQDVPIEQIERIEIVRGPFSSLYGSEALGGVIQIFTRRPQGSVVPTLSVAAGSDNARRYGAGIAGRSPGDLSDAGGWYSVNAVHDETDGINAYLDTSSSAYDPDRDGYRNDSLSAQGGWRFNRQWDADVHAVRAQSRNEYDGSAFGGNLGKGVQQAIGGRVRYAPNEALTLTASVGSSADLSDAYYQGAYLSTYDTRRKQGALQADLDTGPGLLTVGFDWQRDAIASSDNYNADSRIDRAAFAQWQQTFGSQSLQASLRRNDNSQFGGKTTGSLLWGWDFAEHLRLTASYGTAFKAPTFNELYYPDYGNPLLGPETSKSAELGLRGRYDWGTWTLSAFQTRIDDLIAYDASLVDATHPFGQPNNIDRARIRGVEAGYDTVLAGWTVRSAVTWLAPQADGEVNHGNWLPRRARQSGRIDADRSIGAFGIGASLFGSGARYDDLANTDRLAGYGLLDLRVSYAVNADWKVQFAANNVFDRHYETARWYAQPRRNYLLTFRYQPAH

SEQ ID NO: 459 - protein, 1084 aa, Escherichia coli str. K-12
MNKEIALSHHPINQKKNTTNSLFQLSLITSALLFSGYAVAYSEVGQLGNKQSWESPEYQKDWGLAAMNASSAYALGFHGQGAKVGVMDSGALLSHQELSGSRFHAVKAKGEYGSTGMRYPQEMGGHYEKGQVFDVDGNWIKGVNDTHGTHVTGTVGANRDGNGMHGVAWGADIYLGNTGATDSNNYGPYQDYTYFYTGWKAMVDAGAQVINNSWGTNPRIINTDKTEGPDGGNTTIHMPVNTTAQTEYEYFYFKKVYGDKPSFVDAAYDAVKGTNVVQVFTTGNRDFAQPYYRPLYPYFNPEAEQHWIAVAGLKQNADNTGYVLEKVFNEAGNAKWWTVVAPGRNIYSTVVDKEGNPGWDTFSGTSMAAPHVTGAMGVLMSRYPSMNAIQVRDVMFTTANHRDPDGSLYESWTAAEGTPDVRYGWGTPDLDKGMYGPGQLLGKFEYNLNATPLDVWTNDISQTALDLRKQEDLAWLKEYTEKGIAAGGDYHLGTDFVINDGNPDPTSHIVSQEDAEKWRQEYYQKRADAIQAKIDAGLYDGALVKRGEGTLVMTGNNSYRGGTTVEQGTLYGFSGSFGTQAVNVNGGKLGIIERYNDTFTQKGQLTSNQNHKVNININDKGRYLVTAGHNVNIGNLVLNQGADIDVGADNVGQLKDIYLNNSVVVGEVNTDSLVDNRTKTKMLASNRVVADPATTTTVTNNDYALFDKHITITDKTISGSLTKKENTTLATFADNENGRAIANALDNTGNGELFNAVLPMNENDLKTTYQSLGSDMYLNANNASIVNVLGLTRTVKDQAIGIGDGRHAQLGNSNARIWISGMGQWGKTDYGHSDMDVDFYVGLLGAEIDVTENTKAGLFFGAGSTKYKGNQYGKIDSNDIHIGAYGISNLYDVASLNYGFTHTNQDRDAKRTLWIGQTAGYNSTSYDAKISQFFLEGAYTQLNTSQYSIEPYAGFSWLRVSTDNINENVGNMKFTTKTDAQDIQVATVGLRGGYPFMAGNINMALKGDISASHLFGDNRPESRLWLSNSGEASLRGGKLDNLFGVGLGVDAQLSKSTTFGISYQGQYNSDINSSGINAILKINF

SEQ ID NO: 460 - protein, 707 aa, Escherichia coli str. K-12
MRFSPSKLSMAVFLATTSLAYAQENTVNLDVVSVVSENAGAKSRTNVVTLKDLNKGTKEDLRGVLSAEPAINFGGGTGGTSQWTTIRGMGQDQIDIKVDNTYSDAQIFHHQSRFMLDPSLIKRIDVRKGAGSASAGIGATSGSIEATTVDAKDLLREGQDFGFKLNAGVSSNKGHSQGASVYGKSGAFDALLSGNWETAENYKGGKGYSNKEGSDTVKNSALGQRSLLAKFGVDINEDHRVVLSHRQERYHGERALREEFDFSQDWTTTASLTSEQRAAGYQLGAAAGVDRNGRPTRYLLDKNGALVANDANNDPRYRITTQNTTNLEYIGKNLGLINEVKANAYLLENSREETDTNSKTKVVIKGANINFDSEIGSDHFVKYGVNYRHQEGKPNSLEAFAENRRTRRLEATGVTNNQEKEDIGAYVEGIWGFGPVTMTTGLRYDHFDFKANDGKKVSDGAFSPSVGLIWEVVQGLSLNTNLNYATRSPRFYEVALSGSSARSVADDLKAEKARNTEIGFNYDFNDQISLNGSYFWQKVKDAHAVLNNTLVNSALLRNKGYELGAAYKYSGFTFRLGVADSKPETWVFNDASLDSTVYAVATGRTWTTGLSYKFENPSLEIGWKGRFVEGETGTPSRGSNATTAPVKQSGYGVNDFYASWDANKNLTLNFAVNNAFNKNYKSHSQRAGATSLPSAGRDFRVNVNYTF

SEQ ID NO: 461 - protein, 1000 aa, Escherichia coli str. K-12
MQTIKNKFVVRTILATTVTIVLSACGGGLVRIDIPRPTPTPTPTPTPTPTPTPTPTPTPTPTPTPTPTPTPTPTPTPTPTPTPTPTPTPTLPSLPPSLAAKIGRHLELTNTEAAHALGLTGSGFIIGMVDTGVHRNNIALQGKVIRSGVYNFYTDYHAPSAPDDVDNHGTLVAQLIAGQPVEHWPGGIAPGASIFSARVYPSEEEFEAYIEEQMTSSHIVDTFEAEASKIRLINADMIAAGVRIQNNSWGHSSYAMWTDPKITNLFGDTYRDFVIGSNGLVVFSTGNEKLSQPNGLARLPSLLRAEGSPSAADDLERGWLAVAGLDSFDHPDQLGSYSNHCGVAMHYCLAAPGNVLVIDSNVTTTPIGNDGYEEQRGTSFSAPLVSGAAALVWEVFPYFNNDLVRQTLLGTATDLGAPGVDEVFGYGALNVGKAVRGPAKFDWGDVKVNFNDSRSTWFNDISGGGGLIKDGTGTLVLAGSANQYSGATQVLGGTLQVSSLGESAVSIAHSATLIGSGRFGGAVSNAGTLEIGTDGLKVQGDYTQSETGRLALNVGDQLSVAGHAALQGGELQVLGKRDYVSLNTSYSVLHADGGLSGTFSGLTWGPAVLLGEGQLHYGANDANVTLQRLDVNAAARALGIVDTVAQASARRVEQAFREIDIQQAQGRGQLSTSFMAAAAALQQSGSAQMASASLHSLSGQGHVAATASSFDVVDAGRRSLATRLGERPLGERTVTWRQSLGGSGQDGTAGGTFALSGWLLGRDTQLASGDIVGFAFGQSEASPSGSVSGLRGLDRQVQGRMYVQRSQGPLYVLGQLGFGSFQRRLDRQLQLGHWSDWASSRYRGQFFSGSVETGYHWRRGAWALTPYVGVDQTQLKTDGFREQGGAGFGLQVQAAQAIRSQLLAGIRTELGWRGVKLRGYGEWQQTLRQSGLNPQASFTATSSWTPLVASPWSSRSGGLLGLSMVWPVGMTVGQWNMGVEHFFGARKRSDSLGLRYQLSF

SEQ ID NO: 462 - protein, 398 aa, Escherichia coli str. K-12
MSKARMAVRDLRHATTTRPRMQFDWTTSAARRAAGLASHWSHNCHRRDRDVRRRHRTDFKSKYNCCHGCYVRTTGALAGACTPCSRSLTAPDRRSRRRVSPARAGPMKKRNLATTLCALSASGSTLAAELELYVDRKTKQIFAEPAPGRDKLGTFVQVDENGKLPASAMPAAPARPLPPAPGAATPADTAIAQATPAAATPVAAPAPAKSGDTAKKWYDKLCLRGYTQIRYKQGIGGDAQDLRAPGDRFIGDDQSLGIRRARLVLSGDLNEHVSLYFQPDFASTPTGSTTSNFAQLRDAYADIFFNKKREYRVRVGQSKMPYGWENLQSSQNRLSLDRADALNSGLRDERDIGAVFFTAPPWPRAGSRTWSSGIEGFGRLRRDRCRCVQWPGRQPRRA

SEQ ID NO: 463 - protein, 464 aa, Escherichia coli str. K-12
MKFKTKNPLIYSIILGWASFLVTPVYAGTETMLELLKILRDRGTLSQDEFEMLRNAAKDDEEKKVSGQGKFKEEAKETPQNSIKVKTGYKGLAVESTDGAFKFHVGGRLQIDTAFVDDDKTRLGSGAELRRARLEVGGTMWRIWGYKFQIDFGHGETKIKDAYIKFRGFKPVSFTLGQQKLPFTLQSWTSNKWIVFQERALMNTFIEDDSIGRRRFGFKAHTHRIIHGNHWTAAAGIFGEGVEHKGPFNESWAPMGRVTFAPIAEKTRVLHFGVDSYYRHYPPNPDLSFTAYPEVHSIPSLLNSGVISGTEDALLLAGELSAVWGPFHAQSEYIHAHVGRKNGLPDPDFYGWYVQAGYFLTGESRNYEPEEGRYGQIFPQGIVGQGGWGAWEVAARFSKLDLADSGILGGVENNITVALNWYATPSILFRMNYIHAHTDPTSIAAGLGVDENVDILGLRAQVVW

SEQ ID NO: 464 - protein, 3165 aa, Escherichia coli str. K-12
MTVKNRDLTYLKSHPSSTKLANTRDYTNYKVKTTSGGQIASRAQETNMSYIKNTGDININGDDSVGVGLLHNIQGVTIAGNINIGNVDPSSFSYSNKTGGNNGKVEGAVGVYSEVRTRPILNGDYDDHALQNTSGKTLGTETVEVSGKVELGSYAEKSSGLRIKDEGSITLKNGGEVLVGGKNNYGAVVNGKDYNYYRKTVANAYAESGTKYSDTGKINLDSGSKITVTGEESIGYALLAGKGINAGTITVTGHTNNNTTGAFHGSLGFYGEKGTFTNIGEISSSGNIAHAVALVGDATDGTIFKNNGKINVVGKGNIGVYADGKYTFEHSGSGAKISVGSDSLGIYAKNSNGNLDIKAPIELANSNTATTIGIYSDGDANVKFGTGSKLKIGEKAVGLYSADPTKFNNTFKIESGKTLDVELGKNSTFGLLNGNNTVTNSPLLSKYLNNNTSDKINIVSFGEGASLFYATSKAKAILDEDYKVTNGDAISTAVLVANNGANVEIASGKKLETNTNAGLIAINGTVGFTSVAKNNGTLISTRIDKGIGIYTSAANGENSGTITMQNKNAVGILGSKGSNLKNTGKIELEAVSSAGVYAEDSNMTNSGTTSEIIVNKEASVGIYAKETSISSVSKNVKNEGKIEIKADGDGKSAGIYSKKEGGAKLTIENTGNIEVAQKASAGIYTKNESTQANTQSEVTNSGLVKMSAENSIGIMGEKSKITNTGTGTKGIEIVEKKSAGILVTNESAVINSGRISLSNSSISSSSDGLVGISVDGSSTGENDASGEIKVDAAYSTGMLSSGGDVTNAGKIALEKKESVGMYATNANVTNSGAIPKGIFIKDEKSVGIYSKINSSSIANKTVTNSGTIDIAGTSKTGSAGIYSIIENGATKTLSAVNNGNITINQKKSVGIYAKNESSHANTESDVTNSGKIEVKNEGSAGVLAEKYKVTNTGSGTNGIIVSAKKSAGIIGKLGSEIINSGIIKTETATPTVATDGVVGISLNNSKATNTSGGVITLDTNYSTGMYGEANSQLTNEGNITGTNKEYIVGMAGDSSTVTNKNIITLNGKKATGIFGKNSSTLLNETTGKIPTKEEESVGMYSSSSLKATNKGTIITEKKTSAGMLGDKANIENDSSIPTKEEMSAGMYVKNGTSKATNKGTVTTEKKTSAGILAEIDEANGGTVSGLNETTGTITVSEETSAGMLGKVKSAVTASTAKLSLTNKKDININTKNSAGIMVVNESTAVGKENVLAENTGTINLTSSSATNEKNIGILANKATGINTGNININSKESIGMLGQNASSITNNKTITLSGEKGIGMLSKDTSSIADNNDIINVNGKESLGMLGEDSGTVKNNKTISVTAEKGVGIFVRDNGVGKGSGTGENTSTGTITLENKEAVGIFAKNNGTSDSAKNSGTINLGKADGSTIKESLIGMFAQAEAGKKANVKNTKDINVNTKKSVGIYAKNDASNITDVDLENTGDININSKESAGVYAPKANISKVGTITLKNSIDSNGSSAVYVSKGGKVANTAGVKINLGTVNQNRVAYYVNGKDSALAGADIGKITGYGVGVYLQGTSGDKATLDKNTSKLDYTLQGTGNGIIGLLLKGETNIQSYTKGIKVGNTVAATSPSDKAKYAIGIYADAQGTVGTPYNITTPITAGKSGVGIFADKDSNINYTGNMEIGDGTTAGTGIFITKKIGATGGKVTLGTNTIKLKGTKGVVAIASEGTTFNGGNATIELVGSNIQGVGVYAKKGSTVNIDHWTFNNNGNSAEEVRSEEGRVYINANKNLKPKMVLTHVINGETSIATGKTVTSVNDGSITAKENIGLMAEGIKNHSMTWQEGNFEAVNHGIIDFSAAEKSTAMFINSARAKNDGTIKVGKNSIGIYGFYNKDTRKYDGASTNPDPNKLELETTSNSKISLGDASTGMYLTNAEKIENKGGQITSESGATKNVGIYAVNGQDTKVSANNKILNMTTATNINLGNGSVGLYSKGQSNTVRNTVTNTGDITVGDKITGSPSVAMYAENTNLTTNSKIPVGKDGIAFYGKNSDITAKGSANFSNKGVLAYLENSKFVSHLGNLGSTQNTMLYLKNSIAQLDGAGTKVDMDVADGYTGAYIEGNSALTGVKTIKLGQDSTGLFLKDANFVSDAESITGTKDKARGILGVNSNFTNNSKISLSGAESIGIYSNAGSGKTVVNNGELTIAGKKTLGVFLKGSQSFENKANINIANSANSFEPAIGIYTAEGASTIKHTSGTIEVGEKSIGIYSKTPSNVEINSGKVHVKDQGIGIYKESGKLTIKGELDIDTHIATAKDSEPTGVYAVNGAQVDDQASKISIGAKSYGFILNNTDPNKTNIYTNTDAGTVSLGNDSVFLYSNGKANIINNRTINANGASHLIAFYIKNGGNFTNNGTIDFSTGKGNIGIYAPGGKATNKGRVYVGKTDDIDPMTGKVYSDVSKIVYGIGMAADNGGYIKNDGEIRIYNNKSIGMYGKGIGTTVENTGKIYLDGSRATATDKIQSMTGVYVDDGAKFINRGEIRTTDSYAGRDGKVNENVTGLVGVAVMNGSTLENHGKILIDADNSYGVIIRGKRDSKGNVERYAVIKNYGEIKVRGKGTWGISWKDVSQAYIDELQKQINDKISSDPEGQALRAATGTNKDYEGVTITVKNGKPTFLRNGVPISDSEVEQIGKLIGKESNLGLSDIGFYVDTLGRTKPIDIDGATPPINSQLIIGTEYSEKTNKKQWFVKGDVIKPFLDQIQGRNFKLTSIAGSLTWIATPVLDNYGQITGVAMAKLPYTSFVNKTDNAWNFADGLEQRYDMNALDSVEKRIFNKLNSIGKNEQTLLTQAYDEMMGHQYANVQQRVQATGIVLDKEFSHLRNSWSNPSKDSNKVKTFGMKGEYKTDTAGVIDYKYNAYGVAYVHENEDIKLGKGTGWYTGIVHNTFKFKDIGNSKEKQLQAKVGLFKSVPFDENNSLNWTISGDIFIGHNKLERKFLVVDEIFHAKSKYYTYGIGIKNEIGKEFRLSEDFSIRPYGALKVEYGRVSKIKEKSGEMKLEVKENDYLSIRPEIGTELAYRHYFGTKTLRTSVGVAYENELGRVANGKNKARVAGTTADWFNIRGEKEDRKGNVKVDLNVGIDNQRLGVTGNVGYDTKGHNVRGGVGLRVIF

SEQ ID NO: 465 - protein, 257 aa, Escherichia coli str. K-12
MFFKFILCLLLGVFAWAKEDIPTPLTPSKRYSINLMTENDGYINPYIDEYYTAGNQIGFSTKEFDFSKNKAMKWTSYLGFFNKSPRVTRFGISLAQDMYTPSLKNRKLVHLHDNHPYGGYLRVNLNVYNRHKTFMELFTLSLGTTGQDSLAAQTQRLIHKWGHDPQFYGWNTQLKNEFIFELHYQLLKKVPLLKTRFFSMELMPGFNVELGNARDYFQLGSLFRAGYNLDADYGVNKVNTAFDGGMPYSDKFSIYFL

SEQ ID NO: 466 - protein, 620 aa, Escherichia coli str. K-12
MLRHAACYVEDVITNRRAVIFGAAPARYWGPGAPTICRAAILSERDYNSGKFRAIFMRSRVLFLGAATMAIATTGTSMANLGREALPPSVWNWSGGYIGGHVGGGYGRTSFTNPFGPPIYGDVVDIPSFVAGGQIGYNWQNNSWVYGLELDASAAVASGSNTCLAASDLIVSANCNAAPNLFATGTGRIGYAFGSLGQTLAYLKAGAAWQNNRGDIVNNFEGGDLPQEKTHFDYGQVGGVIGLGVEQALTPSWSVNVEYDYLHFGGPSVATASTAKLSPSTILPASTTSLSSNYHIGKIGLNYHFGADPEAAPKSDSPLHARSAGSVPPIPYTSGWSFEGGSRLWLSRGRFQWDQSAVPYGWPEDPSILISRLTYHALDGLSGEVFGRVDSPWGVFLKSSLGIGFFNKGKSNDEDWLPHEGYPYLNTRSGESNGRFAYYTADAGYDVLRSTNYKIGGFIGWAYYSQSSDSRGCVPLTNPQDFCRIKPSDDRIVGSQDTQWNAPRIGLSAETMLTERWRLNADIAYLPWTDFKGRDNHLLRKKTTFSEQHGNGGGGVQVEGLLSYFVTNNISLGVGGRYWAMWTKKEADSADCGNGCGSLGFANYSMERWGTFFQASYKLN

SEQ ID NO: 467 - protein, 226 aa, Escherichia coli str. K-12
MLKKTLAPSVLATSIALAFSTPAMAYEAGDILLRVGTATVAPEKTSDDIDQIAGQAVEANDNTQLGISGTYMITDQLGVEVLGATPFSHDIEAKAGTLGAEGAAIGEIKHLPPTISAQYYPMDKNSKLQPYVGAGLNITVFFDEETGAGAEGLGYDELSLDNSVGLAVQAGVDYAFDEKMFVNASVMYAKIGTEATLSDSTGTAPDLTVNYDLDPLVYRVNFGYKF

SEQ ID NO: 468 - protein, 784 aa, Escherichia coli K12
MKRIILAALGSALLLPSQAQQKNKEYTNFNDSVFSINEVVVATNYRRKTDALKLDVPAKFIPISTNSITSGMLEKRNIRDIQEASRFLPGVRFRTSYGAFTQFSIRGFDNSVIMVDGVRDERSSIDNSYPFMDLSAVESIELLKGPASVLYGQSAVGGVLNIVRKAPVSKQSVYARLAYGSYYNKQATMALGGKLIGPLNYRASVNWQDQEGWRSNATKRLSGYLALGGHLTENDELDIRIGANRDFYPTEIGLPPTMSYDILSATDGSKYLSKGDALPGLNKKARYNSESDFMYNRGFNASAMYKHTFSEVFKLMEKLSYTYDDIDYFGTESLDYLTSDRPIYDHYYMTKDKQGNDTKKYICLDSIYYSYPLRFSHIAKTVNNQLEASGKFYTGDVAHNYLGGYSFVSLMRDSYMAYGNGSTGATGPGTTGHGSVYNPHSIGWMEAPFRFVTAQKTFTHGFYLQDLVEFSDKLKIMLAGRYDLFMYKTANLNTSDGGRHYDKPDDDAYNKITNGAFTFRAGLVYLPIEKLSVYGSYGTYFKPIRAFYDANTIYIDKDGKEFTPVNGKEVFKPEKGFQVEVGARYEITRTLQTNVSLFYINKDNIRQTLANKGDIANGVELDKKVVGQVGRMDSKGFDIDITWSPIYNLSMSAGYGYTDAKVRDLADNPYMPTTSSKGKQYAYIPKNTFYAFGAYTVSKGVLKGLGVNFSTSFQDKVYRNSDNTSSFDAYWLTDLGFSYTLKSNVRLGVNINNLFNKEYCNQALGNQLIPSMPRNFMLSASYTL

SEQ ID NO: 469 - protein, 728 aa, Escherichia coli str. K-12
MNNTTMNKTLLALAIGAVMHSASAAETPKEDTLVVQAAPASDFKPGGDRLVPAFLDGQVANGGRMGMLGQQSAMDVPFNIISYTSKLVDDQQAKTIADVVANDAGVQSVQGYGNSAESFRIRGLKFDGDDMTFGGLSGILPRQVVDAQMVDRIEIFKGANAMMNGAASSGVGGMINLEPKHAGDTPQAKIGVDYTSDSQIGTTLDAGRRFGESDQFGARVNLVHREGEAPVANDRRRTTLLSTGLDYKGDNFRTSVDMGYQKKTFHGSETGVNISAVDFVPTPPKNDRNYSQKWAYSNIENEFGMWRSEYDITDSWTAYTGLGAQHAHEEGLYSGAKLIDKSGTATATRLDTNRISDSVSGMAGLRGNFDTGFVSHKVNVGYSAQTKNEKIAWKMSKAADNPITNIYHNTGVDKPDSTNLGGSGGNYSDPLTSGRTRTQGWLLSDTLGVLDDKLLFTVGARHQKVVIRGYNKVTGAENQADSFDGSRWMPTYGVVYKPWNELSLYANHTEALQPGKTAPEAATNYGQSTGIVHSKQNEVGVKADFGRVGGSLALFEIKMPSAILDSVTKHYGLDAEQRNRGVELNIFGEPMLGMRLNASATWLQAELTKTNNGVNQGNDAVGVPNFYAVLGAEYDIKPIDGLTATARVNHSGSQYANLTNTKKLDSYTTLDLGMRYRFAVNQNQNQMTVRAGIDNVTDENYWSSVDDSGTYVFQGEARTFKVSVGYEF

SEQ ID NO: 470 - protein, 958 aa, Escherichia coli str. K-12
MDLSPQRGKNAWRPMRSSRSFAFVLSVFLLSAPVLADNNADEADIAFELGNDAYSKGQYAEALRSYFTSYRLVPNRNVLFNIARCFEALGKFNEAYRYYNDLLAEDLPKEDAAEVSRSVDRLRPKVALVRVTSNPKGADVYVDRMDLGSRGRSPQTLALTPGRHKIMVKKEGYRAAEATLTLVRGRETDQTFDLTLITGGVEVTGTPEGAEIRDAPNGNILARVPGRVRLPPGQRVLHVRAPGYAPSQYVVDVPADGNVPVAVALRPQDRPTGRLVVTANRDGATVRVDGKPAGFTPTVVTLPEGEHTLEVESREVRPLRQTVKVVADEEVKVHAELRYAPPPVRAASKSLVAVDEAPASTTVLTQEELRAFGWRTVAEAVAGVRGFYLTDDRTYTYMGVRGFSPPGDLNTRILILWDGHSMNDVWAGQGFAARDLSVDIQEVERIEVVRGPGSALYGTGAFFAVINVVPRESLGSDKHLEVTGAVGALGTTRGHAAASWEDGNRSVLVSAAALTSTGADTTRLGSSGPIITGLDAERAAGGSLRARVGDLSFQAQFNVRTKELPTAPYGTVPGTEGNIVEDMRAFAEARYERQFTERFSLSVRGAFDISRYEGTYVYPEEDGGARTEGGAADWLTAEARARIGLFEGNVFTLGVEGQAQLRVRQDAGDLPLETQARTLVSAYLLDEWKIHPRLSVSAGLRLDKYVDLDSTPITPRLAVIARPYERGLTKLVAGNAFRAPNVYELYYADGISQGAALNLRPETITTFELEHSHDLTDELRLTVAGYHNRISSLVQLTAEDAASGDCGTAACLRFMNTDGTTLAWGAEAGVHWQPGRWLMVDVSYSYVTLRNASEEVANAAPAHLVAGRMMLPIGAGDMRVATQAIYQSARPTGPGGADSGEALLVGFGLSGDYGPLRYFAGVHNLLDARYSLPVSDENSIAPVPQYGRTFTLQLTGTF

SEQ ID NO: 471 - protein, 794 aa, Escherichia coli str. K-12
MAENKPSSPEPDNTGVGNSPSDYLHGEAIIPPLSSLSNFNDKRFMKKLHMIAALAVLPFCLTAQAPVSNSEIDSLSNVQLQTVQVVATRATAKTPVAYTNVRKAELSKSNYGRDIPYLLMLTPSVVATSDAGTGIGYSGFRVRGTDANRINITTNGVPLNDSESQSVFWVNMPDFASSIEDLQVQRGVGTSTNGAGAFGASVNMRTDNLGLAPYGRVDLSGGSFGTFRRSVKLGSGRIGRHWAVDARLSKIGSDGYVDRGSVDLKSYFAQVGYFGSNTALRFITFGGKEVTGIAWNGLSKEDEAKYGRRYNSAGLMYVDAQGVPHYYHNTDNYEQRHYHAIMTHSFSPSVILNLTAHYTAGYGYTDEYRTGRKLKEYALQPYVENSVTVKKTDLIRQKYLDNDFGGLIGSLNWHTGAWDLQFGASGNIYKGDHFGRITYIKKYNQPLAPDFEYYRNSADKREGAAFAKANWQITPELNMYADLQYRTIGYTINGITDEYDEVQGSMQHIDLDKTFRFLNPKAGLTYSFDDAHTAYASVAVAHREPNRTNYTEAGIGQYPTPERLIDYELGYRYASPLLSAGVGLYYMQYKDQLVLDGRLSDVGQMLTSNVPDSYRMGLELTLGWQILPRLLRWDASFTMSRNKIDRYVQYTSVYDADYNWLELKEETLESTDIAYSPNVIAGSMLTLSHAGFEMAWTSRFVSKQYLDNTQRSDRMLPSYWVNDLRLGYVLPVHFVKRVALGVQLNNLFNLMYASNAYIYDAGYVQASGELSAYADLRYYPQAGFNALGSLTIDF

SEQ ID NO: 472 - protein, 191 aa, Escherichia coli str. K-12
MKKQSLAVAAVLATAISAPSMAADWFVGGAVGYQQDTYKIKETENGATESDKAKEKDMSYQLRVGTYLNDNNRVYGTYSYNSDDFAKQQSFLASYDYLVPLGAGKKLNWFVGATAGMNHTSPDFDELSSKNTFVWGGQTGLMYKINDKLSTEIGYRYLKQDYDVSASDTDYSAKFSLNDTQQVYLGVDYRF

SEQ ID NO: 473 - protein, 784 aa, Escherichia coli str. K-12
MFVGVRSLKSLLQIVGNSYQLHQYSCFIFDKDQIMQLKPLFTLLPVVLSSVVQAQENNEQAVDETVTVHGQSIPTDQRTRSDLDKVRGIANADIFSGITSVQSNNMHNEAGALDIGIRGVQGEGRVPIFIDGSLQSTHTSRGYQGVSDRTYIDTDLLSSLTVNKGATIESSPYASGAVGGVVNATTLGIKDIIKDDQAFGVVLKARANNHNRTPDVSSDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRFGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASDSLLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 474 - protein, 364 aa, Escherichia coli str. K-12
MKTYTRAAVVVLLSSFACAARAQSSVTLYGMVDILMDISNQGNGTLTRMTNGGLAGSRIGLAGVEELGNGYKAIFKLENGFASNTGVIEQGGALFGRQAWVGLQGPQGSLTFGRQYAPEFLAVSDYDAFFAGLGGSFWNFDRTLSNGTVQSTLMTDIITCRTNNSIVYSSPTVQGVSFGLMYGVGGVPGSISGGATISGALNYANGPLALHAGYLHMKDASDPGYYEEWGVGGNFVIGPAKLYAGYTKDIYPDTTTPATIQNTQRYAIANLGVKYMLRPSLALIGQVSKIIDTSDGLGASQNAYVEAVEINYQLSKRTSVYGGYSQVNNKNGSAYSLGAAVYYGGPAVPDTTSRVFQFGMRTLF

SEQ ID NO: 475 - protein, 781 aa, Escherichia coli K12
MGHDRFRFSRPCWLKALLASNSICWMAGLYGPAHAADLPVKTAPPITAAPSTLWNWTGIYVGAHLGGAFGSSDWQTATGLQADFSNRGFPGSGNAEGLLGGGQIGVNYQFGTWVTGLEIAASAADVDGFAKCANRADNRYGVISFTCDNRVTSLGTIAGRLGQTWGNLLIYGKAGAAWATDESDARTSHYINKFNQSGTRWGWMGGLGLEYAFSPNLSAFVEYDHFDFGSKDSNYVDQFNNASTVGFRQRFDMIKAGVNYGLGGPILNARADAATTPVLLGGWTIEAGSRYFGSTGRMQKDLYGLRPTHLVSRLIYGDQTGHAAETFFRFDHKSGFFARGNLGLGPLVDGKLNDEDFPYINYSNTNSDMKSGRFTYGTADVGYNFINDDGRRLGAYVGYHSFYERANGFGIQQQATNGPPLEASKSFLVLSETETWRAAAIGINAQARLSDRLKLEVDAAYLPYASRSGFDNHWLRADINPTPDPGHGWGTQFEAVLSYAVSDRFSVGVGGRYWFFTTDSAYSQFPGGSPQTTKFYSERYGGFLQASYKSGELDTAQAKANGIDKEPPPVMPTNWAGVYLGGTIGAGKGRSHYADPFPTPVSGDYADLGGAMFGGQIGINYQTGSWVLGLEASGYWANVQGTNTCFGAFPSPQIAGFNCGSQIDALGALTGRVGYAFDRTLLYVKGGSAWDRQTNQFNTGGISGTILTNGNTNWGWTVGGGLEYALLPNWSMALEYKYYDFGKSPVFTTAGLGSVPLSPNSTTVQTVSLGVNYKLPILGAR

SEQ ID NO: 476 - protein, 874 aa, Escherichia coli str. K-12
MKTLIFTLGCLFITAFTFAQSSVSGTITDSNGGPLPGVNIIEKGTSNGTSTDFDGNYTLTVPNDAVLVISFVGFETQEISVNSQTTINVTLQEGNTLDSVQLVGSRSPKRTATDTPVAIDVIEVSDIVTQAGKIEINELLQYAAPSFNANKQSGSDGADHIDPATLRGLGPDQTLVLVNGKRRHQSSLINIFGTRGRGNTGTDLNTIPAASIKRIEILRDGAAAQYGSDAIAGVINIVLKDNVDEFSGSVSYGAYNTNAKGDFPDGTPNTDGNRLDTDRDGNAIGDDQSLDGGSLKVSGNYGVAIGEEGYANFTTEYVNKNKTLRPGYDFRRGFGEAAIEGFNIFGNLSFPVSDQTEVYAFGGRNYRDTDAYAFTRNGGERVVTEIYPNGFTPRITSIITDNSFAAGVRSELGNDWKVDLSNTYGKNVFHYYIKGTLNASLEENSPTEFDAGGHSLSQNTINLDFSKYYADIANGFNLAIGTEYRTETFTIFAGETGSYATYDTNGQPITDPQTQQQPIDPGTGNPRPGGSQGFPGYSPENVVDRSRSNVSLYVDTELDVTEKFLLAGAVRFENYSDFGSTFNGKLASRYKLTDNINLRGSLSSGFRAPSLAQVYYNLRFTDFQGGTATESLLSANNSPVTRSFGIGELKEETATNASLGFTAKAGDFTATIDGYFVSVKDRIVLTGTFDAPQIDNVNEAQFFVNGVDTETTGVDIILSYRKLLDDSSISATLLGNINSIEIKDVNNGNLDEDTFFGARERAFLLASAPDSKFALNMSYVKNKFNTALGITRYSEITLIDFAETEDVYDAKFTVDLNFGYEITDQVKLSIGSNNLFNEYPDQQNDGETEGGGYWDSVQMGFGGAYYYTRLDFTF

SEQ ID NO: 477 - protein, 733 aa, Escherichia coli str. K-12
MERKNHKKTTLATLISVLLMGSAGATYANSPSISEKLDLATQHLDGAASTGEAISSDGKTIATSINNRTRAFLLSGDNWATKTELGSLKSDSSGTSIVRALSADGKIAAGISSVDSSSTQLHATIWSGDNWATKTTLGTLATNNGGDSVVYALSADGKVAAGQTAASIGTLHAVIWSGDNWATKTDLGTIRSDGTGDSMVKALSADGKIAVGSAASDIKTPVNGMYAGGVLTGPNSVRAIAWSGDNWATKTDLGTLRSDNLGAAVANAISADGKVIGGASHHYVTTEYYRANADQLATIWSGGNWATKTNLGSLRSDNSGASLVAALSADGSIAGGAALNDANATRAIIWSGSHWATKTDLGTLKSDNSGNSEVVALSPDGSVAVGTAATDSGSSHATVWKITYPTESTSTSDSTTNTQTPSQPSQPSVVTVDADNTKKTLSQLGAETFSVMDLQRQGLTRLQQHCQIDAAGQSCWGIQTAISSIDGNRDKVAGIRLGHGFTETFSAGVSLDRSLSRSLPDSYLKNNGNLGAGLYAQWNTAFKGSQWYVRPAVAFNRYNVTVQRPVLENTEAGIGTSRMKGRGASLEAGQTFKSDHGVLLGWHLGGRYNNVSRAEYSEQNAAFPTTYGKASFKRTSAYLGADATIPLTTNLKWMAAVEIDRALKNRDAVYSAQADYIGSFNHRAGIKGTIATLSSGLQYTISEKILLGLTLDVNQTAFGDIARGGTFTVGGHF

SEQ ID NO: 478 - protein, 392 aa, Escherichia coli str. K-12
MSLNLERISPLLYLLDVTAKKIDTSNLIVEAMNLDEHYGYQGIWSPYWMETTTTTSSTVPEQTNTNHRQLYVDWTPVGYRPNPERHGEFIANTLWQSAYNALLGIRILPPQNLKEHDLEASLQGLGLLINQHNREGRKGFRNHTTGYAATTSAKTAARHSFSLGFAQMFSKTRERQSPSTTSSHNYFAGLRFDSLLFRDFISTGLSLGYSYGDHHMLCHYTEILKGSSKAFFNNHTLVASLDCTFLPARITRTLELQPFISAIALRCSQASFQETGDHIRKFHPKHPLTDLSSPIGFRSEWKTSHHIPMLWTTEISYVPTLYRKNPEMFTTLLISNGTWTTQATPVSYNSVAAKIKNTSQLFSRVTLSLDYSAQVSSSTVGQYLKAESHCTF

SEQ ID NO: 479 - protein, 1037 aa, Escherichia coli str. K-12
MTSLWLAAGGAAAQAHAPAPFAAAADQTPHRFRISSGPLAQALRDLSRQSGMAVLADADLMNGRRTAQWQGRTTAWNALTRLLAPHPDLQGRIVGETLIIERAQAAPAPTTVTQLEEVVVLGRKGALQEALEIKRAYDGVSDVVSVDDQGLLPTNNLAESLARLPGVNAVRNHQTGEGDRLTIRGMSTEWNAYRINGVRLGGAGSRADKFYRGVRLSYLPPEGIQNLIVRKTLTPDLDGDALGGLIDIQTPTAFDADHDYVRLSAENGWLTRFDRPKSGKLALAVSRRLSDQLGLFVAANWSDARSQFEMVGGESDDLPPVWFDTFYSTGWDFDRFIMRGMELAIGETQVRRLGVNGSLDWRGGQQELHLRLQYNRYEGEEYRNRLNFRNDGLAGTERLVQVDSGRTGLAQPDAMVVGSDPDLGRIYGYSTADMKDVDGDGRITDADRDVRSVYSLAGASGVWDPMGFRLRRFWEATRESGLLSSITLGGRRWDGPWRIDYDVSLSRSQDDLDEGALLEFRTDAVEWLGNRGVRVIETDDPRFRLWGLNPAGMAAVQDPAAYDFRHLGDEWEQTSETLAQAQFGLTYTLTGGWLESVQAGGRYMHSNRRSAGGARPDLIGPETLADLEGLFGAPVTDLFDGRYVGDHRLGVVLDSRRMSAEIERAYRGDSAYFTVDPAFEPQADAERFRLKEQAAAGYVMAAARWAGTEITGGVRVEHTRSKVSFPILDALRGDGRDQRRNSFTNVLPSLHLRRALEGDKVLRAAIWTSFARPDIARMTSARQYVYDQDPDRDGEVNPEADWILQEIRQGNPDLKPMEAIGYDLSLEHYGRSTAWSAALFHKDIHNFLYRASTSSIRDGGLIDRGDENGTPVRAYANGRRARISGVELAIRHGLDWAPAPLDGLGVTANLTWQVSRADANIVWRVGDRLPFTETPETLASVELFWQGGGWEAAAGWSRQGGFLEGMDSFANDPYEQAYSFVDISLRRRLGGDGLASIQIRNLLNSHTYWYTFGSGPEDLREYIRTGPTVTLAISRSF

SEQ ID NO: 480 - protein, 1025 aa, Escherichia coli str. K-12
MKPIFRIEHPFGSLPARAARGGLLLAGALACCAAAHAELLGVDGGGPSGGAGASGPGLAGQPGSGPAPGLGGDRTTPVPGGNGGAGGGAGAAGGSGESTHYGGGGGGSDSGGGGGALVYEMAGGAAGGNGGGVAQALSVGADLQSSRGGAGDDGGAPSYGTEPGGGGGGGGSGAAVLAGGGYRALGAAIVGGRGGAGGAGFESGGGGGGGHGIRVDAADVRIDLFATQVAGGQGGDGGAGSGGSGGGGDGGHGLAGAANDLRLRVGADSSLRGGDGGATWPVTHRAGAGGAGGAGLFVSASRWQVETAGLIQGGNGARGEASRELDGGDGGAGGAGIALAGDTGRLVNRGEIRGGSGATGGTSERAAPGAAGAGGAGVRIAGNGNRLVNAGRIAGGLSADGQQADAVRIDGAGNTFELRAGSVLQGNAVATGGANVLALGGAQPGVFDVSALVAGAPAAWSGVARYGGFTAYEKTGTGSWRLTGGNAAALSWTVRAGRLAVDAEMAGSAMTVAAGGTLGGTGTVGDTTVRAGGALAPGNSIGTLRVAGDLVFEPGSRFEVEADPAGTASDRVTVSGTADIRGGTVLHVGPEGGFEARQRYVILTAGRRLGQFDAVGSGYAYLAPALSYDATSVALTLQRRGAAGSGELAFADLADTANQRATARAAETLPAAHPVYRAIETLPEGAPPAAFDALSGEVHASTRSALLTGARQAQQVNLGRLRDHLGLAWQAGAPMAASGSAPGAAALPGALSPAWAEVVGAWQRLDGDGNAAQVRQHVGGLFVGADTALANGWRVGGSLGFTDGRIEVDARASQTDVASYTAALYGGRAWDTGAGRLNLLAGAAYTWHDIASERRVDVGDLRQELTADYGASTTQLFTELSYAMPLGMTAELEPFAGLAWNQLRVRGFTETGGSAALSGASSRDDMATTTLGARVAVPLGAGATLRAMAGWRHAFGDRTPQSTLAFGQGSAFEVAGAPIARDAALLGVGAGIEVAHNAFLDVAYAGEFGGGNRQHTANAVLRWRF

SEQ ID NO: 481 - protein, 383 aa, Escherichia coli str. K-12
MFEPMELTNDAVIKVIGVGGGGGNAVEHMVRERIEGVEFFAVNTDAQALRKTAVGQTIQIGSGITKGLGAGANPEVGRNAADEDRDALRAALEGADMVFIAAGMGGGTGTGAAPVVAEVAKDLGILTVAVVTKPFNFEGKKRMAFAEQGITELSKHVDSLITIPNDKLLKVLGRGISLLDAFGAANDVLKGAVQGIAELITRPGLMNVDFADVRTVMSEMGYAMMGSGVASGEDRAEEAAEMAISSPLLEDIDLSGARGVLVNITAGFDLRLDEFETVGNTIRAFASDNATVVIGTSLDPDMNDELRVTVVATGIGMDKRPEITLVTNKQVQQPVMDRYQQHGMAPLTQEQKPVAKVVNDNAPQTAKEPDYLDIPAFLRKQAD

SEQ ID NO: 482 - protein, 439 aa, Escherichia coli str. K-12
MWLGPGGISQAGDEDWEELFTEGEARMFFDNQYFARDYRNGPNNSGRNRYKLRSERNGYRQEWGQSVQLYYRSGFTPGLLGLGFDAFAMQAFKLDSGGGRTGTGTLALDGKGHPRDSHGKVGGALKLKVAEAQLRYGNFTTQAPVLAANNSRIIPGMAYGWQLQRDWDGLSLEAAWLSALSGPTESRARGGISTVYGRLSGARINIDSAQYLGLNYKGEQWRGAYYLGQLEDVWTQHYLNLGHTLELAGERSLSNTFNLYRTRDSGASLFGPIDNLIASHALAYRFDAHRLTLAYQRSFSDTPFDYIGFGDGQTGQSIVLANSAPYSDFNGPRERSWQLRYDQRLAWLGLPDLNLGLRYQRGWGVDGSHAPANSIYRGLYGEDGRHHETDLDLSYTFSSGSLKGLHLRATQIWHRGNSAQADGSIDQLRIRVQYPLALF

SEQ ID NO: 483 - protein, 796 aa, Escherichia coli str. K-12
MRHRKIQNGFNRTGTGYSIVANTQETVRITHRYDNGEIFEEKVALKSEFTEAIDKYKINKPDWTATEMVSSGKNAYDITYKKVKKTVTDEEAPKEPLKMDNPLTDDRENAPKVAVVKPEEIPNGVPSHEHSETAPKSDTATQTENPNSESVPSETTEKVAENSKQESETAEKNEQEVADTTPQNDEVAKEAKPTVEANTQTNELAQNGSETEKTQEAETARQSEINSTEETVVEDDPTISEPKSRPRRSISSSSNNINPAGTEDTAKVEKEKTQEVPKVTSQVSPKQEQSETVQPQVEPESENVPTVNNAEAQPQTQPSAIVSTEQPAKETSSNVEQPALENSANTGSATAMTETAEKSDKPQTETVASTEDTRQHTANTVADNSVANNLTSVTPTENSSTEVEQPVTESTTVSTENPVVENPENTTPATTQSAVSSEAVQSETATTEAVISQAKVTSTKETTVANASESSKPKSRRRKRSVSSAPNNVEPTGTAGRDRSAVVLRDLTSTNTNAVISDAMAKAQFVALNVGKAVSQHISQLEMNNEGQYNIWVSNTSMNENYSSSQYRRFSSKSTQTQLGWDQTISNNVQLGGVFTYVRNSNNFDKASSKNTLAQVNFYSKYYADNHWYLGIDLGYGKFQSNLQTNHNAKFARHTAQFGLTAGKAFNLGNFAVKPTVGVRYSYLSNANFALDQDRIKVNPISVKTAFAQIDLSYTYHLGEFSITPILSARYDANQGNGKINVSVYDFAYNVENQQQYNAGLKLKYHNVKLSLIGGLTKAKQAEKQKTAEVKLSFSF

SEQ ID NO: 484 - protein, 118 aa, Escherichia coli str. K-12 [sequence omitted]

SEQ ID NO: 485 - protein, 749 aa, Escherichia coli str. K-12
MRLNRAIGAVASLALPLGAAAEEATVLQTVEVVGERPALVKEPTALQTEVMAEKLEDINSPEVSDALKYEPNLVVRKRYIGDRNATLSFRETHTTQTARAVVMGDGIMLSNFLGSSFNFAPRWGLMQPEEIEWIEVLYGPYSAEYSGNAMGGAVIMHGRMPEQREAQVSAGVFLQDFSAYGTEDTYFGYKTHASFGDRQGPWSYFLATDWLQNEGHPQSFGIASGSGGAPVGNPVDGAHEYPAGGYLYNSAGRSDIGESVTKIKLGYDINDRLQARMTLAYLDRNEDNLNPETYLRDADGQPVYNGEVDIDGASYKVSSQRLGESEARDLIYGAELEGALGQGWEIKSALSFYDVLEQKQRRSGTNYEEAQSNGAGTLTEDQGTGWETFDVKFAHRHDGGWMGDRVLFGYHFDRYRLDQASYNTSHWRSDDIASLSGDSEGTTRTHALFVENEWTLAPAWSMTLGARQEWWRAYDGVLARDFGADRVSAAYPERSESDLSPKASFSYRPNADWSATLSLALAYRYPTVGELYQGSIDNTGAFNASFDPDLKKEKSFAKNLTVKRHFEDASLTVSLWENDVDDAIYRQTNVFTGVTNYQNIDRVRSRGVEVVTGFKDVLTAGLDLDFNLSFTDAEIMKNSASPESQGKQFPRVPKWRANLLAGYQATEQLRFGGGVRYASDPYDSLDNSDGDRSGFGYTDSFLVFDARAVYALNEHFSVAGGVDNFTDERYYVYHPYPGRTYYAEVKWKY

SEQ ID NO: 486 - protein, 974 aa, Escherichia coli str. K-12
MSRTTRWKDVRKCGIRTLVPLGVSLSLSPCALAEARSSGWEQDFIGVPVARALGLTGKGVDVGVIDGGFLPQHPAFAGQAITPLANRVAIDGEEAIADPSRPLFDRDEQSGEIQVASHGANVSGIIAARPEVIADFTYRGGVAPKVGLFQTQIRPSDEADDEDADIEEEQDEAASQASLLQPGSEELVHGALSTLYRGAPTVRIINNSYNDDPIGNDAAAVDAAYAAIDPAAPHPYLNALADGVRDGRLLVFAAGNESRAQPGLLATLPRFMPGLESGFLSVVALGPDRDLTDYSNQCGVTKDWCLAAPGDMYVAAANGASAERLTYTYADQSGTSYATPLVSASAALLAERFPYMDMAQVRMTMLSTAVDLGEPGVDARFGWGLLDLARAVRGPGQLFGDQRVTLDAARGGWNARDAWNNDIRAGGMLGKAGSGALRLSGDNRFAGVAVEAGELALAGRNRFSAASEVRGGRLVVDGTLEGPGLRVARAGELGGGGTIAAPTRIDGVLAADRLAGAPSFTRSLELSPSSTTRVALGGQPPIRLDGAAAFARLGGRLQLTAADAAGAGQKFLTVARGATYQGGFDALQQAPGLAARGLRHDLRFAADGIALALAPLDLPGQVNLQGNAGRSAAALNALRDRPIALRPGAYNDWLQASLARGDLAGLPRSAGGQVYADSLAYLSRQPSQVDRAMFGELSWAQPGQAPRLWFQGLASGLRNEGRSGVSGSRERSDGIALGLVQALDERTQGGATLAQTKGRINSAGGKVELDITQLAVGLLHAFDSLEQGGYVSAMLGAGYLDAASKRRLPGFATAKGDSEGWLYHASVKSGYRWRKDDWRVEPRVGLLATRTEWKGFREKHSELALDVDRAARDATFATLELSVARSLRVADWSLEPELNLGYERALGVPASHTEASLQGVDLKQVSAHRGRDLFSAGMALHARRGPLQGSLELQGTKGERVGGSAVNLRLSYDF

SEQ ID NO: 487 - protein, 1036 aa, Escherichia coli str. K-12
MIGLILPTLSVWGQNATITGKVVDPKGEPLVGVSVLEQGTTNGTVTDMNGRYSIVVQKDSSPLRFSYMGFDNQEIVPGKRRVIDVTLTENSVVIDDVVVIAYGTKKRRDMIGSVSKIKSDEMSLMQGGRFENSLQGLASGVQVVNDGMPGSTPQIKIRGIGSIASGSDPLWVVDGIVGGGSTMVNSNDIESIEVLKDAAATAIYGSRGANGVIIVTTKKGKKGGLKFDVHYEGGITPITNSDLGLANTKTYFNIMDEARANVGLNPLDPQKDIIEPYYSNWTSPITREEAMNTDMDWVDLVTRMGHFHDINVALNQGGENSTTYASVNYRSDESSLKGLSMNAVSARLNSEFKKGIVTLGTQSFLKFDRKKSTNKWAVVSDKFPWRKVYDPEDPTGYWNPQMADGHPTATLDNDYQLSTGENFSFRTTLYMDVNLKWIKGLSVRADASYGYGLAQSDYWLSGLITNTGNVDGNQGNKSKKTTKSQQYHAFAKYNREWTDHGLDIVTGIEANRSYTDNAVVAGKNLSGEFQEPKIIGTMLGNNSAYIGGESYTFSFFNRIDYKFKQRYLLGASFVREGSSKFVKENRFGDFYSVSGGWIISDEAFMRNAGFISLLKLRGSYGETGNQNIPSEVTKNSYSIKSKQYYNNMQNMFLWNIANKAAKWEKNKSIDLGLDYALFNNKVNGSIAYYRRTTSDMLMRVQLPASAGITNSGGNADNNSMWANVGSMYNQGFEFDINVTLVKKDFEWNMNYNLTTNMNKVTALDASVDAKGTGIINTRPGAITKKDLALGTYFMAEWAGVDPEKGIGMIYEIDLDRYNKTGETVKTGRLIPATQSNVNKHRIIQEGKTALPKVYMGWTNNFKYKAFDLSFMFYLSLGSYTFNYHRYTKSFVGDGRNNVTADIYENSWKKPGDIAEYPQLRWQDKYNYDDNGNDKQNVTYIKHDAGHTKYLEKSAYLRLRNLTLGYTLPQRICSKINIDALRVYVSAVNLFTITSFNGYDPEVRVKNQTGANAQGAVFSGSEMPQTRIFSAGINFKF

SEQ ID NO: 488 - protein, 211 aa, Escherichia coli str. K-12
MPTLQTAHSKFQALLKHTMLGALLLSPTVALADWSGAYAGAQLDVLTGDEVSLGFAAQSFEDVIETDTIISGFAGYQLQQGDFVIGGELSLGQANGVRFEDVDGLDTDVRLVDVKARVGYDLGDALVYGVAGFSQSRLLDIDEDDLEGLDLETSTGVNYGFGVDYRVTEQFTVGAEYLIRELTAEDDVNEFFNARVDTQFETFGVRAAFNF

SEQ ID NO: 489 - protein, 214 aa, Escherichia coli str. K-12
MNNEFHRIGLRLDSIPFETDFGIHQVTLRTAVSQRDFKNENTDTYLFSTSTASSTYAIQHPIRTRAFYIAAQDQIQWNEMFSGTAGLRYDQEQLAPQELNAKCYNCDTRGKATTFKNLTGSLGLNAQVTPVWNLGYYVSTGYRVPSASEMFFSYKHPSGNWLANPYLKAERSVNNSISIRGENRLGRLNLSLYHIRYKDFLFEQETNGLTSNGM

SEQ ID NO: 490 - protein, 724 aa, Escherichia coli str. K-12
MPRRLRPLALALLGGSALSTVAAGQERAEIALDQIVVTATGRPEPRSEIAGTVQVIDRTMIETSTAKSVTDLLAENAVGFFSEWTPGQTSINIRGGATDGQGKDFKSQVLVLMNGRRAGTANLSKLSIADIERIEIVRGPSSVIYGSQNIGGVINIILKTGRTAPGTLVEGIGGVWGLAQGRAQTGGVVGPFDYYLGLSGAKRDDYFAGTGGGRMANTQWNRMGITGGLGLQIDPNNRLDFTLRTDGIYGVGFRGSGGNIYSKDDRINGSFDASYTGRSDDGRMSLFAQLYSVNDEDRFKWASPIQRGGTGLPVPGTSADFNTRYLDILGTRFQPRFNLFTGNDLLLGWDWETSRLRSDRFRAGVPGNPLAQVSPQDNNQTDQFHALYIEDTQRLFDDRVTLRAGVRRTYGTTSFDPTPYLTAQVNGTRPYEATTYSVGAAFKATDWAAFRIGASSGFRAPTASELAADFNTLGGGRIFGNPNIRPETSEQVEIGTTLTSGVSRLDVALFQNVISDRIITRARGRNSNTSDYVNNPGDVVIRGMEVQYETDMVRTFGWEPGVWRWRAYVNGNYNFDMKDKGAVTVATANTHRVERVYLYQLALGTRFGQGDVAYPWTLQIQGELNGPVWYNTEENLRVPAAEPYREYIWRKDPFFLVHLRGEVDLMPGVKLFAQVRNLFDVNYHPLFIAIAGQQPTLADLRFYNGSGGTSAPGRDVQIGLQARF

SEQ ID NO: 491 - protein, 697 aa, Escherichia coli str. K-12
MREVKLSRFSSRLTVLSMGVAAVLGAQAASATTSADMPSTTLQTITVTANSSVRESVQEGGVDVEGYTPAAQASHLSDFLNVVPGVTVGGTSAVNQRIRVRGLDDTNLKVTIDGARQEGTLFYHMGDVTIDPDLLKQAEVSVGNNSVTLGNDALGGAVAFKTVDAADLLKPGQKIGAKLHAGYASNNDELLTSATVFAAPTDNIDLLAYYGQRNANAGEDGEGRKIQTEDSKGENILLKAGAYIANDHHVGASFSRTENEGMFPLRPDFPASPGVGSWNEILPQKVKRDTYGLDYSYNPASNLVNVDTNVYQTETQISRDTDYTTKPGYNWEAGVKTTGAKIQNTSVIDTNVGSHKLIAGVEHYKKESELERDFVKKGTDEAKNTSIYLEDQWKNGKLTLTPGIRYDRYESPEFVAGGKTYDNVVGALAASYEIAPLTQVFASYTQLFNGPDLSQAIFNSDGDKTYVNKDLKAEEGSNAEIGIVKTLRDLTVAGDALQLSGKYFETDIENFIEFVRSGGTRVGLDCTTGQLGGACQGAVNKDEDYKIKGVELAADYKMDSFSMGLSYAHARSKGDKTGYSIPSVTGGSADSGDKYMVNLAYVPTDTTELGWRSTYVAAITPKTESAQLEKSNYDVHDIFMSYMPKQVDGLKATVGVYNIFDETYASHASRSLTEQADGLRTDFEPGRNIKASLTYQF

SEQ ID NO: 492 - protein, 752 aa, Escherichia coli str. K-12
MKSLDSYSASTLANSLAAAIAVPALCLMPGAQAQTSAGVTQLAPVQVEGEASPYQATTVQSSKMTAPLLDTPRTVQVVPQQVIQDQAATNLQDVLRNSPGITMGAGEGGRAGGDLPIIRGQNAAGSIFVDGVRDPSTQIRDTFNLEQVEIIKGPDSVYSGRGGAGGSINLVSKTPKARDFAEGSVQIGTDSNYRATADGNWLLGDNAAFRLNLMGNKGDVPGRDHAVDFSRWGVAPTLQLGVGTPTRITLGYYHYQDDSMPDYAIPYDPKSGQPVTETQGVSRKNFYGLTGRDFMKSRDDVATLAIDHDFSSKLRLRNVTRYGRSVTDYAATNPDDSKGNVPNGLVYRALKAGYYTNKTFTNQTDLSGEFETGSLQHSFDVGFEYSNIKQDKDSYTQTIAKGAMPCKVGANDASNPALCTSLWDPDPHDYYPGHLSRNDNPARYSTDTIALYGFDTIKFNEQWQASVGLRWDNYRVSGSNIARGRNDPASTPAFYSTSREDNLFNYQLGLAYKPVPNGTIYASYGTSSTPSAVAGSNVSDAVTVSNESLAPEKSRTVEVGTKWQLFDDRLTLSGALFQDIRKNTSVAVSATETEQIGKAKVRGIELGFSGSITPKWNVYGGYTFMDSELVEGAYNSGAVGQDLPNTPRNAFSLWTTYKLVPQLTVGGGAYYVDKVYGNADNGRNADGTPKARWVPSYWRFDAMAAYEFNDHLTAQLNVMNIFDKTYYTKAYAAHYAALGTGRAAVLSFNIKY

SEQ ID NO: 493 - protein, 1094 aa, Escherichia coli str. K-12
MFKSRKNQCSYIIFLALFLFFNPILVLAQTGSVTLSMKNATLKQFFEAVEKQTTYIFSYRDAIVEGKKEVTLNVTNQPIQRLLDDVLHQRDLQYTMTGHSIVVTLKTAGKVKQVSGTVVDSNGEPIIGANVVEKGTTNGTVTDISGNFSLNIDDTGILQISYIGFNTQDVAVNGKSSLMINLKEDTQKLDEVVVVGYGVQKKSNVTGSVASIKTDDFNDLNMDVSHVIQGRVAGVNVSNGNIIIRGAASINGADPLWIVDGVPGSAPNFNDIESIEILKDAASTAIYGARGAGGVILVTTKKGKIGKLSINARVNFGIETPIDLPDMLHTADFIDRKLAAGFPNNPNSGWDNPASLPDTDWEDLVWRNAFRQNYFLQMTGGNEKTTFNMSAEFYKNQFIERYSFEDAGNFRVASQTNISKRVKFSEILTVGFNNTDPHLYGQTNNDYVYYRQVPTMVPYDNTNEAGGGWGKHPAGGYYEGPNHVATLMSHHANERRFWARANAILDWEIINDLKFQANFSANFDSHANNLFLESWNLGSLSQQDYYSKDYGSGYDLRMLYTLTYDHTFGEKHYVKGMVGYEAYRATASSAGGWKNGFLVQPSDDISLGTGDKDVSGTKTEGRSLSQFARVNYAYDDRYLLEASIRRDGYDNFGPENRFGVFPSASVGWNVGKESFVKDNITWMSQLKLRGSYGKIGNNTIPQFLYEPSFTNNYLYYSYDGQNTQRGFWYSNVANATIKWEDVAQWNIGVDASFLDNRLNTTIEYYDKKTSDMLYSVGVPPSAGPSSEPFSETSSYRANIGKISNRGFEWMVQWRDSYKDFRYDVAFTLSTNKNKVVKLSDQVNPIIWAGSDAALNSSIYRTENGQPMGQMYGYVVDGIIQDQAEIDALNAQSPDGLYQQAGTAPGDLKYKDLNGDGKVTNEDKTYIGNPWPDLMYGLNINLSWKGFDLSMGWLGNAGVDVFNSAKLYERSFYGDYNTTYKVYEAWSPTNRATSHPRVTKEDPNGNFKNVSSYFVEDGSFFKLKNLHFGYNLPKSILSHLKIEGLKFYINCDNLFIITKFQGDPELGGGYLERNMYSVKRAPSTRTIMGGLSLTL

SEQ ID NO: 494 - protein, 451 aa, Escherichia coli str. K-12
MARFQFKNRKNNGLIFFISFMVMGEAAIAAPLPQWANAPAVTPVAQLSLQESILRAFARNPGVTQQAAQIGIGEAQIDEAKSAWYPHVGLTGNAGPSRQTDSSGRLDNNVSYGITLTQLVYDFGKTNNDINLQTAARDSYRFKLMATLTDVAEKTATAYMEVSRYQALCDAAQRNIHSLENVYNMAALRANAGLNSSSDELQAQTRIAGMRSTLEQYQAQMASAKAQLAVLTGVQPEAIAAPPAELAEQPVSLKNIDYQSIPLVLAAENLRQSAQYGVEKTKAQYWPTLSIQGGKTRYQTSDRSYWDDQLQLNVNAPLYQGGAVSAQVQQAEGQQKISASQVEQAKLDVLQRASVAYANWTGARGREEAGLAQSESAHKTRDVYQNEYKLGKRSLNDLLTVEQDVFQAQSAEINANYDGWVAAVNYAAAVNNLIPLAGIKQGLYNDLPDLK

SEQ ID NO: 495 - protein, 190 aa, Escherichia coli str. K-12
MNKFAKSALALGLIGAVSLPALAAGTDGGAYIGGGLGVYQDSDTDGQGNLDSDGMGYNLYGGYQFNRIVGVELGYNDYADYKQGTAKVSPTSVSVSANLGYTFDNTIRPFVLAGLSSVDLNANKSAGYDDDSGTGFHFGLGVEYTPIENLTLRLISQADAVSVENYYGQYKTDDKTLAFSSVSLGGSYNF

SEQ ID NO: 496 - protein, 940 aa, Escherichia coli str. K-12
MDEALGDRPLLNAADALQGAVPGLFVSNGGNAPGTSKSFQIRGAYSLGVKNSDGTYGNTIKPLVLIDNVEGDIDMINPEDIESINVLKDAASAAIYGARAAGGVILVTTKRPKGASRFELNYNNNFAFGKAVNLPKQAPLMDYLQAYLDCGYSDAYWSLGSPSVSKWMEYLTAYQKDPSSFNTVGDGIYVDESGVPYYLNEKDLYKNFMETSFQMTHNISASGGTDKLRYRISGGYNSNDGVLISDRDKFERMNVNSFISANVTKWFTQEITMSYAHSLQTSPGGMGGVYNTRLVSYYPEGELPASVNTLADEDLPLFTPRNQILYSNPVNNKNDNPRIFLKSILKPLKGLEAVFEYTFDKNIYDYHWYTGQYDYTTIQGGSSKSFVDDYLRKYKQHTNYNSINVYATYNKDFGNHHFKVMAGFNQESSYQETLDTYSYNQAVLDVPAMSSGTGTIKATDSYSEYAIRGGFFRVNYNYLDKYLLEVNGRYDGSSKFPKSSRFGFFPSVSAGWQIAQERFMNSTRHWLDGLKLRASYGVIGNQNINPYTFTPSMSVNNKATSWIIDDTYVTSISSLPALVSQNFTWEKVGTINVGLDVNLFNNRLSGVFEWYQRNTNGMLAPGVQLPAVVGASAPYQNTADMRTRGWELSLNWRDQIGKVGYRIGFNLSDYKSEIIKYDDNAATKLLSSYYPGQTLGEIWGYVVDGYYTVDDFVDTSSWQLKEGVTSINGYNVRPGDVKFKNLRDDDTSTNVITSGDNTFDNPGDRKVIGNTTPRYQYGINLGMNYAGFDLNVILQGTGKRDYWISNVLTFPMNGDNFVPLFEGLSDYWMPKDPDNGDWSAVNPNAKYPRIYGNRGNSGSNLRQSDKYLSDASYLRIKNITLSYKLPKKWVNQIFLNQMKAFVSIENVATFTSLPSGIDPERIEWNYPAFRTVSFGVNITL

SEQ ID NO: 497 - protein, 1007 aa, Escherichia coli str. K-12
MKQVSFRRSITALAVAASLGFALPALADNTTANISGSINANDYSAYTVIAKDPATGLERVISVSDEGSFRFAKLPTGVYDITVKKGDAVVAEQKTRISLGSNTSLAFDFIDNDGTERIEVTGARISAIDLSSTDSGLVIDEVELDRMPVSRNITAVALLAPGTVMGDSSFSSPNSGGTASFGGASVAENSCYINGMEVTNTSQGLGCGTVPFEFYKEFQVKTGGYSAQFGRTTGGVLNAVTKSGSNEWEFAATALFTPKSLREDGQISYSAGGAGGPVVFRNQTQDEYSKTEFALSASGALIEDTLFFYALVNPRDVENNFASQSSGTQQYAVDDNYIKRDSSGSDNLFWGAKVDWFINDDHKISLFGYSNKSDTESTAYEFDRSTGEIGDALQTTIRERGGDLKSISYTGNFTDELTVSAMYGEIETDYTNTPSNLDCPTVLDTRNVSDSQKITSCGSGGSTGVNQDKNKQTRIDIEYAFEDHLVRVGYDKQERETFHTSAPITGHSWTYSSVNPNGVITGNDGPLFTNTTGAAIDVVADRIFAGGGGFSTDLNAWYIEDEWQVTEDLMLSLGLRRDEFENSGVTGKVFSSFKTDVAPRLGFSWDPTGEGDSKVYGTYGTYYLPVPNNTNYRAASGVSDTTTYYTFTGSDATGAPTGTSPVSGTVADSQIVNSVPNPATKETFQAEEAEPFSKDEYIVGYETAINDEFSFSVRAIYREVATALDDYCGPFASQATCTLLNPGNDSTWQLDNDFDSIVDTGSRRTYTAEEIGLPEAVNEYTALQPQINYRGDSMRMSLIYTWSRSVGNFEGAVKSDIGQADAGITQDFDFPALQDGSDGYQANDRRHVFKFFGSYDVTEDLTVGFNSTLSSGRPLSAFGQGYPSDDPAIYGSYGDTFYLYTNECPDANGNGTCEQSEKIYQYSPRGSKGRTPWTFNLDLSANYNFTFSDVDMRATLNVYNVLNGQAVTSQNEHYENRRSEGSFNQYYGAAYTWQSPRYVELGFEARF

SEQ ID NO: 498 - protein, 1062 aa, Escherichia coli str. K-12
MNMEKCKYLLFCGTLALWMAGSFQQVYAATEPSSQAIQQQSNKVTGKVSDATGPIIGASVVEKGTANGTITDLDGNFSLNVKAGATLVVSYVGYKSEEVKAGRGPLNITLKEDAKALDEVVVTALGIKRERKALGYGIDEVKGEALTKAKETNLINSMAGRVPGLVVSQTAGGPSGSTRVILRGSTEMTGNNQPLYVVDGVPLDNTNFGSAGTNGGFDLGDGISSINADDVENMSVLKGPAASALYGSRASHGVILITTKRANKDKISVEYNGTLTFDTQLAKWDEVQQIYGMGSNGTYSYDAISNTNKSWGPKADGSNMLKYFDGVERPFLIVPDNTSNFFRTGITATNSAIIGVNSGKTGIRFTYTDMRNKDIVPQTHMSRDIFNLRANTSAGKVDLDFSVNYTREDVKNRPALGDSKSNIGKNLMTLATTYDQEWLQTYQTADGEYSNWNGMDPYNVNPYWDIYKNFNKSKKDLFRMNGKAVWNIDPHLKLQATLGAELNWFTFDDYKAPTTPGFEAGRLQNSAFRNRMYNFEALALYNNHWGDFDFNATLGGNVYKVNNQTTVTTAQDMKIRDVPSLTSFNEISVVPGSYRKQINSVYGAVNVGWKHMLYLDATLRGDQSSTLPTGNNMYVYPSFSGSFVFSELTKLGDLLPYGKVRMSWAQVGSDTDPYQLGLVYTKSKYAYPGYTIGYIDNGTIPNKDLKPTKTNSVEMGLELKFLKNRIGLDFTYYSQISKNQIMGMASSWTTGYNYRLINAGKIENKGIEIALSTRPIQTRDFSWDINLNFSKNSNKVKELDGESDMFELEKASWLDVQVAAKVGENFGSIVGPDFQRNEKGDILIDPQTGLPQYDKSNHVLGNASWDWTGGLLTNFTYKNLSLVAVFDVKVGADLYSMSARAAYESGKSPETLAGRDAWYRSEEERLAAGIAKGADNWKPTGGFVAPGVIDNGDGTYRPNDIYINPEDYWMSVCRNAPSMFIYDNSYVKCRELTLSYNVPKSWLKNVVSGLTVSFVARNPFIVWKNIPNIDPDSNYNNTTGMGLEYGSLPSRRSYGFNVNVKF

SEQ ID NO: 499 - protein, 585 aa, Escherichia coli K12
MKLNCRNKIIVLLVLFVCQLSFSQVKKNESIGTETVNVVKPYSPTISDAFKVKETPSLDDAGNQPKETIKYSILSVPVASTFTPSKGNAQGVDKSKKERLFNNYATLGVGNYGTLNAELFVTQDLGNNDYLAGMLRHHSSQGGIKDVNLNDEFYDTGLNIGYGQNNRDMSWGVDLGYQNQVYNWYGLPADFGMTLAPGTQEDLIRGINPNHSYNTISVGGNAEFNEGIFSKISTRFTHFSDSFSSSENRFYLKPTFKVDIMDQAINTNIIVDHVSGSFEHNYAWDNTEPLKYSLTNFGIEPSFVVHENEWTLELGAGLFYALDSENSGNKFYIYPKVNASYKLVGDLMIFYTGVNGGLNQNSYADFVTENPFLSPTLNMRPSSTQYNVFAGLKGKLANNVGYNLTGSYLNEKNKALFKSNDYTEDFSNQNYAFGNSFGVVYEDIRTFRFYGELKADFSQNVTFGINGTFNSYNTDNAVEAWNLPTMKLSSTLDVNITKQWYAGLNVFYVGERKDMQTNLDFGTDPVITTLKSYFDANAHLGYKYNERLTFFLKLNNIGNQAYQRWLNYPVQGLQVLVGGNYKFDF

SEQ ID NO: 500 - protein, 381 aa, Escherichia coli str. K-12
MQYSTTRLYQFMLRMGVTFGMVGCIVVIPTVVNAQDNWTLSLKNAYIDRDYDGNAVKDTGSWSQGASLFYKSDYYKTPIDGLEIGVDGSVQYAVRLSHDKGVADTILPFDPVSQKQARDYLKYGGTLKLKYDQTELRVGELWPDLPVTAVDRSRQLLTSYQGVSLNSKLTSKLTGEIGIISKVSPRNEEDFRKLTFTKNGIKYVSDGLNYIDLKYQVLPNLKLKYFNASEDNKNYNIDSQNFGILETLKYRNHTVGLGYQQIVGDAYPLPDGFLPETYFINWNTTGFFKSDEKSVHFIYGYDFKDYVPGLNFTFKHVYGYDFKTATGLKNKEQESNFILNYAFQNPKLKGVGFQWLYIPYKVRYGTDFNENRLFLTYTKKF

SEQ ID NO: 501 - protein, 723 aa, Escherichia coli str. K-12
MKRLLGAASGLALLGAASAAAQSQGDGDVIVVQGQKIEQSLDQVTSSVDVTTSEEILREPIVNLYDVVDRIPNVTSSFGGLGFAIRGIDQRGIAGNGATLTVYVDDSPLGNFTTFFGPLDSWDLGQVEVYRGPQSTNFGRNALAGAIYVRTQDPTYDWDVRVRAEAGNNGVAQGAVAVGGPIIEDKLAFRAAANYRESDGFIFNTFLNEEADAAELKTGRFKLLFEPTDRISIISTSSYTENFAGEDNVDPTNGVPGQPLDAGDVIREVDYDTPGLEGTETFIQSINATWRLSDRIELQSITTYQDTDYTRQEDFDNTSAPIAALDRTGVDEAWSEEFRAKYLGDRFEGVLGFYYFTNEDGFNDSFIVPATIVDPSLPATILVSRVSANSNETTNYAGFFDGEYEMTPSIDLLFGLRYDKEEQDSVATAITSIANPPLPAGFEFLEALLGEETSEVDASYEAWLPKGGVRWEAHPNATLSFVVQRAYRAGGAQILTLNGSIDRFEPEFLWNYELAARTNFLDGRIQWNTNVFYADWRDQQVNEPVPDFPTFFTTINAGESTLYGFETDMAVEVTPDLLVYGGLGYSHTEFDDFPNANYDPDLPDSESNQENFSGNRFPFAPRWSLNAGMDYRHPSGLFGGVDVNHQSKMYQDNENFDVNEFGERMLVNARLGYQFSENMQLSAYVKNALDEQYFTSLNVISPGDEFSRLGAERTYAVRLDFDF

SEQ ID NO: 502 - protein, 647 aa, Escherichia coli str. K-12
MKPLFTYSLFSTSVVSACITVPMVVVANDQLPETGINTTAMETVVVTASGYEQNVTEAPATISVLTREQLENRSYKDLTDALSDIPGVTVTGGGDGQDISIRGMPAQYTAILVDGRKQSGRETQTNGSTSTEQDWLPPLSAIERIEVVRGPMSTLYGSDALGGVINIITRKNYQEWHGSLRAETTLQENSKSGNSYQGQLYLAGPVIDGLLSTSLTGLYQERKEDEIEGGYAGKTLDNYRASLYLTPTSDDTFTLEFTNHNQERETTLGKSVERESQVAVREYERQSIGFSHYGNYSWGTSSSFISNETVKNIGADKEVENSQINTQWGLPLNAHYLTLGASFEQKDLTDNKLSLTSKNKQWAVFAEDEWYLTDTFALTLGLRYDDNEIFDGQFSPRAYGVWSIDPSWTLKGGVSTGYRAPSLTQMDEEWVQESCRGRCSIYGNPDLTAETSINTEMGLYYVNERDLSANITLFYSNFKDKIESEFVDPTCTDSRSCDRTYVNIDDAISYGAESSVSKGITESITLSATYSYTRSEKNTNDDDDGLPLVQAPEHIFSLNGDWAVRDDVASWARINYQGKDKNNITSDSTRTLAPSITYVDLGVNWRVTKSVKLMAAVYNLFDAQTTEEEFGYIEDGRRYWLAAEATF

SEQ ID NO: 503 - protein, 1039 aa, Escherichia coli str. K-12
MTDIWNTSYRLVWNHITGTLVVASELARSRGKRTGVAVALSLAAVMSVPALAADIVVRPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRTEGTTNTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDMATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRVGTVRDDAGSLGGYLNLIHNASGLWADIVALGTRHSMKASTDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 504 - protein, 723 aa, Escherichia coli str. K-12
MQRVSFSLRKKPLTQFVLATLCATGAQISHADTSGDLGSVQSTAASSSNSATAASRNVQSAPAQAPSQGSLTATQPQSVISRHYIENSTAPTANYSEVVQIAPSVSNVSPNGSGLMESQSLSIRGFQDGQYNVTFDGIPFGDTNDFTHHSTSFFSNRVLGNIIVDRGPGDASQIGFATFGGTIALQSRDPSATPAFSVLGSYGSWDTWQAGAEFNTGYLQQWGDARAMVGYTQSSSDGYLTNAGQRRQNVYFKLDKPIGDNTLLTLFATYNNIHQNFSSGATAAQIQQFGPNFGLSADPTSQAYSGYNFDKINTDFEYIGVKSQVAGWVIDNKLYTYGYYHNGFNGLDPNGETPNGTIFGPNNVPGQEMNNNYRAFGDVLALERQLGPGKLQTGMWIAHQSNFRNNFNVDSSLNFAFISQNFTMNDTMLTFQPYLQYAWQLQNGLTITPGLKYVSFNRSIDTPMNQKTGEPLDFSHTWDKVLPSLTLHQQITPQWSAYAQYAQGFLAPNLNVFYVNNPNVSGQPDPEQTDNYQIGTTYKTGRLTVAADLYYINFRNAVTSRTVGNNVIFSNAGGSVYKGVETEATLSVGDGFSLYGNLTFNSAKQKSTNTWMPNAPQSTAAAGVLYERGPLAGSLLMKFVGHQYGDTGNTQPIGGYAVTNFASSYTFARLAPWTHNTRLGFQIDNLFNRTSINALAGYTAADNTPLYWTIPGRAFVATLSTDF

SEQ ID NO: 505 - protein, 797 aa, Escherichia coli str. K-12
MDKSGGPLCGGRFALLNLALFAACGSQLTAMPADTGNGTDAAVAHKSDLAGVHTEVRWLAQQAPSAPVSAEPSGSSEAPNAASTVGQSPANNGEVGDLLDETVVTATRTRERVQDVPRTVTVVSRRQVEQQSLLTTNLGDILGFTVPGYSAPSDGPARGTYRGRDVQTLIDGIPQTGNYAYSNQLRFIVPVSIEQIEAVGGPSALYGDGATGGTINILTRRGTETPQAKTRIGFNLGLSNLSGGPGYLFEQFASGKAGAFDYAITASYTGLGSVYDARGAQIPNEWFGTLGNTNTYNLYGKFGLDLGADQRLQFTAGYANDLTDPNSISDPAVTTSGGLQFAGAKNGRIQIQNSPYSPQPTKRNLQLALEYNHNKFLGGSKLLAQASHRNSFELTTVNDSRFTADGSGGPFDSINRGVWGEYITTARVQVETPFSDNFKLLWGSDFKNDPVEAWQLETFDPKIYDESGGFIQRRSGNFLFNPAYTLTNIAGFLQANWNISDQWIINGGLRYENVSFSVGDFVASNTGQSVTGGSLNFNSTVFNLGVVYKPSNEISLFANFGQGFSLPVFANPLTNASSGFAVSNSLTALQPKLVDSYELGVRGRWRSIQSSLSAYYTFSSLDVGFVQVSPTQFQSVRSPQRTYGLEATLYAQPGPGWTLGTTAAWVQGEQDPFNTGDYYPLNSYSVNPLKATFYLENQTAPGWRNRLQVLFSGYRDVAYNAILPTGFRVEQAPVGSYATVDYLSSIQMGAGTLEVGVRNLLNNQYSPVYSQYLSGFNDRNNFAARGATLNVAYNFGW

SEQ ID NO: 506 - protein, 673 aa, Escherichia coli K12
MSICAAFCCQFLSIPLFAQQQKVDTTHTYFIPEVTVSDIYQTREVRSTAPLQLFSKEALKNLHALQVSDAVKHFAGVTVKDYGGIGGLKTVSIRSLGAQHTAVGYDGIAITDCQTGQIDIGRFSLDNVDQLSLSNGQSDNIFQPARFFASAGILDIQTLTPRFEKGKRTNISAAFKTGSWGLVNPSILLEQQLSPQWTVSANGEWMSSDGQYPYTLRYGNAADDLTSREKRKNTDVETFRAEAGLYGNFSDKEQWRLKAYYFQSSRGLPKATTLYNDFSAQHLWDKNTFIQSQYKKEFSRQWVFRTSAKWNWSYQHYLDPAIKNNEGKTENSYYQQEYYLSASVLYRLLNNLSFSLSTDGSINTMNANMADFAHPTRYSWLTAIAGKYVNEWFTLSVSALATVINEQADKGGSAGNHRKLTPYVSATFKPFRNEEFRVRFFYKDIFRLPSFNDLYYQEVGNSKLKPENARQYNIGLTYSRNVCTFLPYLSATVDAYYNKVTDKIIAYPTKNLAVWSMRNLGSVEIKGIDATGSLSLQPRESIRINFSGNYTYQRALDVTTPDASSNKSTYKHQIAYTPRVSASGQAGIETPWIDLSYSFLFSGKRYALGQNIPENRLASYSDHSISAGRDFRIRKVTTSLSVEVLNLLDKNYEIVQFFPMPGRSVRATLKIRY

SEQ ID NO: 507 - protein, 995 aa, Escherichia coli str. K-12
MNRRRFPFSQARSGRRLAHSALIAGAVIPWPSAAQVVSGPQQANGVELEVAPGDYSTSQTGQSVLSAINGGRLTTAGKTRVFSTGHVAAGVAASGAGSRVELRDTEIRTRGRTSVGIDVRQGASASAARTSIDTDGDFAHGAYVYGANGRLRISDSVIVTRGKESSGIAVNGAPGGTVDVADTLIRTSGLFATGLSISYDGARATLDRTDIRTDGDYASVLYLPSASTVAFNDSYLETGGEAAVGIDTREGDVALARTRVVTHGTSAHGLYASKEYAGTPVIDAIDTHVTTTGDRSIGAIARLGGKIAMTRGSIETDGDRARGAMSTGTDSVVALTGMTVDTHGTGATALHASAGGKIDLLRTDARASGDDAYAAGVYDGALTIDDGSLVSERHGAIDASGATIMLRNGTHASGGNGTLLSVHAQTGAPVRLTLDTGSHADGDIVNHPADDGHPTHAITDVVLSKASSWTGATDAVRALSLDTNSRWTVTANSSVGSVALNDSTIAFADPAAGAPATPRTLVVTGDYAARNGKLVLHTTLQDDASPTDRLVIDGGHASGDTGVVIKRAGGDGAPTTVGIPIVETRNGGTTDASAFALDAASDGYRQGFGTLSAGGYDYMLARGGNGGKADDWYLVSAAKPEPPQPPQPPQPPQPPAPGDSEPPVFPETTPPTRSVAPEPDAYLANADAAAMMAVHSLHQREDRSLRTGGAASGPLDGAVWLRTEGQFTSISGGGRSVSGNGRLVHAGADLLRFDDGRGGSIRAGVMGMYGSQTNWSTRPLWNAVEQRTADATARGSVEGYNAGLYGTWYGNRDILSGPYVDAWFMYGAYANRVGGSLAGDSYRSRTVTGSLEAGHSFRVYERGDTRFFVEPEVQLVVSDYRAAAHRAAGGYVDGQGSTDVLTRVGVRVHGVTAIAPGRELRPFVEANWWHGPGSRSLTLDGNAFSFSVPRDRAAFRIGATGQVSKRFTVSASLGVEANLSDYAVVKGEFTAKYRW

SEQ ID NO: 508 - protein, 676 aa, Escherichia coli str. K-12
MQGRFFPALLMASSLHSVSVFAANESNDDLFTLSMEELLDVTVSVSNKTETKINLSPASVSLFSEQDIASLGVTNLIELLQHVPGFYPVFNSVEGNQSYLVTRGHAQKYANTVLFLLNGRRINEDYTGGINYLIRHFNLASAKRIEVIRGTGSALYGANAFNGVVNIITGTESYVSVSGGNNGMIAADFALNGHLGELNWGLAGAYYQDDGETYHNIYDRLGLQTSTQDPIDSQQLELSLQYADFSWHSFLQRSAFEDYYLFRRVSDEHNQVQLENWIHQLGYQFWRQGGEHLTLSAQWQEGERQSLAMLAPQDNEEFVQADFLFGEQFKYQSLQLALEGAKKLNNDWLLSAGLEWSESKLPDGFVKSNYNLYGDLEWLENVTVFDLPQQRTVLDKTRFIRSAYLQTQTELTDTLNLTMGLRFDGYNDIASKLNPRLALVYQPAEHHVLKGIYGEAYRVPSLGDLYDEESGLTQGNTSLRPSTIKSYELIYNYTGSDFFISTTLFHNDIADLIGFDSGDTVALANIAKSNASGIELEWRWNVTESVRLQGHSTHLFENESEIKAQASLVPSEQLSPDNYMMTLLDWQIASQWQAQLQWSYRDNIAITDDHNTLSLLNASMVFLPAAGHRWQLKVSNLLDKTYQVPVIQQIGSSNGIAINELPSRGLAVSIKYSWHF

SEQ ID NO: 509 - protein, 621 aa, Escherichia coli str. K-12
MNVLKRWTQVLGVIGCMFWPMSAVGQGSATELGPLVVTATLAEKAVDQVPGAVEVLDQQQLVETGAETVSEALLYATGVMLITAEGRNVGTSIRGIGRNHTLVMLDGRRLAGSFKAQMDVAQLPVTMVERIEVVRGPASALYGSDAIGGVINIITRQPTAQTEAGLDVRGGFGPSAEHLGQIYVGGGSENIQANLGVARSVKDDWDGDSALPDDVDETSLNSVLGRANVNIGPKQQLLFGGEYGHFERDGGRYYQNINRRYDADDRRWGGFAEYHLNQGEPLSAMVRGYASQYKATSSFDPPTSKSEERRRLIQGEGRVTYSTSNRFILTSGGEVREDSLKVGGMDHNEEKVLNSALFTQADWRITQQLNLVAGVRFDHHEDFGGHLTPRATLTWHYDHGRVWIGYGEGFRAPNLNELYVTSILKKGFETYQNNEDLDEETSQSYEAGTSFHWGRFRSQLVVFRTDLDDLIAAQLQSASGKYKTFTMVNIDEVRAEGVEFESSVALPGDVQLSGQFSYVDTEDRQTHDELADEPRWKSGVTLAWLDPYWGVMTQVRWLYFGTSEDGESNEQDAYQLTHLHVEKDLTASLTLYGGIDNLFDEEHDDFTLSPRGYYLGVKWVF

SEQ ID NO: 510 - protein, 415 aa, Escherichia coli K12
MRGGRTCALACIDPAESDSCSINSRNGPGAGVFRTSPSRSYARGRASQAPGGGRKVCASRGLVGVFRVTTSIEGEKRMRIRTLPVCLALAAAVVQAHAADDRFYLAPSVNYTFADSDRQADDDWGLGLALGKPVSRHWNLELALSGASLNMDSGGGEYDLIGLGVDAVYLVNRDADFTPYGVVGVGALRTDIPGSDDVGVAASAGVGVLKRLTENVALRADARYRWDDNAADAFNEDNFGDWIVGVGLTIALGKSAQAAPAPQAAVEPVPAPEPAPAAPEPAAAPAPALQTEQAAQLERSQAGDVVVLPEGVNFAFDSAELRPDAVTVLDEAVTVLNRRTDIKVDVVGHTCNIGPEAYNQGLSERRAKSVYDYFIDNGVAADRLTTQGYGETRPAYSNDTREGREKNRRVELHVK

SEQ ID NO: 511 - protein, 724 aa, Escherichia coli str. K-12
MKIKNILIGCALLVSGWLAAQNDFRATIRDADSGEPLIGATVLIEALERGGTTDTTGTILLTDIPDGTHTFRFSYIGFEPQEQTFDLPLPARDPEPVIELHPAHEEMEQVTITSTRSTRSIADIPTRVEFIAGEELAEKGNMKPGDIRMLLNESTGIQTQQTSATSYNSSIRIQGLDGKYTQLLRDGMPLYSGFSGGLSLMQIAPLDLKQVEVIKGASSTLYGGGAIAGLVNLITKTPGEEEELSFMLNGTSALGLDASGFYSEKYGNWGATVFASYNMGTPYDPADIGLTAIPEFDRFTLNPKLFVYFDDATKMHAGVNLVTEKRLGGNIAFAKGEEVADPYFEANETDRISTQFELDHGLGGTGRLQVKNSLNFYDRSIAIPNYAFGGRQFSSFSEANISWGGEQSEWITGLNLWTDRFTQSEGDPERDLGYSNATLGGFVQNTWNLAPLWTLESGFRLDYQNRYGWYALPRFSLMFDPASAWTFRLGGGLGYKTPTVFSEDAERLQFRNILPLDMGALKAEESAGANFDINHRMPLAPGLVMSSNVLFYYTRIADPLLLIPAGNLFEFTQPDGYVDTHGAEVNLKWSYGDLKLFVGYTYANVKEHYNGEASDFPLVAKHRLNNVLMYEKHDNFWIGLEAYYFSPQQLSDGTTGQAYWITGVMTEKKLGEHLSVYLNFENFLDTRQTAFDTIYTGDLSDPQFRDIYAPVDGFVVNGGFKWQL

SEQ ID NO: 512 - protein, 236 aa, Escherichia coli str. K-12
MKKYYPLLTVILLGLPLCSQALTLNLRGGYRSASHAYETLIQVSQGWNNGWWASFESNTWNTIHNNENELFALNYNKIDINKTYKIDDKWALIPGIQTQWMSAGSQYNPYLKISYQATPDLNLALRYRYDWKAFRQTDLDGNRARNDQHQFDGYVTYKINDSWLFAWQTTVYTKVNNFKYGNHKKTATENAFVLQYKMSPVFTPYIEYDYLDKQGVYKGKDNKHENSYRVGVLINF

SEQ ID NO: 513 - protein, 388 aa, Escherichia coli str. K-12
MKLRSMAVAALLACSGGALAQSSVTLYGVADVNLEYVNHVGAIPSAANQFNRGPSNDVYRMNAGGFSGSRWGIRGTEDLGNGLKALFVLENGFNVDTGTLQQGGRMFGRQAFVGLQQAGIGQLSLGRQYASMFEALANFAPAAYATQYEPTVLMTGPNFRQDNTVKYTGQFGPVTALAHYSFGVGLALPQTVGIATPIGGNGENPGQARRDSAYGAAVAYQGGAFGVTVGYDQWNPTIGTSSGTVRKAAVGGSYTFGSLAKIMGGYRWGQNKNAADVVIQRDDFYWIGANYQVTPAIGLTLEYNYDNVKSLYGDTHVANPWQIALIANYAFSKRTDLYLSTAYAKNAGLMMESLATVYANSLSLGNNYVLANGQSNMLGVSLGIRHKF

SEQ ID NO: 514 - protein, 246 aa, Escherichia coli str. K-12
MLINRNIVALFALPFMASATASELSIGAGAAYNESPYRGYNENTKAIPLISYEGDSFYVRQTTLGFILSQSEKNELSLTASWMPLEFDPADNDDYAMQQLDKRDSTAMAGVAWYHHERWGTVKASAAADVLDNSNGWVGELSVFHKMQIGRLSLTPALGVLYYDENFSDYYYGISESESRRSGLASYSAQDAWVPYVSLTAKYPIGEHVVLMASAGYSELPEEITDSPMIDRNESFTFVTGVSWRF

SEQ ID NO: 515 - protein, 991 aa, Escherichia coli str. K-12
MTKLPIILYLTIAIAPLAAQNGTAALSGTVMDPSRSVIQGARVVAVSSSTGFRRETTTNAAGVYQLPGLAVGAYNVTISREGFKAAQFKDVELTVGEPRTIDARLEIGSVADSVEVSATLETLNRTSAEVGGLIEAEQIKELPVSGRNWASLMMLAPGAVNYSDGSQRNIRFNGHSIDDANYTFDGIDNNGVQEQTQKAETRLNIALDSIAEFRVSTAVYTAESGAAGGVQVQVVSKTGTNQFHGSTFYSLRNDALDARSPFDGPTIPPFTLHQFGANFGGPIKKDKAFFFMNYEGLRQDLGITQISYVPNAAYRAKVIAASPVLKPLMDAYPVGQTHLDATTDQLNLVASNTVREDSGMIRFDYRFNDTNTMYARYNIDDVYIDNPTDALGSHNVVPHVPANAVVAFQHIFSPVTINEVKFGINRANYHNWSYGIAPVAVSVSSASFSGLTSNSLDTEVGTTFSYIDNLTVVRGKHTLKFGGNIMRVRLNNSGNTLTTQSLSYASTDDFVANKASSATYLQGEGVAGNRRTFFQGYAQDEFKVTPNLTLNVGLRYEYYSVSHEILNRSAVVDILGCGGFCPKGTPYYEPNPKDFGPRIGLAWAPAFLHGKTTIRSGFGIYYGGNQNDDFSDPAESYVPRYSLSSSDFPALAYPLTAFLDPKNQLYSPKAIDRHRKDLSYNNWDFVIQQQLGHDFVGQVSYIGGEGHHLFSKYTVNLINPATGTRPLASFGSFGYKTNDGNNNFNTLQSSLQRRFTHGLLFQMNYMWSHGIADASIGSGESMAFQNMGCRACDRSSSSIDVRHVMTTNAVYQLPFGKNRLVGGWELAGIASARTGLPVNITVSRTAAALLDGNTSGQRPNLVAGVPIYAENQSINNWFNIAAFSAPANLVWGSLGRYVANGPGAYEIDSSLQKRFHVSERVALHFRASAFNVLNHPEFKTPGASVGSVSGSGSNLTIKPSASFGRITGILNTGATGTGAPRRIEFQFRAEF

SEQ ID NO: 516 - protein, 145 aa, Escherichia coli str. K-12
MTTEPFQASNTNRHVIGAACAAVPGATATAAAHAQSSVALHGLLDASIAYTNNQSGKHTWRQGRGLPSHTVFGLSGSDGPGARLRVAPRAGRIVDAYASRGDDRHPASVPTVRSDGAPRTPPSVRRANSACRRRGRKRIGGPDRW

SEQ ID NO: 517 - protein, 1411 aa, Escherichia coli str. K-12
MSGKPAARQGDMTQYGGSIVQGSAGVRIGAPTGVACSVCPGGVTSGHPVNPLLGAKVLPGETDIALPGPLPFILSRTYSSYRTKTPAPVGSLGPGWKMPADIRLQLRDNTLILSDNGGRSLYFEHLFPGEDGYSRSESLWLVRGGVAKLDEGHRLAALWQALPEELRLSPHRYLATNSPQGPWWLLGWCERVPEADEVLPAPLPPYRVLTGLVDRFGRTQTFHREAAGEFSGEITGVTDGAWRHFRLVLTTQAQRAEEARQQAISGGTEPSAFPDTLPGYTEYGRDNGIRLSAVWLTHDPEYPENLPAAPLVRYGWTPRGELAVVYDRSGKQVRSFTYDDKYRGRMVAHRHTGRPEIRYRYDSDGRVTEQLNPAGLSYTYQYEKDRITITDSLDRREVLHTQGEAGLKRVVKKEHADGSVTQSQFDAVGRLRAQTDAAGRTTEYSPDVVTGLITRITTPDGRASAFYYNHHNQLTSATGPDGLELRREYDELGRLIQETAPDGDITRYRYDNPHSDLPCATEDATGSRKTMTWSRYGQLLSFTDCSGYVTRYDHDRFGQMTAVHREEGLSQYRAYDSRGQLIAVKDTQGHETRYEYNIAGDLTAVIAPDGSRNGTQYDAWGKAVRTTQGGLTRSMEYDAAGRVIRLTSENGSHTTFRYDVLDRLIQETGFDGRTQRYHHDLTGKLIRSEDEGLVTHWHYDEADRLTHRTVKGETAERWQYDERGWLTDISHISEGHRVAVHYRYDEKGRLTGERQTVHHPQTEALLWQHETRHAYNAQGLANRCIPDSLPAVEWLTYGSGYLAGMKLGDTPLVEYTRDRLHRETLRSFGRYELTTAYTPAGQLQSQHLNSLLSDRDYTWNDNGELIRISSPRQTRSYSYSTTGRLTGVHTTAANLDIRIPYATDPAGNRLPDPELHPDSTLSMWPDNRIARDAHYLYRYDRHGRLTEKTDLIPEGVIRTDDERTHRYHYDSQHRLVHYTRTQYEEPLVESRYLYDPLGRRVAKRVWRRERDLTGWMSLSRKPQVTWYGWDGDRLTTIQNDRSRIQTIYQPGSFTPLIRVETATGELAKTQRRSLADALQQSGGEDGGSVVFPPVLVQMLDRLESEILADRVSEESRRWLASCGLTVEQMQNQMDPVYTPARKIHLYHCDHRGLPLALISTEGATAWCAEYDEWGNLLNEENPHQLQQLIRLPGQQYDEESGLYYNRHRYYDPLQGRYITQDPIGLKGGWNLYGYQLNPISDIDPLGLSMWEDAKSGACTNGLCGTLSAMIGPDKFDSIDSTAYDALNKINSQSICEDKEFAGLICKDNSGRYFSTAPNRGERKGSYPFNSPCPNGTEKVSAYHTHGADSHGEYWDEIFSGKDEKIVKSKDNNIKSFYLGTPSGNFKAIDNHGKEITNRKGLPNVCRVHGNM

SEQ ID NO: 518 - protein, 1305 aa, Escherichia coli str. K-12
MSNTAVTVSGENVPNNVKNKNKIQLSGSASLTIENGGSLSPADWIILPGATASVTVTGAGSTLTTGEVQITESGASLKVEDQGKAVLNKLNLDKGQTLVTGQGSSLQVKADGSFRVGNNGAATLQIKDGGALTSDTMLTLTNTNTDSATLGIDGAGSSLNVSGEVSSGAGGTTAITVLNGGSLNSQGATLGKSDGNKTTVLIDGAGSRWTNTGAITLNAQASVQLRNGGALDLGDKTLTLTGQNTSLNLGGTNTEGAAATGTLLAAAVAFSKSDATAATQALVFNHSDSEGFEFGAKLSGDGKVILKHGLTRLSADSSQFSGSTEIAGGSLQVVGKLGGKLNLINGELQVSGTVDTPEALTLTQDTSDTASLLISGSGASLTTAQTVDSSTGGGMASIKILDGGSLNSQGATLGKSDGDKTTSVLIDGVGSRWTTTAKPFTLNDNATLQLRNGGTLDLGDQALTLSGKDAEVSIGSLSTEAAVAPGLLKTPEVAFATNNSDDTLQILAFKHTTNGLDFSPKITGNGSIVVEQGLTNLTADSSTFSGETLITGGSLDVAGKLGGALTISNGELKVSGTVDSQSAVQLKSTRSSSLLVEGENASLTTASTVNAQATEGKVDIKILDGGSLKSQGATLGKPGDGESTTVLIDGAGSHWAATQAFTLNDNASVQLRNGGTLDTGNKALSLQGKHSRLILGGEDAAAAAGTLSTKGLEFSSLDDSAATQQLVFNHNSDNYEFGAPITGRGHITQQHGVTLLTGDSAAFAGQTDVLGGTLRVDGKLGGTLTVHSGAFLSGTGQIGSTVINEGGTLSAGGRQPVTVMGDLEIKNGGALSVALASDTVPTQALLNVSGKTKLEETSKLDVEARDAQLDAPYLLLKATGGVEGKFGTVSSKVDNNLAFIDTTLDYNTPGQISLTLTRRANDTFASQAVSSNERAVANALDHMPESGELPQFVQRLPKGAPAAVFDALAGDAHTSVSNALQQSAVAPVMQVPMAHLRSNLQAGLLPGAPLAQSGGSYPVSALPSSAAQPLWAQTFGSWQHDKGDSNAPGGRAFTGGLFIGVDQALGKNKDIRLGAALGYSQTQVNIRTRSAKATIDNFSLTAYGGKQWETGLGQLNLLAGGAYTSHHIRSKRDLSQVGLADTLRAGYHGNTVQLFTELGHAFPWRHGYVEPYAGISLNRLHTESYTESGGVAALHGAAQSRSNLVTSLGVRAAYDLKVSGKDLRLRAGLAWRYTGQDLTPQSKLAFQNGPDFTVSGTPIARSTAQAELGADLAISPKATLGVGYTGEFGSRSRQQTATLQGRWAF

SEQ ID NO: 519 - protein, 674 aa, Escherichia coli str. K-12
MVDLRGLEYVAPNLTVQSINGTASTNFYLRGLGFNDFTQNNMGPVVTYVDDVAYPYSTMASGLMFDMADVTVTPGPVGTEHGQSTTGGEVKLRTNDPTDSFHFGASQDMASYARSRSEAYVSGPIARGFSFRVAAQVNQGGGWQTDPLNGAHLGDADSWALRAKLKWTPDSRTTVLLSGHVVRDESEVVGGVPIARLIGSTPIPAVGWTQTEWSAKNAFTNLIGRNAGLKPSEDNWFWGADLHVAHDFGPVTLTSVSAFETEREGEYTDQDATAAAQADAYRTIAANSFTQELRLSNTNAQDRLQWVLGAYYQRSRMNQSFYFDYTDYLPARGYMQDSSFGLNQEATSEFGHVSYRLPGNVTLFTGLLHEIDDRAITGLTSRIYGGRTLDFHGESTAAAQFAGQVGVSWQATKSVLLYYKMSKGFKPGGFTANNTQVQAQLAPFKPESVLTYELGLKSDPIPNVLRINAAAFYNDFHNQQILGTILIPDYGPLSQLTNVPKSESWGFEGTIDLHPLRHVFVTQNFGWQRGTFQDFPTVNRAKTNAYYAQHGVWKAINDNFSGVDNGQPKLTLNGQLDWRQAVNPRYAVEFGPNWVYRGAQAMTPGGTGFYRLPPYFLLGAHVTLRPASDRWQVTLYASNILNRQYYTSGGQATTTYLYIPGAPRFIGGRVSCNL

SEQ ID NO: 520 - protein, 980 aa, Escherichia coli str. K-12
MLNILIICIITTTEKYFQRKANIIYIVSNQHIIVVFSSAKTLQISYIGMQTQEVAIKPNLRVVLKSDAQLIDEVVVTGYGVTKKAAFTGSAQTVDNKDLMKKTDANFMKSLEGSVAGLQVNSLTGQPGAYASTTIRGVGSMNSGTEPLYVIDGIAIYTDKMGAYNKAGTGDMAASPMANINPNDIESITVLKDATATAIYGARAANGVIVVTTKKGSLGKARFNVNAKVGTSFVGKIDHNYRTTNLDKYKEIWTEGLTNAGYDGEDGMTSAEWLNAYVMDWYNVDLTQNIKSVDWLKEILQNGFSQEYDISAQGGNENLRYYISGGYFQNTGIVIGTGMKRYSGRISLDGKSGRIGYGLSVNGALSDINNTMTESQYTNPIVAVYDIRPFEQVRNEDGTYNTNVNYNPVAINDKEKGDKRNQKQITLVVNPYFTYNIIDGLTWKTNAGLSLIDLDEFFYSSIYNPQYSGSGMLGQRNQERATTLTITNTVNFNRTFKDMHHLNVLLGQEAQKISYRTIYAAASGYPSDAVFELDNASKPTGAGSSTKASTLSSFFMNAEYNLNDKYYLSGSFRYDGSSRFGVNNKWAPFWSIGAKYRISNESFMENTKSWLTDLTIRGSYGTVGNQDIGYYAAMGLYNYGYSYNGKPGAIPYQIANPDLKWETVAKADIGIHAVFFERLTLEVDYYNQRTKDMIFDVPLSYTTGFGSILKNVGEMENKGIEFLINANVLRNKDFSWDVRFTGTANKNKIIKLATEKPIENTLTIRKVGEAYNTFYMPEYAGVDPETGEAMWYKGQEGDEKTKNVNEAGQRIVGSADPKFYGGFGMNFKYKGFDFSFDTSFTLGNKVYNSGFAFDMQVGHYFLGPVSNYVYDNRWQKPGDITDVPKFVAGDNSGAETNSSRFLMNGSYLRMKSMVLGYTLPKNLMNKVAIDNLRVYISADNLFTITAKDFIGFDPQTRSTGMQSWAYPVPRNIMFGLNLSF

SEQ ID NO: 521 - protein, 589 aa, Escherichia coli str. K-12
MKNIRSMATVATVSLLSVLPFAAQGQTAQQTEIEEVLVSASLLPISASRSANAITVIDSKQLKNRAALSVSDLLRDVPGLAVSRSGVQGSATQIRVRGAEANHLLVLIDGVEANDPSQSDELNWGTLSAADIERIEVIRGPQSSLRGSDAMAGVVNIVTRRADRPLSVNLFSETGSFGTYHSGLSIGSKQGDFDGRLSVNHIETEGENISRTGSEKDGYRNTNINLNAGWTVSDELRLSVAARQSDGMNEFDADGDFDGLVDDQEKVSEFRNSTMRIQGDYVSADGRFQHKLVIAQSNNDNEAFDTGVLGTYTSSTKYQYQYVGSAFWDESSQRLSVLAEHEEEDFQQRGAIDDYGIYGIYDPNQDRERNTDSIAIEYRNDISDALSLAASARYDDNSEFDSANTVRVEAVYQLNDGTRLRSAYGTAIKNPTFTERFGFYTNFIGNPSLEPEESTSWELGIDQMLFDNSLTLSATLFDTELKNEINGSAVDPVTFGYTAVNKEGKSQRQGVELTAIGTLTNSLSLNAAYTYTDSVEWDDETRVYIDEVRRARHMASLNLSWQAMDIFISIPMSSITALKLMWYFPILWL

SEQ ID NO: 522 - protein, 800 aa, Escherichia coli str. K-12
MIQKIFLCVFFCSATFISSAQQCTYNFKGIVTDYHDGTPIFGASIFIKSLNKYATSDARGHFEISDLCPGKIEVRISHISCETKEVFITLDNSFFQEFYLEHHTEELKEVRIVATSKLKTKTLQSSVLKKELIDAYSNSSLGDILKNIAGVSAINTGNTIVKPMINGLHSSRIILMTNGVRLQDQEWGIEHAPNIDINTAEKISVIKGANALEYGGDAIGGVIVVSPDRVLVKDTLYGKSILTGQTNGSGFSFHTALSKATKAGWYVNAKTTFKKYGDFESPAYVLSNTGLNSQAFSLRSGLKKFETGFNVYYTYVKNNIGILKSSHIGNVEDLVHAINSNEPLIVAPFSYDIDAPKQEVTHQLVKIDFYKRYRNTGKLVLQYDFQNNQRYEYDIRVGADKEKPSIDLNLNSHTLKTSFEFDSKSNQTYKVGLKAAYQDNFANPNTGVRRLIPDYYAYDLGLFTIGNFVLNDKTNLDLGLRYDFNYINAKKFYFKSRWNERNYDIDFNHLIIGDFKTQWLVNPTFKYHNFSASAGISHQLNEKNSVLFNYALSSRAPNPSELFSDGLHHSAARIELGDLRMQQELSHRISSSYYFENEKTSVLIDLFYNLIHNFMYIEPEGTEQTIRGAFPVWGYKKTNASLFGVDINWQQQLTNKIDFNNKTSFIRGRDLVNDRHLIDIPAANTVNSIRYQNKKWHHFNATLESNFVFAQNLFPNNNFDVFIPTTNNTVLVDVSSTPNSYHLLKFNTDTSFKLSENSEITVGFTITNILNSKYRDYLNRLRYFADDLGRNYVLQLKFKY

SEQ ID NO: 523 - protein, 767 aa, Escherichia coli str. K-12
MTIVVKDQITERPLSNAQITITERENNSTRSVETDARGRIVIEPLDPGLYSVNVAKGGFASSYEPSVRVITRKNILIRFELLEQLGEMVELEGVVVRAQQADTFASASSSYRNREELRSSVGGGADPLLSLDGLPGLASTNEFANFNVRGRGPRDNLLFVDDFPFDKAVHFDATLGEEEDVGGGGRFSIFAPNVISGAEFSPGGWGPAYGGRAASLLKLEVASGNPSPSASLRFDIAGNEFGYDGPAGITEGSTLLVSARDLDFGDFFEDIEELDIGNPVLSDIIVKSVIPINENHTFEALLIDTQEDYTRDVTHVFASPNFEDAALLDFKQDSDLYGFTLRSLIGAEAVWTNKVYYRKSDKTSSEGEAFPDLVPPGSPASSFPVRENIITIGEGEKETGWRSDFTTVNQWGVFSAGIQATQVELDYDTVLDGNWNRFVYDADDFRPNSDQRYITLTPASINASLNQKETNLAGYVDQVFERGDWDIRTGLRFEQDGFADQSFASPRFSVNWRPSNTVRYFATAGLFHQSPRYLDLAADTSNTLENEEITHGSFGVQFFTNENWSVLTEVYYQNLDNLVVDLDRVNGTYSNIGDGTSYGLDIVVNGTIREGLYATATYSYNDAVVDEKDGRGDVAADFSREHVATLGMTWEISDRWKVAARYKYLSGRPYDDFIIHSDVLGAGQPLRFSKEITERNVGRNSGYGLLNLRVDYRRSFGPIDVTTFLDVINLTAASSSDDTEFDYRRGVQVEDESEAEPLIGIRLDYAW

SEQ ID NO: 524 - protein, 933 aa, Escherichia coli str. K-12
MLEKYYFNKSCIAIAISTFLSTSVAYADSLESPHSSIKLSDEISAKYSGKGVKLGVLDGGFVVKHPLHSSKLNLSGFKLTSPDGKPLNYDPGYLQFEVKPVEQNGKKGLAALFEIHGLAVSGIISAKASEKEGFKGGVAKEAEIHIATNTPNRSLSELIAEANQSKGEDEEKGDSENQKPDFNELAKSDLLISKDKKLSFERLEWATALNKLVERNLFAINNSWNLDPISDNIADFDKFYHSLSTDKQNSLLQAVLNAKKKNTLLVFAAGNESKKQVGVMAMLPRYLPELEKHYLSVVAVDNKHNLTDYSNHCGVSKNWCVAAPGNLAILNAIPDSTTLKPQYNLGKEQGTSLAAPVVTGALAILKERFSYLAPTQIRDTLLTTATDLGEKGVDDKYGWGVINIAKAINGPSQFLNDETVNVTRDDRWKNDFSSKFKFTKQGEKSLDLAGKNNIARIDVEQGRLNLSGMTQSQQVKNNAHLGVNQTEIRQGYMATENSQLTLLDSNGLIGKDKAIIQLNGSLKIADKLTENSKQGSISATVVKLHDKASYQGGFTKLIDNKNLANKGLMQDLYFKQSEIIAKVNSNKAFTDPNANDNAKSGLNLLNQLRTSSFAYRQGVYNDWLQSALEKKKLGQLHYAVSNHIYADALALLRHQNAKQLSHVQHNLFTAAYSPQKTSVWLEHSGQKHSKVAIKQNSSALSLSHKFNDNALLSATLMRKNHHMDKDFAHADLKQTSLNIGLRYPLADHWFSELALQFGQQKYNQRRWYKKSQLGQAQNKGHHMGGEIRVGYQFMPQTWIIEPSLGVQFIQTRMKALNEKGELATNTTALHYNDINLTPSVKLKYTVKFEQGSISPYVGLNYLHRVKGKESKITSQLNGYPLQSYATQKRNHALNLEAGMQFQYKNWFVYANVDYDRIKSTNAFGWKTNIGLTF

SEQ ID NO: 525 - protein, 727 aa, Escherichia coli str. K-12
MAQGTGAVTGTVVDAADGAPLVGATVRLRAAAAPTVVRRGVTGETGTYQLDRIRPGRYVLEVTSLGYQRRHVHVTMEVGESRSVDVELRRDAFGLETIVEAPSRTRQRLLEAPASTTVLEPARIRREAKTSSVEALRAAEGVDVAQTGIDRREVALRGFNSAVSAGPHVRTDHREARAPALGLNLYSVMPNTTLDLDRIEAVQGPAGALYGTGVDGGVLHFVTRDPFRDPGTSFALSGGSRRYLNAQFRQAGVLGGAVGYKFTGQWGRADEWGLDPENARDVAELGRYRVYEDPESPALEGRNFVVRDVDGDGSAEAQLRREDRYRRYNVNGLLRYRFDRTTSLSLRGGYASLTSPLQSPIGTLQASNLGYTYGQLRLDAGDLSAQVGLDRNLSGDGTYLYRTGNAITDEGTRVDGRMQYAFGVDRLNTEVLVGSALDVTRLQSVPGGTTPDEEAFSTFGTYLQTITPLAPSVSLTLAGRADYLSVREEVQFSPRAALVYTPAPKHALRVSYNRTASVSSASPLLQLAPEVSAPPRATVTQTLEVGYKGQVADRLRIGVDGYYETRDDVFVPVGIPVEYQNGGTISYGGFDVSTELRASDALTAFGTMSVVSDDSFEGGAGRGDIALNAPAFKGKGGVDYGLPYRTTIGATVHHVDDFPVRFGPYTGTVDAYTLLDVRLRSSLPAVPGLSVNVTAQNVLGNAHREFVGSPALGRMVVARLTYELPSP

SEQ ID NO: 526 - protein, 1071 aa, Escherichia coli str. K-12
MKFIFISIAMCLSLSVFSQQKITGRVTDSSGIALPYVNVILENSSKGTTTNDAGRYSISLEKLKGNLEFSSLGYKTQLVPIKGRNTIDVVFYESESVLNEVVVTALGQARETRGLGYAVQSIQEKEISEVKAPNFLDNLGGKLAGVTVNQGATGVGSSTKVTIRGEASFSNNNPLLIVDGTPINNNTVFPATSEAAAGFQEVDFGNGAMEVNPDDIASVSVLKGPSAAALYGTRASNGVIIIETKDGSKQKGLGISINSSVFIDTAFQLPEFQNEFGQGNSGQFEFVDGLGGGINDLITYSWGPRLDVVNMISQFDSPVVLDNGTLVRGGDTSVYGEEAITPTAFNSHPDNLKDFYRTGVTTINNAAVSSGFNNGNYRLSFTDLRSESILPGVNLDRQTVAASLNFKPLRGLKIRSHINYVNSGSDNRPANGYGSENLNYSLVAWGPRSLKIENLKDYWQPGLEGVKQFSYNYTYFDNPYFTLYENTNSFGRDRVFGNISATQKINSNWSVSLRSGMDYSNEKRKFKRAFSSNRFKNGAYGEQDVLYREINTDFLINYTKDFGDISADISFGGNRLDQKVSNTQSQTTTLAQPGVFKLTNAASPIEVYQFESEKRINSLYGIAKLKYKNFLFLDVTGRNDWSSALATPFSVDNTSFFYPSVSSSFILSEVIELPEVISFVQLRASWAQVGNDTNPYQTTGAFVSQTPYRSQPTYSDQNIISNPNLNPEQTTSYEVGGDIRFFNDRLRFDVTYYNALTEDQILSLPIGISSGYTQKVVNAGKVRSQGVEIIAGMVPIRTSNFQWDATFNFSKNVSRVEELPQEAGRLTLAYNRIYDNPDQTVWLQVEEGGEIGDLYGTGYRKNENGDFILTEEGRYIADNNLQKLGNYNPDFMLGINNNFNYKNWNLSFLFDWRQGGILVSRTRALATVGGQLAETTPRPEEGIVPQGVVNMGTEENPEYVQNTTAVSAESYYRQFYDRNHEENNTYDASYLKLRQFSLGYTFDLKNDFLGFMKQGGTVNLSLIGRNLFALSEIPHFDPEQLAVQGQGFISGVEDMSYATTRSIGFKAGINF

SEQ ID NO: 527 - protein, 731 aa, Escherichia coli K12
MTMRFNLLPLAAAVTLALNPLALMAEEQTASTTETQDQNIEKITVMGKYTVSRNIDTATGLGLTLRETPQSVSIMTADRIEDQALNTVVDVVNNTVGLSSSKTDNVRNGFSARGFTVQNYQIDGVPLSWSLGGDAGETVSDVSIYERVEVVRGATGLLTGAGDPSASINLVRKHADSSDLKGYVDVATGSWDKKQVTADVSNGLNEDGSVRGRLVAKYVNSDSYQDLYQDRKTILYGVVDSDITANTLLRVGGSYNHNDPKGAMWGALPAVFSDGSATDWDTSATTAADWSRWETKNINYFANLNHYFSNGWQLVANYNRMGYETTTKMIYMSGMLDKDTGAGLSGQRYHSHGESNSNNFDVQLKGDYDLFGQTHEFVTGAMYSKQKSYADTYEPIRDDMTGWDSQVVDNFYEWQQNQFAEPEWSSNANRQLNMDTEQKGFYAATRLTITDDFKLIAGGRISSWNREGVSYGTDTNFGDDGVFVPYVGALYDINDAHRIYASYTGIFNPQNKQDASGDYLDPLEGKAYEIGLKSAYLDDRLHTSLALFKIEQDNFGKQDPDFVPTEEQIANGQTTAYYAIQGTESKGFELEVVGEFIDGWNISAGYSQFKAEDAEGNKLDTTSPRKQFKLFTTYQFVDLLPELTIGGGVNWQSDSYSTGGNVTITQDAYSLVNLMARYDLAENMDLQFNLENLLDEKYYAYMSTSSYLPEAYSVYHYGAPRNFTVSFNYRF

SEQ ID NO: 528 - protein, 636 aa, Escherichia coli str. K-12
MRNDASVVNDYAPVGYFEGFAIRGFPVDLASAIRIDGLTVSGEQNVPLENKERVEILKGLAGIDSGVVAPGGVINFVTKRSANVASVTTGVDSRGSTSAAVDLGRRFGPDHQFGFRINAAKENMHSYIDGTNGRRTFGSIAADWDISPRASLQFNAEFQQWIQRSAPGYQLLGGTVVPSVNTTSKALGTQPWAKPVTTDALNLNARFDYRFNDDWNAYIAAGRSRTMIDDNSAFAYGCYYAPSCAAGATSPFFFGANGDYDVYDFRSPGEYRRNDDLRAVTTGKFATGPLRHELTLGVSVQRRVVHMANAVYDYVGSENIDGPDIAFAPSPNTAGPSYPQLDSWQYGVFGLDRISIGEHWQVLAGGKEVLLRQRSWDSLDGDATHTDRSVFLPQVALVYKPVNVLSLYASYSKALSLGDQAPVRATNAYAFLPPVESHQFELGAKYDWLDRLSLTAAVFSISKPFQFADPDASGTSYTFVQRGTQRHQGIELGAAGRLTERLSLTASVAAIRARAYDSGSPAYEGHQIINVPALRASLYADYAVPGVAGLNMLGGVEYSAGRNANEEGTARVPSWFVFNLGARYTTKIGGHRTVLRVSVDNLFNKFYWRDAGEQQGDAYLFPGAPRTARVSLTYDF

SEQ ID NO: 529 - protein, 811 aa, Escherichia coli K12
MVLWFFFSAGTIVNAQTSGIRGRVKADSVSVEYAYVLLKETPFGTVTDSLGNYRLDGVPAGTYIVQVHCTGYQKTERKIVLLDNIVVLNFNLKEDENTNDIVITGVTRATLISENPVSIVSVSPQQMDQTVESNVVDALVKNAPGVTALKTGPNVSKPFIRGLGYNRVLTLYDGVRQEGQQWGDEHGLEVDAYNIHKAEVIKGPASLMYGSDALAGVVSFMPYIPDQNDSTLHGKFTSEYQTNNNLIGNGLQLTYSTAHWVAAVRGSYRAAKNYRNQYDGRVYNTGFDEKNVSALLGYKNSRGYSHMNITLYDNLQGIPDGSRDSLSRKFTKQVYEGAVDDIANRPVVSDKELNAYKLSPLHQHIQHYRIYNHSFYRLGRSDLDLLLAFQQNIRREYNHPTLPQQAGLFVRLNTINYSLRYNAPAFKNIETSVGVNGMSQNNISKDATDFPIPDYSLFDIGSYLYLKWKQNKTTISGGIRYDTRKLHWNDVYVKSNPDTGFDYISTDTTNAYLQYPAFNKTFSGISASIGLTHKLSKKINLKVNIARGYRAPSITELSSNGLDPGAHIVYLGDRSFKPEFSLQEDIGITGEFKDLSLSASIFNNTIQNYIYLTKLFDANNDPIVDDQGNKTYQYKQALAALYGFEATLNIHPERMKGFLFENAFVLTYGFNRDAIYKGQGVNGEYLPFIPPMKLYSSMSDKIQTRSQLFTSVTPRIELEVTGSQNRYLSLAETETFTKGYALLNIGISTDIAYAKNNTMQLYVQVNNLLNTSYQSNMNRLKYFEYYSQTPNGRTGIYNMGRNIAVKLVVNF

SEQ ID NO: 530 - protein, 797 aa, Escherichia coli str. K-12
MFRRHALGGVSVIAIAWLQPATIAHAQTERELPSVTVDAPRAATPRATRKPAAQPNAASARAPKPTAASATNISAQGQAASGRVGGATDARDQLGQAPAGQTATTIDRSRYDDRPAFTVGDILRESPGVSLKQGNGPRDLGISIRGSNARNSFAIRNIVLFEDGFPVTQPDGLSRSDLIDPHAYGAVDVIRGPSSALYGNYATGGAINFRTRPGGTIDGAEIGSEGGSFGYLSNYMAFGKKVGNFEGSLFTSDVRGDGYLGNSWFNTQTVNFLGTLKVTPDDRFTVKIINNDLTTRLPLRYTLSQYNQNPYQQGCTTGSFRAAGCATVALNNNGFNTLGGVDTETALQAGLGRNDRRTIVGGRWEHDFDNNTTWRNQFVFDDRNISQPTGSTSAIGDYPSYNYMSDITRRGEILGLESTTFFGAFYNTLTASGDTRFVVPGGNGALGRLSANTWSETTNYGLRAREELKLTAALTAVAGLGWERTHLRGVNTAYSYKDAVGTATTAITSADRQFDNLAPELALLYRVNSDWLLRARVASGYGTPQVSNLFVLPTGDNGNNTQLQSQTNLGYDVGFDWTPNRAVTLSATGFYEFFRNELVTQAVTGTQNTSYTFNAPRSEHRGVELAADWRFLPGWRFTAAYTYLDQVYTEYTENLVGASKLFSFNRAGNKIPGISPNELTARLGYDHDSGRFAGLGAFIEVQWKDSFYMDNANLLKAPGYELVNLNVHYKTELASDTFKSMNVFFEVRNLFDRTYIASANNLQNTVAGTGVQGLAGTGTIYAGSPRAFLAGMKVAFR

SEQ ID NO: 531 - protein, 431 aa, Escherichia coli str. K-12
MKVMKWSVIALAVAAGTSQMALASQQSESKGFVEDASLDLLLRNTYYNRDYKDGADDVRSWGQGFITTFESGFTQGTIGVGVDAYGILGVRLDGGRGYNYGAMFERDSNGDPERDLSQAGAAIKFQVSNTVLKYGNQMPMMPVLTYDDSRLLPESFTGTLITSNEIEGLELNAGRFTADSSMPSSSRDDVGLKSINVVGGTYAFNENLSASLYYADNEDVAKKKYANVNYVMPFSGEQALSFDFNIYRSDYDKDYVQFADADRDDDGNITQLADRESHDNTIWSLAAKYSVGAHAFILAHQRVSGDRGYDYDIGDGGFSIWVANSYYSDFNWKDERSWQASYELDFSSFGAPGLFWKTAYVYGDNIDTGAGEGKEREFFNQVQYVVQSGPVKDLSLKLRNSIYRSNGALRDAGSADLNEIRAFIEYPLSIL

SEQ ID NO: 532 - protein, 342 aa, Escherichia coli str. K-12
MAGAAGAIGTAPLAHAQSSVTLYGVADAFVGSVKQPGGRTALVQSGGGMTTSFWGFGGSEDLGNGNKAFFVLESYFQPQSGAYGRYAGDSLFSRNAYVGLQTRFGQLRLGRITTPLYLATIQFNPLFNSYTFSPMIFHTFKGVGAEGVVGDSAWNNALAYTSPTFGGFNAGLLYALGNTAGRNGAKKWSVNANYARGAFAAAVVFQYVNFSATPGDLDGALAAAPGLSSQRTVQVGALYDWRVVKLFAQYMNVANRAQRGNFHGDTLQAGVSVPIGVGSLLASYAYTHSSGALADGAHRSTGALGYDYLLSKRTDLYSAIKVDHVGGLSTGITYGAGLRTRF

SEQ ID NO: 533 - protein, 299 aa, Escherichia coli str. K-12
MNMKFIIGSVFAFIPASVVQAADVIVPQQSEQVIPPVIASPPFSWTGFYFGGQIGGFSSKISAMTSDVASPYVDNLFFPDEESKNKKWVSVEKKYMPELSGFIGGGYTGANLELGNGFILGVETDILVSKRKDTKTVVFSDKSDQKITLVEGTKGETDGHTEEDSLGQLIGVSRLKEAEENSLTVSHTLKQKWTGATRVRVGFPVERMMPYISGGVAYGQFQDIFSMSITGEDADFTTVDDTKAMIGYTLGGGVDFAMTDHFIVRAEYRYSDFGKKKFQERIELNYKTNDFRVGVAYKF

SEQ ID NO: 534 - protein, 659 aa, Escherichia coli str. K-12
MQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQNDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTFKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 535 - protein, 1847 aa, Escherichia coli str. K-12
MATMFMQRKKLLAVGIAIALQTYYCPAIAAENTEDEKECPVNISSLSQAERNKLPAKCLTAEAGQDNHWAWVASGVAALAAGIAIGNHSDGDSHHHSTTPVPPDDGGDVTPTPPDDGGDVTPTPPDDGGDVTPPDDGGDTPVPPDDTSVTTFSNQVTLDKGTDTLHFDDIKLDNGEHLGEATLSYSEQDAQWQLTTQDGKTLAISGWNVTDSNAAVIEGAQANGFYWKYDSRGYLILADNNTQVVSGDGKTHTTDRELDISGKNRTGVIISGDNTRNTLNGDSTVTNGAVGLVISGDGTTNAISGKSTVDGATGALISGNGTSTSLSGDITISGGGTGIVIDGDNTLIDNAGTSSISGAGSTGSIINGNNIRLLNKGELNVSDGGTGAKITGDNAIVDNKGHSTTRGTGSTGLYIEGDHALVINEGDQLIADGATGVRIDGDNARVLNTGNMAVDGAGSTIATITGNNADMTQNGDLLVMNGATGLTINGEESELTNSGTTTVRNDGSVGFVVAGTQNTFNNKGNINTSLNGTGTLISGTESQVSLTGDINVTAAQDSSGVFRGATGLNVSGDTNTTTILGNVNIEGSYPQDAQIKSDEQLQGITVNGNQNTVNLDGAMNIHLDSSDISSGYASVVGLDISGSGNAVNVAGGINIDFSQNEAAAGSEAIGINIDGDNTLTLSGKSTVDMTTISGGQATLANVNNGGSLLVTDDATIEVNADYLYTHYSVGNKALLSAHGQGSTIENQGDITTHGTANVLLADQGAEASNSGNILVYGSSDDTGDNRSAITSANREDAVVHNKAGADITLFSNQTPEYIDGINLYPERWYTHTLYAMLAAQGGSVVNDKGATVHLQGAGAYGVSASVGTALNEGDIYLDGFIPTLDDENNIISTDYWQPTHLYLTSSAMVAGSTDSGYGDATAINTGTITVNNAGFGMMALNGGTAVNQGTITLTADEGVTGEENQLVGMAALNGGTVVNDTTGTINIDADYGQAFLSDSNSYIINNGAINLNGSPMDENDPHMGSTPTDKIWIRSLPGSGDSDSQTSEAGFFTTGALANYGNETLNGDIDVSGWLYNEAGATLTVNGDMAINAGGDLENHGTMHVDTITTYHSLFNRADGSLTTDLLTLNGDITLFNEGSFTGSIAGTSYAQEVVNTGNMTVAEDGKSLINGSFAFYNQEGATLTNSGSAVEGGENTIINMTRTDSSIAQVNSGTITATNGYSAITTANASNSPMWIWNTETGVINGINPDAPLINLSRDYSFDNEGTINVQGDNAVAISGGTSSYIIDLVNSGTINVGTEQGQIDGTNGTGLIGIKGNGNATTINNTADGVINVYANDSYAFGGQSKTIINNGEVNLLCDTGCGIYAPGTTGTQNDHNGTADIVIPDAIVAPTQGDIPAPPADPNAPQMLSNYIVGTNADGSSGTLKANNLMIGDDVKVNTGFTAGTAETTVVVDNAFTGSNIQGADNITSTSVVWNAQGSTDGDGNVDITMTKNAYADVATESSVNDVAQALDAGYTNNELYNSLNVGTTAELNNALKQVSGSQANTVFREARVLSNRFTMLADAAPQVKDGLAFNVMAKGDPRAELGNDTQYDMLALRQTLDLTASQNLTLEYGIARLDGDGSQKAGDNGVTGGYSQFFGLKHSMTFNEGLAWNNSLRYDVHNLDSSRSVAYGDVNKVADSDARQQYMEFRSEGAKTFNLMDDALKITPYAGVKLRHTMEEGYKERSAGDFNLSMNSGSETAVDSVLGLKMDYAGENGWSASATLEGGPNLSYTKSQRSATLAGASDQRFSVDDGQKGGGLNGLATMGVKYSAQDSSLHLDAYQWKEDGISDKGFMLNFKKTFR

SEQ ID NO: 536 - protein, 727 aa, Escherichia coli str. K-12
MMQGARVARFGRWRPSLYLGLLIAAHPAAAFADAAPAAGAEVRRDEAAAAQPAGSELKAIAVNASRGVADDPSVATVGKMPLALREIPQSVSVTTRERIDQQNLFSLDEVMQQSAGVTVQPYVLLTTAYFVRGFKVDSFEFDGVPVVIGDMASAPQDISVYERVEILRGANGLLHGSGNPAATVNLVRKRPQYQFSAHATASVGSWDRYRAEADIGGPLNAAGTVRSRLVAAYEDRHFFYDHAKQDTRSIYSVTEVDVTRDTLLTFGAQYQTTTSVPDMSGVPMARDGSSLGLSRSTFLDTAWGRFNWDTTRAFASVEQKLGAGWKAKVSGEYQSVRSDLKYAGSFGAIDPATGAGGRLTGAAYQFSSYSRSVDANVQGPVHAFGLTHDLLFGVTYANSSSGQMTAPLLGDVAGTPVNVYRWNPSSVPEPGIGPYQQSQQNDVSQKGVYGLGRIKLAEPLTLVLGGRMSWWNQDSLGAHYNTGHQFTPYGGLIWDFARDWSWYASYAEVFQPQTKSMWGGGILTPVKGRTYETGVKGELAGGKLDVSLAAFRIDLDNNPQVDLAHPCAGPSCYYVNGGSVRSQGFEFEANGRITPWWSVWASYTYDTMRYADNLANAGSFAPLLNPRHLFRLWTNYDLPWQERRWSIGGGVQVQSSYSAQANGVTMSQGGYALASVRLGYRYDKHWSAALNVNNLFDRTYYLSLSQPGWNNRYGEPRNVMLTVRGQF

SEQ ID NO: 537 - protein, 362 aa, Escherichia coli K12
MMTQKNKLIQCVYCLLIGVFWQGTLKAQNLSVDAQALTGLLIPISLTSPQLTTASPKGVELRLMKQTSGNKDWHHWYKSPRFGVTFIHYDFRNEFLGKAYSLQGVGDFPLKQRKRHDWHLLVGYGVAYLTENYRKFRNRKNTYVGSQFNYSFELMLSYNYYLTPRLQLSAEAGIIHYSNAALQMPNGGINALSLGLGIKYRQNKPVENKVDTTFYKPKKWRWNISGAFGMLEQYPTGGRKYAVYNVNFLGEKRISRKVSWLLGVEAIYNNLYKEYIPDGKNQPEPALPGRAAVLTGMDILVGQMAIMIQAGVYVYKPQPFDAVWYNKYGFKWRFYRELFTSFAIKTQLGAADNFELGLGYRF

SEQ ID NO: 538 - protein, 215 aa, Escherichia coli str. K-12
MTENKEVIMRHLYGAILFWTALLTGISLPAQAESGHGAFSVGYAQVHPGGVPALSGTGARAGDLKGINVKYRYEFTDHLGGIVALSYASVKKSDTMKTGENTFHYESLRGRYVSLMAGPVWQLSERVSLYGMAGMAYTRWSDSVQDYRRDEVKPGYVKETTTASDGHTARHLSPAWNAGIQFSPVETVVIDLAYEGSGSGDWRTDGFIVGVGYKF

SEQ ID NO: 539 - protein, 929 aa, Escherichia coli str. K-12
MRFWRVTAHGIWATALLAAAPSLARDVEPRRAFDLEAAPLGRALLAFNLATGAQVIVSRDLLVGRVSRPVRGQYTATQALARMLTGSGLHAERTGRGVLMILPDRPPAAPRPSPSPSAPEAVAIAEMEGVTVTAPRILPPVALTTLSGARLEQLGVVGMDQVGRLTPGLNVVNLSPAAAAFSMRGVTQASGDASREPRMAVLQDGMPASKERGAYFELFDLDRIDIAKGPQPTLYGRGAMAGALDVIQHKADPRAKAWSLHGEVGDHGQGLLDAMVNQPIGQDLAVRVAARWRGRDGLTPNLAGGDRLDSVATDAARVSLAWRPEDGERLDLIVNYQRDRPTGRPLKSFTFAPTDPVTGAALGDLDRHTPPALSAVDENGRPAALGLDRTLGSVAVLAARRPSPGLNLSASLGYRRFYADERQDGDGLSLPVISVFEQTRGVQYNADLRLAYDAGERWRGFAGVSLFHESGTQRAYFTIDERLLLARMAGGLDTPVPQGLDTLTQPDFVAAQLRQLAARRGFDLPGDLALGAAGNLKSAYVERNQNFARTTAVDLFGDLTFAPSPTWALSAGLRYSHDAKASAVATALPAGPSVLAGAVQALGLPWGQRAALLAALSAPGAGASAETPRAWPNYALVFQPTSGNGDKVSNALSDEGWSGRLVARYTPSSAFSAYGSYARGRRPSVLVAGPPLVAEGPARFGIVPAETIDSLEIGTCGVGFDQRVDLNLAAYAYRYVNFQTTKLVDGQLQTLNAGRADATGLEAEARFELSRSVRLFAAYGYNRSRLRSGAFAGNQFRLAPDHKVSLNLELTYAMPGGALTVLPTWSWRSKVFFSDDNDRPQLSRGLVRDLVQDEVQGSYDLLDLRVNYQPRAANWSAGVFVTNLLDRRYLQEAGFIGESFGFTASAQGTSRLWGLSLRIVSGARQDFAK

SEQ ID NO: 540 - protein, 1128 aa, Escherichia coli str. K-12
MRTLLTLLTFTVMALRPMVAQVATGNIRGTVTDSSGGVLPNCSVTITQPNTGLVRKVSTNEQGDYNAPSMPIGEFKLSVTLNGFQTKVISGLVLQVDQTAIIPVVLEPGTVNQTLEVLASAPVLDAQTSSLGQVIDNKRIVDLPLNGRNPFQLGALTGGAVAFQGLNTNLPILAGGGRHNANDILLDGVDDNLRNFGGKVGRAGLTYIPSVDAVEEFKVKTNGFSAEYGHSAGYTMNATIKSGTNQIHGSAYEFLRNDALDANNFISNYSGKPKAEFRQNQSGATFGGPVRLPFYNGRDKTFIFGDYEGLQIRQAATSSLLDMPPAVFRTGDFSTQSTKIYDPATRSLGPNGVVVDEPFPNNVIPANRLDPTALAFQGLLPAPNTGAAGAISRNYLATSPQATHRNQGDIKVDHRISDKNNVMVRTSLSNQNVPSVGTFIYSPTIQYFNIRNVALSDTHIFNPTVVNEFRFGFNRANTSANATKAQESIDFTAKNNMAFGPIYGFPAIYWNSIGSSQGGTTEFSNFSGAKTNFGFENTFQYADNLSIIRGSHTFKTGVDVRRFRYDRLLSVPAAGSYYFGATYTANPSISSPGGLPYADFLLGLPTTVTNQNSIDWSRQRDLYVGPYIQDDWKISRRLTLNLGFRYDLYTQPVDAKLTGGMFDPYTANVNGRLGIIQLPGQNGNTAAIVKAHHNNFAPRIGFAYQGTAKLVVRGGWGVFYSNREQNDQTTDMAMSLINFRNINMPAVSRDTTVTPPYHFNSPLNVSSVIDPQFLRFSGTSPLSADSGSFNEADINFSPFPMLQQWNMSVQYELLPNLLVEVSYAGARGVHWVQRIDMNQVTFANALLGKNTQADRPFNFLASAQGLDTADVSNWYNSGNLKVERRFSHGLTMLGNFTISHATDSGNAGISTYGNQANTRAMNSYNLSLEHSLSPLDIPKKLAITGNYELPVGKGKPLNIGNSVLNQIVGGWQTNGVLVTRSGIATDVSVSQLPPVFATINRPDVVPGQPLLVANPGFDQYFNPAAFAVPGTVPNYKGVPIQTFGNAGRMVLRGPGQRNLDASLFKNFHFGEKRRLEFRAEAFNLSNTPTFNLPSPTSASLTVGNAGFGKLGSSQTVGRQVQFGLKFVY

SEQ ID NO: 541 - protein, 248 aa, Escherichia coli str. K-12
MDFSGKNVWVTGAGKGIGYATALAFVEAGAKVTGFDQAFTQEQYPFATEVMDVADAAQVAQVCQRLLAETERLDALVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 542 - protein, 676 aa, Escherichia coli str. K-12
MATGQPIARALLSGAAALPLMATPKAGSAEEHPTVLPDLTVTAATRTERQVERTPAATEILSGDDIRRSGAAMLDEALQAESSIYTGVDGNTFSIRGGNRDDMLYLIDGRRIAGTSSRSNELNRIPVSHVERIEIVKGPGSVVYGADAVAGVINVITRRPEPGLEGGVSAQAGTPTDAEGGEQYQGGLYLGGGTQDTRFRLFADALEREAYSEETTTQPDEGGAPSSQTFDRDLRPSADVYTLRGGVTHWFTDRFHIDLEAGFLTEERQERLVQGSGPGNIEDFAAVETEESDRRDLAATAEWLATENLELRYQAYESHYKFDRVRSHLAPQDFASDAADRDFGFREATFTERVNDFLAQWQPAPRHTVLTGLEHKQQIYQDLQPEDEPEHDQWVGGGFLQHEWQATDRLDLVYGARHDETSTEADSTSLQAGAVYRLAPEVRLRAQYAEGFKLPELRSFYVDTEDGQGREVRGAYVIDPDVGKDETHELDPESSRNYEFGIAGDLNLQRDITAFYDIGLFYTEYDDRIGRAPGNGYQTFKNVDSARAQGAELKLGAAFDPQLELTLAATYLDAIDRDSRETLTDTPEWTAVAKALWTPTDPLEVQLRTRYVDEVRVGDDWDSAYTLTGLDVAYAPAAWDGLRLQGGIENLLDEGNDSSLRADPGRFARAGVRYDF

SEQ ID NO: 543 - protein, 1536 aa, Escherichia coli str. K-12
MIAKKVSRFQKSAFSHSVVIAILVSTGIVANNHRLYAYESVSEVFLDTTSLSKPPVETTVAGIFGDKKKEKSSEKKNPKKENKEAETHVDTSLLHDISSCVTKILGADVAQSQCLVDVSTLFKTPNSLSWANIHTLPANSEKDGYEVQDPQHGLAFCYKNSSEDSGGKNSPGFLGIALIGAGSKSGLSFSNLSSIASGAAVYSDEDVIFEHFKENLLFEGCASQACGGAVSGRSIALNGCHDVSLLNCKSGVDLTTSGEIADFSKGGGVLNVHKIHGEAHTSRFSNGEVLFLDNSGTFLVKGNCAESANGGSVACAQFVCSLNLGDLSYISNRALSGGAVSSLKSMDFCKNIGTLDFVENCALASSQSSAFLGGGALASGERISFLNNERISCCKNTSKSHGGAFLSRYVRIVESVGDTCFKENSAEFTGGAVSAQNQVEICKNFGSVIFEKNTSKLGGGAIYCLLPEQPYTSSEEPLPGSGDIKIIDNSGAIKFEANENLMNSPETHSHLGGGALYGANILISGNTGEIIFSKNASSQCESNSTHLGGGAIFANERVMVSDNSGAITFSYNSGKFLPLPMPSAEVSEENSSQNAPVESSKLVDLGVRGGGAIFAKSIDIEDNTAAIVFAENSMEIKNNKAQKENPLGGGALFGAEAIGLKNNADLLFSSNHVSGENSSGGAVLSNAVTISDNKKVQFVRNYSQFLGGAICALGDKLSINNNETTISFIGNRTVSAGGAIACAEGEVSISKNLGRVEFKDNLVFGDPYVENLEEGQINTVGHHSGGGAVFAKTAVVIRENNDKVLFSGNTTGCFGGAILTGSLTPAEDQERFASRVVSANTKVVITENVGDVIFSGNSTSAAQHPDHNLFGGGAIYTQDLIINKNEGSVAFYNNYSPRGGAVRISEKGSVILEAVGGDIVFQGNRGAEDASDGIYFSGKESRLVEVSAIGENTVSFSDAIVFEDLTLRKSSESHENILLDPTLIFNSKSKDDSGVTHSGKVRFAYATSKIPQVAVLESGTLVLSDKAQLWLCGLKQEKGSEILLSVGTVLRIFDPNVKSVEKIESPSAKSYYSNYEIEKNPIEKTLADISSIGVDLASFVTNDDGSSPLPPQIIVPKGTTIGSGSLDLSLVDSDGAGYENHALLNKETDLTLISFKSASTISDTPELERILEDINVKVSVPTITEETYGHMGRWSDPQVVDGKLMINWKPTSYKLNPEKDGSIVLNTLWGQYGDLRALKQQQLSHNITAQRMELDFSTNIWGSGMGTFSNCATIAKVDGFTHRAGGYALGLDTQLIEDFLIGGSFAQFFGYTDSQLYSSRSNQSGYLGSGYVGILAGSWLFKGMFIYSDIHNDLNTTYSAQSLGVSKGSWNSRGILADAHVDYRHIVNSRRFISSIVSAVVPFVEAEYTYMDLPAFTETGDEIRSFAEGHLQNVTIPFGLTLEHNYSRGQRSEVNSLSFSYALDVYRWEPKVLINLPVASYSWEGIGSDLARKSIKAQFSNDTEWNSYFSTFLGATYEWREHTVSYDVNCGMRVIF

SEQ ID NO: 544 - protein, 1005 aa, Escherichia coli K12
MNSKNKRIVLHQMWTIKSLVFMIFMLFLSAGMFAQGKKLVTGTVYDNTGTVLPGASVLETGTRNATTTDFDGKFTLEVAVGGSIEVSFIGSSTQKVQITASTSKLEVRLQNDGYQLNEVQVVSVGYGTQKKSDLTGAISTVTADNLVKGTISSTEQVLQGKVAGLNIIRPSGDPAAGSTIRLRGGTSLTASNSPLIVVDGIAGVDINVVQPADIKSVDVLKDASATAIYGSRGANGVIIITTKSGTKGVSVVYNGQSSIGYVTDNLDLLSANQWRGYMRETGNKDAIDFGGNTNWQKAIEQTAISQSHTLSINSGKADSGFRASIAYLNNEGVIKKSGLERLSGNVNAYQYLGDNKDVKFDMGLFANIDKWHPIDYRIFERAYNLNPTIPVYDKNGNFTNVNYTLYENPVEILTNRTVDNERHRLLGYFKTEVKFLNDFQAVANISLEHNAAKGGTYKPTYAIMEGRSESGYAQRTYEEYTNAQGELYVNYSKVIDKHNISALAGYSYLENIYEGFGAQRSGFVTDAFSYNNLGAGSNYRLGDVYSYKGKSNLVSFYARANYGYDGKYLLTATVRRDGSSRFGENNKWGTFPSASAAWRISNENFMSGTKDWLNSLKLRVGYGVTGNQDGIGEYKSLSILGVGNDSYYDPATGRWSLAYSPTQNPNPDLKWESTRQLNIGVDFTLFDRITGSLEWYQKNTDDLLYTYEVPQPPYLVGTMLANVGEMSNKGVELTLNADIVRGDKFTWNANLTLGHNVQKIEKLSNPTYKTDVIYSGSLHGLAGMSGQYSQIIAEGYPVGTFWGFRNAGLDANGKIQYYNAAGDIVAENALVDADKTDLGNIQPDLTLGIGMNFTYKNFDLGISGYGMFGQKALNATNMMLNDPNRLPTYNVPDDFLGSGITSAPKYSDYWIEDASFFRLQTLSIGYTLPLNFKNSKLRMYIMGENLAVFTKYKGVDPEIGLNAQDGVNQNGVMDKTGLAGPGIDKYNNYPRPTTISVGLNFTLNN

SEQ ID NO: 545 - protein, 639 aa, Escherichia coli str. K-12
MKYCSSPTLMLLALCWILPGTGLAASFLSEETVVTATRTETPVSKVPAAIEVISKEEIAASGAETLDAVLAEAQSISLQSPSGRISIAGLRGLNSKNTLILLDGMRLSSGFGDYVDMEEIPTAMIERIEIIRGSGSALYGSDAIGGVINIITRKPTKELHAGVGFRTGISKYSEAGMARGDGWISGTTGKLGYVIAGSYSDRDHYDRDKSDIVPDGDDKYLGGGSAALTYRFHEGVTARMGVLYHDRQNEGARLYSKKYYDRTLESDRTLGYAGLDIATGSESTLTLQGSLSSYDWKSTMDPITVASGFVTSLKQEASLLESHWVSKLSKSNRLSIGLDYRKEDRRDVNINKTFAVVTGSHDVWNFGSYIQDELSVIDPLGLTLGLRYDSHSDFGTAFSPKVSIWHQLADKLKIRGSYGEGFRAPTIYELYIGSPWTQSQAIVANPDLEPEKSRTYEIGMDATAGPLTCSITGFRNDLRDMIGKISLGMIDGVPNYQLGNIDRAMTQGVEVSASVTIPYGFTLSDEFTTIESEDKSTGADLLFVPDITNTLKLAYLQPKAGINANIRLLTTGRQMTDKTTKTEGYSLVNLYLSKSVISNTSVFFGIDNLFNDEADAAYALNSGAAATGTYFYGGITMSL

SEQ ID NO: 546 - protein, 937 aa, Escherichia coli str. K-12
MAQQTEPDATRATSTLDAVSVTGSRIKRAQVEGAQPVVTISAQQIQQEGFATVYDVLNSMNQQGSVEADTQWGSHTPNASPINLRDLGPGRTLLLVNGHRVADYPLPYGGESNFSNYSNIPSAAVERIDILTGGASAIYGSDAVAGVINVILKRDYQGDQVRLRGGTATEGGRDSFDVSWAGGRTGENWSLTYALQATKRDPLSGRDRPEMDDSDDMSYSNWTGQNRLYGFNPFTGLSLIDANTNERLAPPAGTCARFGGEFIDGQRLSYNQNTGALTNAGSYCGVARDYGDWGLVTGSEDYSAYLYGTWKFGEHTEAWATLSANRSIGRWTYDPPYAYLGPFQDAATGRSLNLIRQLTRREAGGWDRLANYNKEQSWDLSAGLRGVWAGRFDWELSVGRSRYTVDEYIRTVDTARATDYFLGSSLGTAADGTSIYAINQARLYTPLSMDQYDALVAKSHNSAYSWVNQASFSVSGDVVQGWAGPIRFATVAEVAKQGYQLSPDPCANECYPVDVVDSGGGERMRSSAGLEFQIPLLSTLSANVAGRYDRYGNYRSSAAIPTDVGTQSDTTWSAGLEWRPVESLLVRSTVATSFRAPDMHYVLGEPSSTNQTVIDQYRCISSGAYLTGGCNDENNNIFYTVDVNRRGTPDLRSETGRSFTGGIVWDIAQGLSLSVDYYRIQLEEMIKDLDRDEILSAEAGCRTGTTISGGTWNNPGGAGYCDTITSRVMRNADGTIASIERGPINLAQMETSGIDAALKYRLATAGWGNFQLSLDYNNLIAYREQIYRTDSDENRRDERVRSRVRGSVHWDNGGAWDWTVYFRRIGSMRAVNWGTCERFDDGYQPSASDACLVTDTANVHLGETSKRYFGRIGPAIYWNLSTGYKITDHAKVNFYVNNLFNEVGYDHKERFYGYGFYNTTLFNPIGREVAAEYVFTF

SEQ ID NO: 547 - protein, 1023 aa, Escherichia coli str. K-12
MKNRLECMQSIRFLAVLLMCCLSYTTWAQTQSNVNGLVTDFSGEPLIGVSILVKGTSNGTVTDLDGKFSLSAEMGNMLQISYVGYISQEVKVESDKLLRIIMEEDTKKLEEVVVIGYGTQKKVNLTGAVAAVSAEDLASKPVMSTAQALAGLAPGLSVLQTSGRPGQGATVKIRGTGTFSKAGTDPLVLIDGLSGNIDDVDPNDIQSISFLKDAASASIYGNRAANGVILIETKKGAQGKTTITYSNSFGWQQPTELPDFLPSWEYAEYYNMAMRNMGKQEAYLPEQIQKYRDGSDPDNYPNVNHLKWLLESGSGFQHQHNLSIQGGNATTSYNLSVGYRNQEGMTAKTSNERMTALFTMKSEIAKGLMLNLNINAYNNKYNAPNGEPQSIDGMIGYAVRQGPIYAGQKSDGSFGYQDNYSPEAWLASESFVQNVSRNISASGQLTWNTPVDGLSFIGKVGMNYWTKYDKAYRADTYFDDSKTVGPATLNVWTANNTYTTFEALATYEKQIKNHTFKLLAGTSVEQSNNKGLEGYRNTFPNNYLYELGSGDKSTATNDSSLEEYALLSFFGRINYAWKDRYLLEVNLRYDGSSRFADGHRWGLFPSVSAGWRISEEDFWKNAAVSAVVDNLKLRASYGVLGNQNIGVYPYQQIYELGHDYPFGNPVTLQSGAYMKTYNNPEITWEKTAITDIGLDFSLLNGRFSGTLDYFYKYTSDILAPVEVSSIMGREVGQSNVGAVSNEGIEINLTYNGQIGRDFRFSISPNFTWVKNAVEKLANGATEEINNNRIVGQPIGIIYGYETDGLFVDQAEIDAAPEQLVSKSGLKPGYVKYKDISGPDGVPDGKVDAQYDRTVLGSTTPKFYYGLNLSTSYKGFDFSALLQGLGGHKRLIGSYMAYAFYNGGQIQRWQAESCWKEENPDKWAEYPRLETLNMNDTNLQTSDYWVRNASFLRVKNIQIGYTFPKAWTKKIGLENVRVYVSGQNLFSFNSFYKGWDPENEIGTGDSPSYYPVNSIYSFGFNFKF

SEQ ID NO: 548 - protein, 939 aa, Escherichia coli str. K-12
MSVHKQFRLKNNMFSSLVPGIVLLSCFPSFTHAQQETSELTKQEKQADASDIEQVVITGSRLRQDGSMAPTPVTVLSSDEIEAGGKTNIADFINDLPQLQNSSTPRSIGFTSSSGLQGANLLNLRNLGTNRTLVLLDGRRVVPGVPTGSVDLSLLPSALVKRVDIVTGGASAAYGADAVAGVVNLVLDTKYTGVKAHIQGGSSSEGDAESKSGSIAGGTSFANGRGHVVGNIEYAENKAAFASERDWAKSKSIVPNPNYTQGGAEHERIIVDSGLGLATPGGLIINTPLRGTQFDDNGNPVPFDFGAPTGNGFIAVSPDAYNPIALQQLIAPLERYSGFMHATYDLTENTTIYGEASYGKSTVRQETLPLFRFANQVVQNDNPYLDAVTAQRLSDAGESTFVLGKLGVNLGVAEPVGEREIQRYLVGVDGELSGDWSWSAYYQYGDVDINVRAQNNPIVSRFILAADAVTDDAGNVVCRSSLSDSGNGCLPYNVFGNQPVADDVKAYLTGTAVSNQKLKQHVWSASMTGVVADLWAGPLTAAFGADYRKESGSGDADEQSMNNEFFVGNFKPFSGKVNVKEGYLELGLPVLDDMDYGTIDINSAIRWTDYSNSGSVRTWKAGVIYSPIDELRFRVTRSSDIRAPNINDLFSGGLVRASAVNDPFRDGESTQYLERSGGNPDLRPEEADTLTVGGSYAPDWLPGFSMSVDYFDIDINDAIGDISSQNILDNCFEGQTEYCAYVARNSDGLVTQISKLPFNFQAEQMTGVDMEFAYTMELGEGELKMRAFATHVTKLSIGVPGTLNFVSRKGEVGNNAGGADSGAPDWRGIGNIGYETHGGTNIGATLRFIGEAKVESDFASNYLQGNDVPSRTYLDLNISQKFDLSSGTLKVFAVVDNVFDRDPPVVVSLQGTSPLDLPTNGALYDTIGRTIRIGARVEF

SEQ ID NO: 549 - protein, 233 aa, Escherichia coli str. K-12
MSTSASKGIAALAVAAALCAPLSIARAADLPVRPEGPEASAYVPVQWSPWMVRLRVLGVMPDEGARLSAGGAPLAGARVDISDTVVPELDISYFFTKNIAAELILGVTRHGIKGDGSLSGARIGNTWLLPPTLTLQYHFDGFGPFKPYLGAGVNYSIFFDEQARGGFTSLRLSNSVAPALQAGFDYMLDAHWGLNLDVKKLFLDTKVKLNAGAVRGRVDLDPWIFGGGITYKF

SEQ ID NO: 550 - protein, 1173 aa, Escherichia coli str. K-12
MTNRAFLSGVGLAALAGALTAAPAHASGGNGGEFSLENEELGEASDYRLPLGVASAATPRSAAPAISTSTAVDSFAGFRLTPRSSLDLTFDPNVLLDATVSGGALDNVNQDIFVRDDVGLDASFDAADTQPSVVQMFIGRNSDGAVFLNCTGSLINPRTILTAAHCVNFFPSEIYGTAESGSPFAILIGTGPDTEPRVANFSAGASYSEGGLATSTDVVIHPSANQENGALPFPSADIALIAVDEPITDIPALPILLTPLTELTHVVVTGYGSFGTALGGSGQGSDFLRRVGENMLGALGSFANFDDVVFSAFAPTAESGNLTQPYYFIDFDWPDRDEAGFPGCQFNGFGPECQFVGDVLSLDWFDGDALPREVTTAPGDSGSPLIADVAYDFPVAIGVLSGGVSFFDLSGFGLPQTYGDISFYNPIYPFFQFISENTAYKYVSAKRGNGNWSDPDHWTQDLDPGFFIDDGTGTLVNGLPEGEENGIFEVGNSIGTILGVDISEFPEIVSPFGPQPGDENFGNNLPESSVLLGPGSTGFVPNNTDGTPGIAFANPAQYFEVHLNQRGRTTVDMDVEIDKLVIDNERATFRLGSGFDFTSLIGVEQFSGTSEINGTLNTPLYTLAGGQLTGRDGVINTNALINVAGLLSAGGDRRVSTLTINGDYVQTSGAGLYANFQGGSRNRISNDFYDISGIAVLDGVLLLEARGRRVRNGSEFSILSAAEIDGDFAETIFLSNSPILTASSRVEGNDVIVSIGARSIRDLFSNNRSLRNLGGALDTIRATRFNEFADMFAIVDNATFETLGATLGALTPVSAFSQTFTANSFSQRFTGQIAQRTLALRGGSMAAGGFTAAGNAAYAINGTTPAETGKLGVFGSASGVYLNNGQQGGLLGNGLGAFGSQGVASTQLGASALEQTALTQAGEMTVGVDMALSEGFSFGVAVSNIQSSRQTVNPLQPEADRSQSVAIYATYSDGGLFADGYAGTADQRFGAERASGGDFATYFANAVGQSDARQTFGGMRLGYAFDIAKGLEVGPVASLDYVRSSIGGFDEIGAGGFGLSVADRTFTSLGAKAGAMASFDIAVSETSTIRAFGSVAYASEMADNADVVTAHFFGASDTPFSIANELDTQWMSVNAGAEMQVGTNLNAQISFTSDMGRGLLSNDQGRVSLIWKF

SEQ ID NO: 551 - protein, 367 aa, Escherichia coli str. K-12
MYGRKLYNVDQTNVYASLMFETEFNKQNSFSAGLSFNYDAYDQHYRLENQTELPLIKAFAKEAVPGAYAQYTLNLNDQWMLMAGLRGDYSNEHGFFVTPRAHLKYNPNEYVHFRLSAGKGYRTNHVLAENNYLLSSSRKVEIAKGLDMEEAWNYGASVSTYVPVFGKTLNINAEYYYTDFLKQVVVDMDSNPHEVAFYNLDGRSYSHVFQVEASYPFFKGFTLTGAYRLTDAQTTYKGQRMEKPLTSKYKGLLTASYQTPLGIWQFDATLQLNGGGRMPSPYELADGQLSWERRYGSFEQLSAQITRYFRRWSVYIGGENLTNFKQKNPIIDAANPWGGNFDSTMIWGPVHGAKAYIGIRFNLARNE

SEQ ID NO: 552 - protein, 899 aa, Escherichia coli K12
MMNNTWKSVLCPIACGVGMLLSASPYSASGKDIEFNTDFLDVKNRDNVNIAQFSRKGFILPGVYLLQIKINGQTLPQEFPVNWVIPEHDPQGSEVCAEPELVTQLGIKPELAEKLVWITHGERQCLAPDSLKGMDFQADLGHSTLLVNLPQAYMEYSDVDWDPPARWDNGIPGIILDYNINNQLRHDQESGSEEQSISGNGTLGANLGAWRLRADWQASYDHRDDDESTSTLHDQSWSRYYAYRALPTLGAKLTLGESYLQSDVFDSFNYIGASVVSDDQMLPPKLRGYAPEIVGIARSNAKVKVSWQGRVLYETQVPAGPFRIQDLNQSVSGTLHVTVEEQNGQTQEFDVNTASVPFLTRPGMVRYKMALGRPQDWDHHPITGTFASAEASWGVTNGWSLYGGAIGESNYQAVALGSGKDLGVVGAVAVDITHSIAHMPQDDGFDGETLQGNSYRISYSRDFDEIDSRLTFAGYRFSEKNFMSMSDYLDAKTYHHLNAGHEKERYTVTYNQNFREQGMSAYFSYSRSTFWDSPDQSNYNLSLSWYFDLGSIKNLSASLNGYRSEYNGDKDDGVYISLSVPWGNDSISYNGTFNGSQHRNQLGYSGHSQNGDNWQLHVGQDEQSAQADGYYSHQGALTDIDLSADYEEGSYRSLSMSLRGGMTLTTQGGALHRGSLAGSTRLLVDTDGIADVPVSGNGSPTSTNIFGKAVIADVGSYSRSLARIDLNKLPEKAEATKSVVQITLTEGAIGYRHFDVVSGEKMMAVFRLADGDFPPFGAEVKNERQQQLGLVADDGNAWLAGVKAGETLKVFWDGTAQCEASLPPTFTPELLANALLLPCKMLEGQPPTAPQKSSPLPAQPLIQEHTQTDGQPAAPVATTTQTPPIPLADNHAVNRKDME

SEQ ID NO: 553 - protein, 362 aa, Escherichia coli str. K-12
MKTFRTAATAVSLAAAAASPGAHAQSSVTLYGIVDTGIQYYNNAAGGGAVAGMPSLTGEVPSRFGLRGVEDLGGGYRAFFVLENGFAPNSGALNYGGRLFGRQANVGIESPYGALTLGRQMNMSMRVLLNADVIGPSIHSMASFDSYLPNARSDNALGYLGRFGGVTLGGTYSTGRDDAGPAGPSATHCAGNVAGDPVACRQYTMMVAYDAPQFGAAASYDVMHGGAGASAPLSSPGYTDTRTIVDAYVKFGIAKLGAGWIRRNTAAAAHSQSDIFFAGGTVQATPALSFDAQALRYLLRGRFDSNLFVARANYSLSKRTMVYTSVGYMTNSALGTSAVAAGGTVGAGQNQVGVMAGIQQRF

SEQ ID NO: 554 - protein, 183 aa, Escherichia coli str. K-12
MYQNINRQNAKVTGFEINSKLYLGELVKILNGFNLSYKYTHQKGRVDGNIPMNAIQPHTAVYGLGYQYPDDKFGIDIYWTKVKAKEAKDTYDMFSEKPGIQPIKWRSDSYSMVDLVTYVKPVKNVTLQFGVYNLTDRKYLTWESARSIKPFGTSNLINQQTGAGINRFYSPGRNYKLSAEITF

SEQ ID NO: 555 - protein, 220 aa, Escherichia coli str. K-12
MNKTMVKILMGMALLSSLQAAEAELDEKSKKPKFADRNTFYLGVGYQLSAINTSFSTESVDKSYFMTGNGFGVVLGGKFVAKTQAVEHVGFRYGLFYDQTFSSHKSYISTYGLELSGLWDAFNSPKMFLGLEFGLGIAGATYMPGGAMHGIIAQYLGKENSLFQLLVKVGFRFGFFHNEITFGLKFPVIPNKRTEIIDGLSATTLWHRLPVAYFNYIYNF

SEQ ID NO: 556 - protein, 1048 aa, Escherichia coli str. K-12
MNSFKSKAMFTFVGGLLVVNPAFAQDVAPPPAPAPQSSSASATTLDAVNVTAIRNSLNQSMGIKRDAAGVVDAISAEDIGKFPDTNLAESLQRITGISIERRDGEGAQVTARGFGPQFNTVTLNGRLIPGADAFGAPGQTPIGGVDVGTRAFNFAQLASEAITGIEVFKTSRATAPSGGIGATINIQTDKPFNHDGVVANAGAKMVSDRSEPFGDALTPEVSGIFSYTNPEKTFGIGLSASYQKRHGGSVQATENAWNIQRWTGTDPALRPDAVVTNAPAIGQLYGMPNDLRYAFADFQRERMNGQAVMQFAPTDSLTLTLDYTYSANEIREERGEQGIWLQRANSFTDLTFDTGQAVATPVYLRDVPNGAKDFGMEQQRNEQKYTLGSLGFNADWQVSDRFQLSFDAHNSKTQSLPNDPTTGGSATYFSFAGTNNCTNGPYCGGQWGQELWFNNSLPIGARTWYPTAADSLANTNGVVNPAFTPAELGSQVLRIFYQKQVTETKEGRLDGKFDFDDGRFQFGVSSTNTTMQRRISDTNSPLGDWGVANAGNEPGMVALLQPVSITGMFKDFNPTGAASSAWRGDADQLALWGGRQYGATTRYNPQYTADNRVEEKTRAAYVQLEIAGAIAGMTTNTRLGLRYERTDVESTSQVATPTALLWLSNNDFELIRSTDQQPFSEGTSYNYILPNMDFSIDFTDQLKGRASFGQTIARAPYNTLIAGPTPNTPNGSILINPSNRAGGGSQTPTLNPLESDNLDLALEWYFADASYISATFWNKRVSNFIGNTVTRESLYGLTDPTSGPDAQSALAFLQSGACAAQVRAAGNDVASACSANDTSLFAAMALLRNAAATGGLNAYNGSSAQSLALENAYDIAGNASDPLYQFDVSRPINQNKANIHGWELGGQYFFGSTGFGIYANYTIVQGDVAFDNTVIDRDQFALLGLSDTANVMLMYEKYGWSARLAWNWRDEYLIAANQDNANRNPYYVEPYQQFDLSVSYAFNKQLSVGFEAINLTGEDVRWHGRSEKQIIRLIDQQPRYTLGVRYAF

SEQ ID NO: 557 - protein, 781 aa, Escherichia coli str. K-12
MIKQSFGIISGTSGLIYTLSLPLLFTATDAAADDSHSPEVITVLGQAIDHETLTYPGAQQHADMEQIERSLDTNIGHFLRDKFAGVSVNDVQNNPFQMDLQYRGFTLSPLLGLPQGMSVYVNGVRFNEPFGDTINWELIPLSALNQVSLYSGSNPLFGQNTLGGALVLDLKDGFTFQGTSLELRGGSHGMDQQTLETGGNNGELGYYATISRYQEDGWRQFSPTEVTQFLGRLSWKASDRSRWDLLTAFSQSDLIGNGAVPFDLMALEGRDAVYTHPDKTETDHSFASLSGNLKLNDNMAVDLNLYYRNGQTDSLNGDDSDFEECMYLGEETLCDEDDAPVQFLNQDGTAYLGSLEELGLDADSIDGLNNTSKTDQQAMGAAAQLTIDSQLSQMSVQWLLGAGIDYADIDFQSDTEFAELLNDTASSPRATKAIGLFDADSVVRLDSKRRHYYAFMAASLQLREDLTLNSALRYDATNVHMTDLAPGDDGKTLDGDHDFSNLSPSVGIHWTSSAETALFASYGRSGRAPTPVELSCADPEAPCKLPNGFVSDPPLEQVITDTFEIGAEYSSNGLSLGLTLFHARNQDDIIFQQASGLPSEGFFDNVGDTQRQGGEVFYKQQWQDWQLAFSYSYLDATFQSDYISFSPNNPLGGDRLVTSGDAIPGLPKHNAKAGLEWYIGDLTLGSDIKYQSGQFYRGDEANENEMISGFTLVDLNAIYQINDHISVYARIDNLFDTEYETFGAYGESDEVLDNIYPGFDDARFVGPGAPRTYIGGVKVKF

SEQ ID NO: 558 - protein, 698 aa, Escherichia coli str. K-12
MKKRHLLSLLALGISTACYGETYPAPIGPSQSDFGGVGLLQTPTARMAREGELSLNYRDNDQYRYYSASVQLFPWLETTLRYTDVRTRQYSSVEAFSGDQTYKDKAFDLKLRLWEESYWLPQVAVGARDIGGTGLFDAEYLVASKAWGPFDFTLGLGWGYLGTSGNVKNPLCSASDKYCYRDNSYKQAGSIDGSQMFHGPASLFGGVEYQTPWQPLRLKLEYEGNNYQQDFAGKLEQKSKFNVGAIYRVTDWADVNLSYERANTFMFGVTLRTNFNDLRPSYNDNARPQYQPQPQDAILQHSVVANQLTLLKYNAGLADPQIQAKGDTLYVTGEQVKYRDSREGIVRANRIVMNDLPDGIKTIRVTENRLNMPQVTTETDVASLKNHLAGEPLGHETKLAQKRVEPVVPKSTEQGWYIDKSRFDFHIDPVLNQSVGGPENFYMYQLGVMGTADLWLTDHLLTTGSLFANLANNYDKFNYTNPPQDSHLPRVRTHVREYVQNDVYVNNLQANYFQHLGNGFYGQVYGGYLETMFGGAGAEVLYRPLDSNWAFGLDANYVKQRDWRSAKDMMKFTDYSVKTGHLTAYWTPSFAQDVLVKASVGQYLAGDKGGTLEIAKRFDSGVVVGGYATITNVSKEEYGEGDFTKGVYVSVPLDLFSSGPTRSRAAIGWTPLTRDGGQQLGRKFQLYDMTSDRSVNFR

SEQ ID NO: 559 - protein, 452 aa, Escherichia coli str. K-12
MMITLRKLPLAVAVAAGVMSAQAMAVDFHGYARSGIGWTGSGGEQQCFQATGAQSKYRLGNECETYAELKLGQEVWKEGDKSFYFDTNVAYSVNQQNDWESTDPAFREANVQGKNLIEWLPGSTIWAGKRFYQRHDVHMIDFYYWDISGPGAGIENIDLGFGKLSLAATRSTEAGGSYTFSSQNIYDEVKDTANDVFDVRLAGLQTNPDGVLELGVDYGRANTTDGYKLADGASKDGWMFTAEHTQSMLKGYNKFVVQYATDAMTTQGKGQARGSDGSSSFTEELSDGTKINYANKVINNNGNMWRILDHGAISLGDKWDLMYVGMYQNIDWDNNLGTEWWTVGVRPMYKWTPIMSTLLEVGYDNVKSQQTGDRNNQYKITLAQQWQAGDSIWSRPAIRIFATYAKWDEKWGYIKDGDNISRYAAATNSGISTNSRGDSDEWTFGAQMEIWW

SEQ ID NO: 560 - protein, 230 aa, Escherichia coli str. K-12
MKMNFIGLVVLGLIALAVPSLAADNAPHNWTGFYAGINGGYGWGETQWDYVGSTGKADHHINGGLIGGTMGANLQFFAYQGGIPAVVGGVESDFDWADLGDDGPCPNPRFRAKSSIDALATVRGRLGLAFDRLFIFGTGGLAVAKTDVETVDTWGTSVPPSGTAKNGEGKWKTGYVVGVGAEYAVWKNLSFKVEYQYYDLGRSTYRVDNDIPVKAGVRGDIIRTGINYTF

SEQ ID NO: 561 - protein, 1034 aa, Escherichia coli str. K-12
MLKIARPVSFLLLSVALCSSGVIFAANETTTPKVGISQQQASLKGVVEDEFGPVAGASVVVKGTTNGTVTDMNGNFVLEVKKGDVIVISFIGYLTQEIKYNGEQTIKVSLKEDTQKLDEVVVIGYGTQKKVNLTGAVASVGSEELKERVNTDVLASVQGQVPGVTIINRQGSISINMRGRGNLGTSSPLFVIDGAIADATFFSNLDPNSIESVSFLKDAASSAIYGSRAAYGVVLVKTKDGKEGDVKVTYDGTVSMKIATYTPKVLSSEWYARLSNEAAFNENPNAEMPYSDEEIEMFRNGSNPDMYPNTNWYDLVLDDLAVMTKHSVSVSGGNKVKYFTSLGYMYDDKFTPEASANRYNMTTNLSSDITSWLSWRSNFKYIQNTNNTESGGIGYTELLTVPSTYVARQSNGEWGSYEGGNPAALVNMQRNPLRRLEEGGWNNNKSQNTLIDLALDIKPVKGLTLTGQMIYKAYDYKGKTYEANRNKIKDFVTGSELNGTDVTASKMTYDWNENSRLTYNGLANYNWSNENHNISALGGVSYEHYKYQQQKSWRRNFPTNGMTGINGGSSAPSDMSTEGDVYEDKLMSYFARLNYSYKDRYLLEANFRADASSRFHKDNRWGFFPSFSAGWRINQESFMQDASWIDNLKLRASWGQLGNINNVGQYDYFATYVQGGNYNFENTIVSGIREGKPANPGLGWETVTITNVGVDFDILNGLFSFTGEFYDKQTKDILLSYPSPAEVGINSDYKVSQNIGKVSNKGLEFNISHNKSIGDFSYTVGFNLSKNWNKVKDLGANDPMIEDPWIKKVGYAIGTFYGFRSDGLLTQEDIDNGNYITDGITPQAGDIKYVDLDGDGKLTDKDRDYLACDVPDITYGVNLNLRYKGFELSMFGQGVTGTMVRFYQEQAWAFSDNASPREFHLKRWTVDNPDPNAAYPRIYPRTSAHSTFNNKFSDFWLFDSDYFRIKNITFGYNFNKHQIQHLGVDALKLYVSAENPFTIRADHRMEDFDPETPSGRGTDTRGTSSISLGVNLTF

SEQ ID NO: 562 - protein, 844 aa, Escherichia coli str. K-12
MAGNDREPIGRKGKPTRPVKQKVSRRRYEDDDDYDDYDDYEDEEPMPRKGKGKGKGRKPRGKRGWLWLLLKLAIVFAVLIAIYGVYLDQKIRSRIDGKVWQLPAAVYGRMVNLEPDMTISKNEMVKLLEATQYRQVSKMTRPGEFTVQANSIEMIRRPFDFPDSKEGQVRARLTFDGDHLATIVNMENNRQFGFFRLDPRLITMISSPNGEQRLFVPRSGFPDLLVDTLLATEDRHFYEHDGISLYSIGRAVLANLTAGRTVQGASTLTQQLVKNLFLSSERSYWRKANEAYMALIMDARYSKDRILELYMNEVYLGQSGDNEIRGFPLASLYYFGRPVEELSLDQQALLVGMVKGASIYNPWRNPKLALERRNLVLRLLQQQQIIDQELYDMLSARPLGVQPRGGVISPQPAFMQLVRQELQAKLGDKVKDLSGVKIFTTFDSVAQDAAEKAAVEGIPALKKQRKLSDLETAIVVVDRFSGEVRAMVGGSEPQFAGYNRAMQARRSIGSLAKPATYLTALSQPKIYRLNTWIADAPIALRQPNGQVWSPQNDDRRYSESGRVMLVDALTRSMNVPTVNLGMALGLPAVTETWIKLGVPKDQLHPVPAMLLGALNLTPIEVAQAFQTIASGGNRAPLSALRSVIAEDGKVLYQSFPQAERAVPAQAAYLTLWTMQQVVQRGTGRQLGAKYPNLHLAGKTGTTNNNVDTWFAGIDGSTVTITWVGRDNNQPTKLYGASGAMSIYQRYLANQTPTPLNLVPPEDIADMGVDYDGNFVCSGGMRILPVWTSDPQSLCQQSEMQQQPSGNPFDQSSQPQQQPQQQPAQQEQKDSDGVAGWIKDMFGSN

SEQ ID NO: 563 - protein, 667 aa, Escherichia coli str. K-12
MWYAPSLALVWGPACHVQAQDAALTLGKVQVREHAQRSPSTARVLSSVDVIGGELLHDQHVDYSWELLMRAPGVQVTQFRMGTDAGRFSFRGFNGEGRINAVKLLIDGIPSNDNAGAMPYLDAVFPQDISAIEIVRGTNDARYGLNAIAGSVDVLTRTGGNDGRLSVTAGSFDAREVQLSKGFEQGAWSQNYMLAWRDSDGYRDHADARKRSVAGKWFYTDPDGAFRAGLTTRYYDNHALEAGYLDAATARAAPRSSPDYAQNDRSQRRLRQTALHADGELGEQAQWSAKAYQNDYRNQRWVRFSAAGLQQERDTDETHRGLLLRSNWQPDWGALNANLEAGVDAQWQENQSQRYRTVARVRGAQLRDWDYDLRTRGAYVQAVLTPFARLQLVPGYRIDRVDGQLHDVLAGSVAPTYDYGTIKQPKFSASYRVGGQSSVYANWGRTFQIGSGDGAYRRQSGDLGPSINDGWETGFKFAPSTLVDGRLAYWEQRASGEVATVLGVNGVVGIGAVANVGRTLRRGWDAQLNLQPAEHWRAWVSYSRQKAMIATPDPSASATRGKEIENVPHWLATAGLEWQLSSAVQLSAWGNAQGDYYLERTNTLGRAGGDALLNLGARWNVDARNALSLQLRNVTDRAYVYAWYDSGTSGYSPGDGRALSLSWDWSF

SEQ ID NO: 564 - protein, 730 aa, Escherichia coli str. K-12
MASRFPSRPALLALCCSVTLMAQAAEPIQLEATDVNADAVKPTPNALPEAFAGGQVARGGQMGVLGNQDNMDVPFTLTSYTSKLIEDQQAEDIGDVLANDPSVRESYGFGNQSKVFVIRGLPLAGDDIAFNGLYGILPRQIMSTDGVERVEVFKGPNAFLNGASPTGTGLGGNVNLQPKRAGDTPTRRYTQDISSDGRIGEHLDIGQRFGEDNRFGARLNLSQREGETAVDDQDQRTKLFVAGLDYRGDDFRLSTDFGYQKQRINHLRNSVRPGTATKVPTAPDASHNYGQDWTYSESEDTFGMVRGEWDLNESWTAYLAGGARHTREHGTYGTPVLVGNSGTATLGGSDIVHGEDNTSFSAGLNGRLQTGPVSHQIALGANTMWTQAENAYTFYRSTTGNTNIYNTGKLPRPTDVSMTGGDMGDPGVTGKTRNRSIALSDTLGLFDDRLLLTYGVRRQQLRVENYTYDGTTFNGVANPANDGSRSGPAYVKSVTTPVYGIVFKATDSVSLYANRIEGLAQGPTAPANVVNAGEMFPPGRTKQLEAGIKLDKQTYGANLAVFRIEKPSDGYTLGNRFIRDGEQVNKGIELSVFGEPIDGLRLMAGGTRMTSEQKKTLNGTNDGNHAIGVPTFQLNASVDWDVPGVPGLALNARMLRTGGQFVDAANNLSLPTWNRFDAGARYKLKVSEKDLTLRVNVENLTDKNYWASANGGYMTQGDPRLVKFSGTIDF

SEQ ID NO: 565 - protein, 1063 aa, Escherichia coli str. K-12
MKQPIEYLERRYRMQITPVGYQLVNREVMAQDGVMGAVSATSILKERNRFKGGGIATGVCRDLTVDKKGEWFSGKTGALLGVNKLNGERALKDSSHGGGQDEPLDGQGSETGRTAWGNKGWIHVRHWLFIGCLWAMFTSGFSFFPQPYAQAVGSGTLWCGTESQSAAGTLSGGPGSWDQAPVESGGSMGGSVFGEATGPQPLEKLLRNHPLLADSSSSSRSNVGTDPAASSPSSPSLANPSTGSVTMPETIVAITSESVLPGDYDISSVYGTPLNIVDTPRSVQVITQKEIQSSAFISQNVMSLMYMAPGLYMGTTFGEFSVPNIRGMPANKYINGMLSFLPGTGYEGGPMNMNDFDQINIVQGPTMPSLLSIRAAGGYLDIQTKRPYWDGFHGMATVMEGMYDQNLWQADVGGPINDKLAFRFSYLGDYSGSYYVNDYLHNQAFYLALSYKPYDNYEVFFNNSFYTEGYNEIGGINRPTQELISDHEYLSAYLPNTFLGPPVFIDHHKVNYNIGPELYNYGVSVLPQNYNTMRYVPLSAIGGYRANLLNPGSGGYVESERAQVIQRLNVNDGFQIINNSNFEYFSYNYQNLTPYFIYTPGSWVAQNNTSFIFNFDTPIGGGTDNDGKESLLDQKNPSSQKENKFDIHHTVNVGFEFDYANMIVYEDDFEQVFNVWNMGPLYDAVYPSYFQFNLPGKPWFSKYLYQDVPIPGRPGEYFNPGNFSSTDSESWYLRPYWQHQVDLGKHFSIFMGASVLALLSTAQNPPGTPATYFDFGQALHPTGAYFSTVIPNFDFSPRWKPNEWTTVYFDFQQAYLAETGAFYGVSPLTSNYDLHLHQRLYSGGINFSLLNGKLNILTAAFDQEFQELEVFKKVVLVPVPIDVVGGTLQVAYQPDRHLWLVANAGYIIGTFNYAPPLTSGPSMDQPYPSNYVLNNPAKYPFDLFGYFPQGTYPYVGWPNFQTSFMATYTFDWGLGFFASFNATSPQYLAYDYIVRIPWQYTLNLGLSYTSKDKHWVARLWVWNVTDQHNWMTSGSGFATSFNNYDELMVSYPFWIQGQVSYQF

SEQ ID NO: 566 - protein, 982 aa, Escherichia coli str. K-12
MINRKSLGRHPLSFALASAVLLVAAAPALAQDAGSTQTAQDTPKEAPKSKATNLDTVTVTGSRISRDVFNSVSPVQVVTREETTLAGFNSTAAALQSNSVTAGSAQINNSFGGYVTNGGPGANTLSLRGLGATRTLILLNGRRVAPAGSRGSVGSADLNVLPSAMVDRVEILKDGASSIYGSDAVAGVVNIITRKNVDGVEAEFQHNATESGGGDETRYSIVFGSTGERSHFSGSYEHYRRNEMTVGDRSWASCPTDNLRDMTVGNYFGSGDYIDPTTGKSKCFTLDSGGVTINTLGTATFGGFNRWRPNPAVTTGRLPGYESVGYYDRDTFDPGLLRESLVSPATTHTLFFQGGVDLGVMGDAEFYYEFLGNKRDSTQTGYRQLSYDYSVGNPLLGDLSNLPAFALPTETSNGKNVSARTFIGFGNDRSKQSVDFFRATAGVRGRLGSEWNYDFMVSHADSDADYTFNTFLTDRLAQSLNVVSDGAGGFKCVNPANGCVAAPMLNAQTLAGKLPYEWKNFVYTPVTGNTSYKESTANLNVNGPLFDLPGGTAAGAFGVEYRKAKIDDTPSIHSINRNLYNLTSSDPTRGSDSVWEAYGEIELPLLSGVTAAEELTFNASARYTDYQSYGSDTTWKLGGLWTPVKWLSLRASYGTSYRAPALFEQFLGATSGFLNASSDPCNNYGSRNPTSPRYINCASQGLPTSFTATNSVRVDSIGGGLVGANLKAETSDAFTVGLVLQPEFGSGFGDLSFAVDYYDIEVENGVAQMGATYILSTCYNGTTGDFAANNGLCRLISRSPNNTLTVQNGYANLATDKVRGLDFTTRYVRDIGPGEFRANVQVSRFLEQSGKVFEDDPLVDANGRINNPKFTGQLDLTYKFKEWRVRYGLNWVDNMSSYAYYEEDPATSAYKLAVPNYITQDFSVQYTADKWQATAGVRNFADKEPPTISPGAGIYNTIGNAPLYSGYDYFGRTFFVNLSKKF

SEQ ID NO: 567 - protein, 1057 aa, Escherichia coli str. K-12
MESTNHYFRPLGLIILFCLFPVWVLAQTVSVTGVVKDASGEPIIGASVVEAGTTNGIVTDLDGNFKLNVSAKGSLKISFIGYQTQTIPVAGKKQFDITLKEDAKVLDEVVVVGYGQMKRSDLTGSVVSVNDEAIKKSVVTSVDQVLQGRAAGVQVQANSGMPGGSSSIRIRGINSLNASNEPIFVIDGVIIDGSTGSGSDNALASINPSDIVSMDVLKDASATAIYGARAANGVIMITTKRGQKGEAQITYDGYIGWQEMPKKLDMLNLREYAEHKNVRSGKDYSGNDWGIVNKDNNFVRPDLLGEGTDWQDEMFSKAMMTSHNLSVTGGTDKSNYALGAGYLNQDGIAVGSGFRRLNLRGSFDAQVKSYLKMGINFAFSNSRQKLTVSDESLIRTALLQSPSVAVRNAEGTFDGPDTDEWVQTNPVGLAMIKDNRNEKMGIRANTYAEATIIDGLTFKTELSFDYGVTNTYKFDPSYTFGAIENTDRQGTFSKSYNKFWSWRNIVNYMKTFGVHNVNAMIGQEMQESKWEYLMGSRMGYLSNAATDLTLGDAATAKNNGNSGESSILSYFGRLFYSYDDKYLLTFTLRRDGSSKFYKDNRWGWFPSAALAWKVSNESFLKDNNIINNLKLRLGWGVVGNQNVPNNAYKAIYSSVATVWGTGLLAGNTPNPELKWESTYSSNLGLDINLFQNRIELIADIYYKKTNDLLLQVPLPAYVGTSGQGSTSAPWKNVGSLENKGLELTLNTVNIDKGGFQWRSNVVFSMNRNKVKSLDTATSLIDKSNQTGETITVLTRTSVGNPIGQFYGYKVIGRFEKATDFYYRDASGAIKPVALPEGMSISKNSIWIGDYIFEDVNKDGVINEQDRTYIGNPEPDFTFGFGNSFSYKGFDLSINLTGSVGNEVVNWGRRELENPRGNNNILKSALDYAQLALIDPNGPDDYRNIQIVGGDPYACRMAIAKGTDDSNYRFSDRFVEDGSFLRIQSISFGYTFPRKWLAPIGIQNLKLYCNLQNVYTFTKYKGMDPEIGSANQDALLTGFDNYRYPSPRIYTFGLNLTF

SEQ ID NO: 568 - protein, 757 aa, Escherichia coli str. K-12
MNKWIYSGVPRCAMRGEANLRSKQASGARFMPGAKSSWYSLEVLASFFLLSDPVAAQQAGTPVQLQEVDVTAQGQGAYASEARYQNKTVTVGPLGERSVQDTPFSINTITQDMIVNTQARELNTILTYLPSVQISNQQGGEVTRPQSRGFYGSVVQNTRLDGLNIIGTTAIPVEILDNVQVLNGMAGALYGPAAPSGTFSYTLKRPTDVPLARALTSFDSLGVMTGYADVSARTGPNNMFGYRFNFKHGQGQSYVANSFVANTLYSGSFDVHLTEQTVVELDAYHYQSLQYGLPGAFVYGGSTGQNPLLPAAIDPKLVGYGQPNYGTNLSTDSGDIKIRHAFNNDWSLLAGGLYQNANRGLSGISNTLASNNTGNYTTTAGYTAASRFDIGSNMLYINGHLNTWGITHDVTIGTNGYINGQYNNKNSTTFMASLGSASIGNPMLFAPKAIGPTGGQYLASRLFEQSIIAADTIHFNDQWSLQGVLNSSWLSVDNYNAAGVKTSQDRENGVLSPTASVMFKPIEQLTTYFTFADGVQQGDTAASGSVNFGQTLAPYRSYQYELGAKYAVNENFLLTLDGFRMTRPLAYTDAATKLFQVQGEQRNWGIEFFGSGAITPELSAVGGVTWLDPRLEGTSSYTTSDKLVIGVPHWTSNVFLDYHPTWSQGIAFTLNTRYESARAATTTNNSWAPAYATLDLGLRYSTKIYGYNSTLRFQVANITDTRYWTSLLLGSINGVASTNTAWIGAPRTFQLTYEMDF

SEQ ID NO: 569 - protein, 377 aa, Escherichia coli str. K-12
MHADEIRALEQALIKTKAGAGCAAMMWGLCAQAGGLDRTGQDLGPLFENGRYLSVETYTVRPRIQGADALGKSTGQVADDYTQWGFAYKQDVNPRTSVLLMLSKPFGLDIAYSPRQSPLFGGTQARVSSHELMGALRYRWDEHWAVHGGLRLQRTEGHVALGGMVFGALSGYRVDFRPSTEPGYLLGMSYERPDMTLRVAATYYSAIRHKIATRENLWPGETRTASTAPQSFNLDVQTGITSSTLLFGQIRWTNWSQFRLHPQTLAAILPGRSLADMEDTTTYTLGLGQRLAANWSGFVTVAYDKRSDKAALSPLRPTDGRLGYTVGMSYQQGQFKLTPWLSYQRLGSVDISSGGTTLAAFDAESATAFGIRLGYQF

SEQ ID NO: 570 - protein, 655 aa, Escherichia coli str. K-12
MNAIRYKVGTVLFILLILLSGISPTMNAMIAPVTYSVRGKVIDRQSRQPVAYANVFVAGIPGKGASTDSLGTFKIEQVPPGIYSLEASCIGYQTVSTPEYIVSASTPFIEIEMEEDANLLNTVVVVPSPFRRSIESPVSMRIIGLQEIEKSPGANRDVSRIVRSYPGVSFSPIGYRNDLIVRGGSPSENRFYMDGIEIPNINHFATQGASGGPVSIVNADLIREITFYTGAFPANRSGALSSVLDFRLKDGNPDKQAFKATIGASEVSLSGAGHLGQRTTYLFSARQSYLQLLFKALGLPFLPNFIDGQFKTKTRFNEHSELTLLGLAGIDKMKLNTDEKGEDAEYLLSYLPTIHQETFTLGASYRHYNGRHVQSLILSHNYLNNRNLKYRNNDDSSEDNLTLRLRSTEQKTTLRFENQTRLGAWTLKEGAELNNSIYTNHSRQRLYGSHSGTLSIYETSLNIFGWGAFFSSNYTTADKRLALSAGIRMDGNTYNRKMRQLWKQFSPRLSASYKLSEQWTLSGSTGLYHQLPPYTALGYKDNEGQYLNKNLKYMQVFESSLGLDWHLQDRFMVSAEGFFKRYSRMPLSLQDNIPLACKGNDYGVTGNKLKQPDVIMSTGIIENPSAPVAEQRYKMKYLKQESGTILPTLGITVEF

SEQ ID NO: 571 - protein, 726 aa, Escherichia coli str. K-12
MEGKMKKYLMGLSILIFCASAYGEVIDLGEKNIYSETGFEKNLRNSTTSPFIITSKDIETKGYTSVSEVLDSVPGVNIQEGLHPAVDVRGQGYQKAKATVQLLVDGVPANMLDTSHMNVPIDVVNINEIERIEVIPGGGAVLYGSGTSGGVINIITKKYKGNNNVRGGVGYQVGSFANNKFDVSAGTSVGNFDFDVNYSKNRKHGYRDYDFTNSDYFSGRINYNISKTSNIAFKYSGYRDKYTYPSFLTQKELDDNRRQSGNDKEAKENNRIKKDEFTLTYNTKIGDKNDLNILGFYQKTDIPSESIEDYTTEYKGMLAGQAAGLRAALRNPMLPPRARTAMTNKLNALLTELRSTNNVDFKTVSQFKDTKKAIKIKDKFTYDNAGSNVVVGLGYTDNDMVRVSKMELVGKRVMADTKLDLTKKTFEVFALNTFKVNKFELIQGLRFENSKYDGTRRNNTDTLDIKKSKDNWAGSLAVNYLYSDTGNVYAKYERAFTSPAPGQLVDKVETATNVYTYKVNNLKSESTNLFEIGWNDYLFNSLLSADIFYAETKDEIATIFDGGRPNAHGTAFKSTNLGKTRRYGFDLSAEQKFEKFTFREAYSFIDTKILKDNSSSFEGKHIADVPKHKLVLSVDYDITSKFSVGADYEYRAAAFIDNANKNGKDKAKSVFNLRANYKLTNSLNIYAGINNIFGAKYYNSVGVSSGERIYDPAPRINYYAGFKYKF

SEQ ID NO: 572 - protein, 698 aa, Escherichia coli str. K-12
MQQPSVTRRALKTLCAVLLFAPASASAAESARAESTLPEIVVTATKTAEDPFYVPSSIETVSPAEIEREVAGNTPELLDKVPGVSLEGSGAWEAAPIIRGFSGTRTLVLVDGERENNLWAGRDPLSPFIGVADIERIEVLKGPASVLYGSDALGGVINFITKKPDYAQNATWQFSPEAGVSYSSVDEGWQGTVALEGGGDGFDFRIDASARDHGNYTDGNGNKVTNSQFKAQNLGIQGRHLFSDQHELSLSYRHNDIDDKGVPQKDNAPWSHFTKFDSDIWKAAYTARDLGFIEELKLKGWIVDQERVFDGRLENPSAGMYTLKSNTIETGAKGASLQFTFEPAENNTLVAGIEYIYEDAESAEEQVKKQLSDDQTKKIVYFPPVSDAHRDHIGIYAEDKHDFSNGSVLTSGIRYDFFSADAENALYYEEKANGDLIKSASNVFEEKTDQALTASIGYLYPLSSTVNLAANAATGFRAPDIFERFSTRGGSTIIIGNPDLEPEYSWNIDTGLKVKSGNLSGSFSVFYSWIDDYIDLENNPGVTFGGLPTKKYVNVTEAELYGFDGGITWQPVEHLSLFGTIASVIGKNTTDNQRLNTIPPLNGSAGIRWEDRLNARSDWWIEFETELFDDQDNPAPNEDQTPGYALFNVKGGIRYNENVVLSLAVDNLFDRTYRSHLNYADFLYEPGINVKTALQISL

SEQ ID NO: 573 - protein, 764 aa, Escherichia coli str. K-12
MMYLGRSPHIPYPLSVLALTLFLATTGMQAQASTTKETDEMEIIVVSATRTAQDIKSSPSAINVITEEDIQGMTLFTIDEALGKTAGVMDRRTKGFMETTPSLTIRGLSNARDTLVLVDGVPQNDSRNGQVNWTMIDSENVQQIEVVRGPFSSLYGGNAIGGVVNIFTKVPEENSFSMKMGIGGPADSIAPENFSDQALQGTLKILDSVTLGANYRKRETDGYPTTHVNASDAVIDKLPEGVTGWVPYTTNVGGKSNLIGDMGDNWFNDETYGLRLTYTPSDDTRLNLSYANSDSVYGYDQPHSLLRTTEVTESGKVDSIPTYSNIPMTTWLNGALFARGGSTTQTNTGLNLSTSWDQINLHISAGHISKETTTIIAGLTTANAGHAPINPVTFEGGDGRLAPATESTRKSIDVQLDMPLSDNHTLVLGVAANEGDVTEERWSLSNWTDPTSKVFMSADTTAKDQIRSFYVQDAWQLNDKFTAYIGARQDWWKMRGGESHSYTQAGGTGSITYDKVTDSPISPKISMVYKPSTNTSYRTSLGKAFRAPNLYEFFGTANLGGNIYVGNPDLKPETLVSWELGVDHSFQNNINAIATIYRSEIDDRIATQTVDGISMPQNVAEAKIQGVELELKGTWHYGLGWSANYTYTDSEVTQDPNPNVVGKALPHTPKNMYNLNLNWRQGDWYITANHSYQSKRFTNVTNTDVVTHVPGSTDSFMLTDVKTTYFVSDNITASLGINNLFNEQYNQFYISPGRFWFAELRLSY

SEQ ID NO: 574 - protein, 494 aa, Escherichia coli str. K-12
MFDLRFSTLASLMLASGAAYSDTITDSEAHTLGDIHVSTSGMDKHDASMTTEGTDRYGTNATNTATRMVLSPRETPQSVSVITRQQMDDFNLNSVADVMRRTPGVTVKTLDTERLQLSARGFDITNFLYDGIPSTRAGQAKQAVLSDTFIYDRIEVLRGASGLLNGIGEPSATVNLVRKKPTRDFTGQVGVELNSWDGYRGEFDASGSLSNNGRVRGRFVSAYEQGDSFLDHYENDKQIFYGVVEADLFDNTLLTVGMDYMDHDPRGSTWGGIPLFYSDGGIADLDRDLNPATDWSRWARDTQTIFLNLEHHFENGWYSKFAYNNQQSNYDAQLASAGGGQLNRDGSGKTLWAGRYVETKPRTLSMSTPTGPSHCLAANMNWWWVPVIRTPRVITPASHRSVSITWYRTCLIGMATFQNRPGPRQPPWRTRAAAKQACTPPPASNPLIVLLLLPAGKLWTGNKKPQALTGEARLTTNPIRKMAKWFPTWGWSMT

SEQ ID NO: 575 - protein, 839 aa, Escherichia coli str. K-12
MAWNFWQSSIGVASIITVLGSQPVWATPVLVTAVELYDTDQGLEVVLKTPPGVSIETESSTVDNTLIIILNNAQFQLEQGQLPVIIDNPIPDIAQIVVGQSDPNTIEIEVTGVNEIPKVDLLQNGEEFIVSIPFVTTSQTPPETPEPEPEEPIELTVIGEQVRPTYQVPNSSIGTRTDTPIIDVPQAIQVIPQEVIQDQGTRSIGEVLKNTSSASTGRTPSQAPALNPVIRGFESGNILRNGLRDETLRFSSEISNVERVEVLKGPASVLFGRGDLGGVINLVTKQPLDRPYYGFEYQVGQFGLHRPTIDFSGPLDQNGIAYRLNAGYQTAESFRKFEHSESFFISPIVRLIDHENTTLTANLEYLKYRNFETAPDLPASGTVIANPNGRVPRDANLGEPSLSETETFVTRLGYQLDHRLNSNWSLKSELSTSFLDIPKNIGITPISNSGRADGLNNDGRTVRRFLIENPSSLSTFVLNNNLIGKFNTGSIEHNLLLGVEVSREQTKDQLDFRQISAIDIFNPVYQPETVSNFAIPFGNIDTRKNSVGIYAQDQISLSQNIILVLGGRLDFSHQKYEDLLSSAESFERNDTVFSPRVGVVIKPRENLSLYASYSQSFSPVVGRTRVLVNEQTGQSIIGEPFEPERGTQYEVGLKANLLGDRLSTTLAFYNLERTNVAAQGLSEPLSQIQIGKQRSQGIELDVAGEILPGWNLTASYAYTDTKILEDNRSEFQDKELQNVPKNAFGLWSSYEFQSGNFKGLGLGLGVFTQGERQGDLRNTFTLPSYWRTDASIFYRRDKFRAAINIQNLFDQNYWEGARDIVRIVPGAPFTLTGNVSWEF

SEQ ID NO: 576 - protein, 351 aa, Escherichia coli str. K-12
MQLTQRFKLAAVAAAGLVSAAHAQSSVTLYGQVDAWVGVQKGLDSSRAGVVNPGGMSTSYWGLKGSEDLGNGLKGIFALEAFFRPDTGRAGRFDGDNFFARNAYVGLASNTWGSIKLGRNTPPYFVSTILFNPFVDSYTFSPAVFHTYIGNGLSGAAGISGLVGDSGWNNSILYSTPDFNGLSANLIYGAGEQAGHNGQNKWGGSLLYFHGNFAATAAYQQVRFDASPGDLSTIVAGFTRQDAALLGATYDFGAVKLYGQYQHIKNTISTGDTKANGGQLGVSVPLGAGSILASYAYTKTSGAADVKRNTWAIGYDYALSKRTDLYAAYFRDKVTSLSTADTLGVGMRAKF

SEQ ID NO: 577 - protein, 496 aa, Escherichia coli str. K-12
MTWLSRTTALALLWSAALATTSAFAQSPANEELAEIRARMEAQEAELQALRQRLDTQPAYGFHHIEEDCCGGGAEIYRLPIVYDYSYAPDCCDDGGPPKQHVMKYYTTYDKGFVIRPFNPEENPFEIKFGGWVQFRYNGFSRNADSWTDSAGTTRPIRNRNEFELERARLQISGYAIDPRLSYFIQMDGDTDGSDSVDFFDYWWAWEFNEDQQVYFGKRKVPGSRQWLLSAKHTRLADRPLAADFFRPGRTVGVFGATKVGENGYFEAMLGDGYRTENTPLSEIDDKLAFAATNYWDPYGDFGGKLTDYDYSCDQRMRLGHSFVYAPNASIAPGQPIDESDFIRLSNGTKLTALGALAPGVRLSEFDVYLYTLDFAYRWRGWSFDAEYYMRWIQNLRASGALPVENLYQHGYFAEGGYFIIPEKLDFNLRYSYVSGYYGNVDEYAAGFNIYPCDTRNLKLTFDVTKVNGSPLNNTSSGILVGDDGVLFRGQFQAEF

SEQ ID NO: 578 - protein, 401 aa, Escherichia coli str. K-12
MGILIMKSLKPLAALVGLLVLSGSANAVNVYNDKGTRFDVNGQFRLKTQVTSKDHEMRMRDDGSRIGFFGSHELTNDIKVFGKLEWGSDTQKTNSDNEKTNFDLYNRVGYVGFSHRDYGQIQFGRTYIPIDWVKKSSYGYGNTGVFYFSDVLGRAVGYSSKGVGKNNFMTRLPQTIFIETNRYEGFKLAATLTGKDGKDNDGDGKNGDRRTGDIRHAYSVVGFYKSTFGLEFDAGYSAAVGEPNLYPDSVVGNKKPENSILAFGAEYFFPGREFSIGIDYGQSRGKNTGLTLREGATEKDYKWNSVKGDWKANLYGVGVKWHWDRIESGMYAGYYLRDGDANTFNYKKETYTVGVDKRFAVSKYNNLRLFAEMAYDDARSENPAYEDKKQYIFETGMRLYF

SEQ ID NO: 579 - protein, 802 aa, Escherichia coli str. K-12
MARKLPLKTALMLAAALAPLSFSAALAQDGAAPADANVVALPEVDVISTSPLAGAGGEDRFSFPSQVHTVDAPAFERTRSPSVTDALQQRVPGVTVIDVNGNPFSQDLTYRGFEASPLQGTPQGLAVYQNGMRVNEAFGDTVNWDLIPPQAIARTDIFTANPIFGLNALGGAVSIEMKNGFNWQGFEAQILGGSYGRVTGYFQYGKQIDNFSLYVTADTAHEGGWRYFSPSTLVRAYGDLGYRTQDAEVHFIASGATSNLGVIGPTPVNLLSQSLNSIFTFPQTTQNDMGSIALTGKFDINKNWQIASNFYMRTFRQKHSDGNDADLGGCDDPNDGLLCLDEDNFPAITNPNAFVVLNNHTGQAIPFTDGVVYGTIDRTETHSTTAGVTLQATDNEKIFDHANYFTFGGSVDRGFFNFASTSTLGAIQANLHVVPTGTFAGSNAILQTAGDLGYVPTYLNGTTTYYGIYALDTFNITPEFAATAGARFNIANINTEDTSGLNSELTSASNFNRINPVFGLTYKILPWLSAYGGYSEANRAPTPLELDCANPLRPCLLENSLVSDPPLQQVVSHTIEAGLRGAANNVLGGQINWKAGYFHTESTNDIISLASTVTGRGYYSNVPATLRQGVEASIEYHSGDLMAYANYALVDATYRFSAELASPNNPFADAAGNVFVTPGDHIPGIPRQTAKFGLEYNFTSKFKAGADVLIVGSQYYVGDNSNLNPQLPLYWTANIHASYQVTENIQVFGLVNNLFNNRNATYGAFFDTTTNAQIANGTPLTDPRTLTPLAPVSLYAGVKVNF

SEQ ID NO: 580 - protein, 825 aa, Escherichia coli str. K-12
MFSRSQKHPSWRLSPCVLAAALCAVAVGSADTARAQAPAASAQHYEIAAGPLADALTRFARRAGVVLSFDPALVQGRSTAGLQGVYGVRDGFAALLAGSGLQARAGGGNNWSLAALPRGGDAQTLAPVTVLGLEGALAPTVGYVASASLSGTKTDTPLIETPQSISVVTRDQITEQGAQTLNQVLRYTAGVATETRGATATRLDQFSVRGFSAATYLDGMRVFGGRDALPQVDAYRLERVDVLKGPASVLYGQGGPGGVVNQVSKRPLDEPLREIEVQAGNFDFRRVNMDFSGPVDEDRRFLYRVTGAAYMSDGQVDHTRERRYFVSPSFTWRPSADTTLTVLTNFQRDPDMGSYGSISAMRTLLSAPDGRRLGPNHYDGDADFEKSDRRSYSLGYQLEHRFNDTFKASQNLRFQHAEGVYRSIYGASNNNYGYLDKDYRYSQRGLAISDVDVDAFTIDNNLQARFDTGALAHTVLVGFDYQRVQTDTLSGYGSAPPLDVFDPDYHMGIERPPFTSDQTQYNYQTGLYLQDQIRLDRLSLLLGGRYDWSRTHTGTDNLANGSHSSSALAAEAFTGRVGAIYNFDNGVAPYASYSESFEPQTGTGWNNTPFKPTEGKQYEVGVKYQPPGSATLLTLAAFDIRRKNLPTTDPDPTHMCGVSRCSIQAGEVRTRGIELEAKTEPLRGLSLIAAYSYLDNEYEKAYPNTTGLDLKGKKPVAVPAHQASAWARYQLQEGPLAGLGMGAGVRYIGSSYANETNTLKVPSVTLVDMMLDYDLGRASPALKGMQVALNVSNLFDKEYIGSCLSDSWCWYGYQRSIKASLRYRW

SEQ ID NO: 581 - protein, 689 aa, Escherichia coli str. K-12
MQVIILRWASLCWGMLFLLPFFKAQAMDDAVALEALVVTADPLGRSEEDILQPTSVLMGKALSIKDKRNIGEAVAGELGVTSSDFGPAVGRPIIRGLGGTRVRVLEDGIGAMDVSAISPDHAVAVQPFFADQIEIFKGPATLLYGSGAIGGVVNIVDHRILDYVPEAIEGDVYGHYDSVADDATGVFRFNAGAGDFAFHLAGLLRDTEDYGIPGFAQVNPEPGAKSGTLANSDVHTKNFTGGLSLVRDEGFLGLAVSRLTNEYGVPGEHGHEDEAGQAHEEGGVRIDQAQTRLDIKGTLYLPLAGIQTIKTRWGHNDHTHQEFEPSGLASTILNNKEWEGRVEFLHTPFGEWEGVAGLQYRNRDLSARGEEAFMPPSSRMDSISVFILEERAWRRWHFEMGGRFEHQVAKKSEGGPHASHNLFSISGGAMWDFWKDYAVGFNVSHSERAPALEELFSEGPHLATNTFEIGNPFLNKEISNNLDLSLRKTRSHWHWKLNLFANFISDFIFLQEQDKNGDGIADRVNLEGEPSMDPDGLLLVNEKQADAEFFGVEFETVIGLFEDHRGKLDLRLWTDYVRGKLKNGANLPRITPLRFGSELDYERGPGYAGINLMRVQAQDETAALETETGGYTLLKVYMGYRFALGPVQYAVFLRGTNLLNEKARRHTSFLKNQAPLPGRSAMVGVNATF

SEQ ID NO: 582 - protein, 782 aa, Escherichia coli str. K-12
MTLPSQNPRALGIFSLGLMAISSIAYAKNNHAELDLFADINIEELLNITVSSASGLNETLRNAPAAMVIVSAKDISQRGYRSIEDVLMNLPGFDNSITYGNSNFTSYQRGYRTPFTQRTLVLLNGIVDNHLWTQEASLTSTYPISNIERIEILYGPASAVYGANAFSGVINIITKQAAQTLKNEHIQTVKVSKGSFNSDSIELSLAGASQAWQYNLSANLLQSDEPDIDDFAPWGYLSNEMLSNRAIWGPIVADQSLAQQCASDACPQRGYKHNYGQYHDSSRNWGLLADASYNNFTAGLILWQLNNGYGVYYPSDRAQPGSAWQRNSKQYYLKHYGQLTSQLKTKTLALYRENRLWGDWAEAYPVNPDLNTQNVLSAVSLSKWNSISNSWLVQQDYEWQRSEQLTFSAGLKYQEKSLTKAYEVCGYWEGSFCSTSTLSGVVLSTETSISKPSNPAYKMPADNLIKIKDKGLYLQGIWQLAQWRLNAGARYDHNSIYGSTVNPRLSAIHFLSDKSTLKLIYGEAFQEPSAAQLWGGWNGRAANENLKPEQVKNLELIYMFQQPNWLHDFSLFSARYDDVIKEEAENAGHRQNYGFEYRGQFKFDNPWYRHSAISGHIYYTYTKALSSVSYDHNIAAWVGEGVEQCALLTPTTYNPCQDQNIDVGDIAPHKINANLNIPLHERLNLNIGANWVSSKKLYLRNPLRDQQQDNASYLTLDTNLNYQIDNLLVGVRIKNLLDKQHYHSGVEAASSGNDFSQRSQGWHNSLIPQVGRNFVLSITITF

SEQ ID NO: 583 - protein, 2377 aa, Escherichia coli str. K-12
MIAGVSSHWQASWEDYEFLSGFRRHARARPLTASDRHGRTDQFAAWPLHPSCFIHKPYQRRGVIPACAHTFHFAGEIMRRLRAQAFEGSRSRPAGHGVAPTLLALALGFQGAAAWANCTTSNGATTCTNANGSHTNKVGSGPSGMNERVTVNQGARIETNASAAISVGTSGQVRIEGGAVVQSTVNTAASGQYAKTLEAASNNNISIQVGAQLLAKGSASQSSALGLSGAGNTVTNHGTIRADNAAAIWITANTANAANTIDNYGTIETVLNGGYANAIGSTRNNSATGAGVTVRNHANGRIVGNVKFEAGDDSVILDGGSTITGSLNGGSGNNSLTLKAGDGTLGRAIRNFGTITKQEAGTWTLNGQVGRNDNNLKSTVKVEGGTLVLRGDNSGATQGGVLQVSAGATADVTAASAMQSISNAGTVQFTQDSNAAYAGVLSGTGSIVKRGGGDLTLTGNNTHTGKVVVEAGSLSVSAANNLGGAGSSVQLKGGALALKKTIAVNRGLTLDSGAQTLIIEPGTTTTWQGQVSGAGKLVTQGGTLVLEHASNTYSGGTEINNGTLRAAHDASLGSGTLALKNSQLAATDSFTATRALTLAGNESIDVAATKILSWNGEISGAGTLVKEGQGTLLLRGTNQQNGGTTVNAGTLQISRDANLGRGALALNDGTLQSTGSFATSRAATLRGQATMEVDASHTVTWNGELSGGGMLRKSGQGTLALAGANTYSGGTVVEAGALRAGHEDNLGRGAITLQGGDLLAGGSFSSNRDLTLVRGSLDVARDATLTWNGAISGAGDLVKTGDGTLALTGVNEYAGQTVLRQGKLRVAREESLGGGALVLENNTVFESAGSYAIGRRVTLKGAPKVATPAGDTLEWRGTVDGDGKLYKQGGGTLVLSGNNTYAKGVEVWGGVVQVSRDQNLGAANGAVTLNGGGLAANGDFTSNRQLELTAGAKAIDVAAGKDVTWRGVVNGAGALTKAGDGTLRLEGVNTYTGGTRLQGGTVQVSRDNNLGQAAGAVTFDGGRLASTGSFATARAATLNNAGQIDTAQGTTLTWNGAIGGKGELRKQGAGTLVLGGANTYQGDTRVEAGTLQVSADANLGQGAVHLHDSRLATTGTFATSRRLELTGRGTVQAAAAATLDWRGTVAGAGTLVKEGAGTLVLAGDNQHAGGTEVRAGTLQVSRATNLGPGALALENAALATTASFTATQAATLTGNAAIDTAAGTTLGWEGAIGGTGSLHKKGEGKLVLVKDNHHDGGTTIHAGTLQVSRDANLGSGQSAVTLDGGALAVSAGFSSGREIVVGAGHGALSVAGGHTLQWQGQVGGAGALTKTGDGTLVLEHDNTHAGGTRVTGGVLRVSRDENLGEAHGMLTLDGGTLSTTAGFASRRNATVGNGGGRIVVADSATLDLQGDVAGAGRLVKEGAGTLALGGTNTYAGGTVVEAGTLRVARDANLGGGALTLNNSRLHATAGFATGRDATLTGRASIDTDNRATLQWRGTVDGAGRLVKQGLGTLVLDGDNRYAGGTEVNAGTLQVARDANLGAGDVALNGSRLAATASFATARTATLSGAAAIDTADGVTLDWNGLLDGDGALVKQGNGTLALAAANRYGGGTIVKAGAVRIARDANLGRAGTGVTLDGGALATTADLATGRAATLGAAHGTLEVAAGTRLDWNGAIGGAGALTKTGAGTLALNHDNQHAGGTLVHGGTLRIARDANLGAAGTAVTLDGGTLATTASLALDRALRVGARNGVLQPDAGTTLDWRGVVAGAGKLTKAGPGMLVLSADNRHGGGTAVTGGTLQVSRDANLGAAAGALTLDGGTLLSTASFASARAATLDAAGGTFVTRDGTRLDWDGAIGGAGGLVKEGAGELRLGNANTYQGPTRIAAGRLAVNGSIASPVTVEQAGVLGGTGRIVGDVANRGVVAPGNSIGALTVAGNYAGTGGSLEVEAVLGGDAAPADRLVLDGGAASGVTPVVVKPQGGVGGLTLRGIPVVVAQGGATTAPGAFRLAQPLVAGAYEYQLLRGAGDGAAAQAQDWYLRTSRVERDKAGRIVKVVPFYRPEVALYAGTPMLMRMTGTEMLGSYRERAGQTGAVSPEAGATAARGGWARTFGRRFERSAGGEAAPSFDGHLAGAQLGADLYARSSATRHTDAFGVFGGYATVRGDVHGLARGEIQAVGTSTLRATQLGAYWTHTGPGGWYIDTVLAGTRYRQQTKSSAQVGAVSRGWGMTASVEAGYPWQLNPRWRIEPQAQVVYQQLGIANGADRVSTVSYKTPDALTARLGTRLSGQYAYGKAQLRPFMGVSLLHDFTGADTVTFAGAHGVRASRQNTAVDLKAGVDTQLGKSVGLWGQVGYGKSVGSGDGSDRGWSANLGLRVAY

SEQ ID NO: 584 - protein, 1007 aa, Escherichia coli str. K-12
MIKFNTRSAALAAVSAFAITAGFAGAATAQSATSTLRGTVSDGQAAGTGTVTATEVATGYVTRGRIGENGQYVIPGLRPGTFRIQVTTSDGRTTEDTVTLALGQVGTLDLDLTSTGDAATNVGEIVVVGRRTFNVRTSEVGTSVSQQQINNLPQINRNFLNFAALAPGVRVTEGDTERTITAGGQPSSAINVFIDGQNQKSLINDGGIAGQDDSRGNPFPQAAVQEFRVLTQNFKAEYEQASSAIITSVTRSGTNDLSGDMFVTYQDSSWIAQNVFSKARGEERPQLDRLQYGGSVGGPIIEDTLHYFLSYERKEETRGSSVFLRRTEYTPLFEDQLGTFEGPFEQDLVFGKLSWAINDQQRLDLSGTYRKEEDIRNFGNGPDAFSRANAINGETQSLQLRHQFQGNGFLNEASVDYLKSQYNPRAVNFDLSGQRYVSYRDASATTPGFQFRYDQSDGIFNAGGGTNNQDLTQESLTFKNDLTFNDIEAFGLHTVKMGVKYSIQTLSVFKQFNRNPQFTYDVDARPEVVGSNAIPTVVSLNLPVDATSVDNNVLGLYIQDDWQITDKLEVNMGLRWDYEDNAVNNDWRTPDDIRRMLTAIGNAPGFDYPSYINIDDYISDGDRPAFKDAYQPRFGFSYDFFGDERTVLFGGAGRYYDRIGFNFAFDERFKPYQLSRTIYFSPSGGAYGGRTDTVAWNPSYATAEGLDSLLGGTVGRGEVFLIKNDAPPPVTDQFNLGVRQKIGDWQTALTFSYAKTKNEFAWYRANLDPATNSVPAAAQPANLIDPVTGVAFPYNAGVFVSNHDREREMHAIYFTADKPFNTASGWGANIAYTFMDATQNGSRDQGLGNFDFDYPWTSYSPTFTTPGVERHRLVMSGTVALPLDFQLSSIITLGSGLPYTRNNVGNGAKPDWFSAYPEKHAFIIPAWEWAYRQVDLRLAKSFEIFGGQEVEFTADAINVFNFKNYSGFNQTYRTSNTGEAPLNPTFGQPTAQFLPTRSFQVGLRYAF

SEQ ID NO: 585 - protein, 1068 aa, Escherichia coli str. K-12
MRYILKTLILCGIAALAPLYGQQVTGSILGNVVDQQNAAVADTKVEARNMETGLSRSVQTNERGEYRIDFVPPGNYVIEVARAGFRTFKQSGVTLQVGQFARVDVRLQVGDASVTVSVEGSAPLVNTTDATVGQTVNKEQITTLPMVNRSVYSLLNLTPGVQNTGNAIALGFPAQRTFINGGADATMGSVNYYLDGGSNVSSLRNTGNTPPNPDAVEEFRVETNNYSAEYGRFGNGVINVITRSGTNDFHGSLFEFLRNTKLNANTFNALIKPPLHRNQFGGSFGGPIIKNKTFFFGTYSGLRQTTTTFLSSAVVPTAAQRAGDFSAITKPIIDPVTGNPFPNNQIPVNRFDPTAANIMNKYVALSNFNNNILQAQVPSPYNTDEYLAKVDHQVTDSQRLSASYYTTAGTNSILPGGNMPWSIQAYNWRQQNANLNYTWSITPNTINQTWLSYTRYFGGRTNIPALSLHDLGSDYTIQGPANLPQIAITGYFTLGQSIAGPVAGDNVYSLRDVISHTRGRHSLRFGGDISLSKDIQQTLLNNYGTFSFTGAKTGPKANQGDAFADYLLGLPVTMNQDAPETALYNFFQAGLFVQDDFKVLPRLTLNLGLRYDVQTPPTDPQNRELTFVPGRQSTVLPSAPAGILVVGDPGVERGVVSTRWNHISPRVGFAWDPFGDGKTAVRAAGGIFYGSVSGNGWGTVENSQPFAIRQQFTNVASLTHPYAALPGGVSPFPYVYTPSTARFILPAGLLPIDLDFKWPKSYQFNFTIQRQLGRGFSASAGYVGTLSHNLAFSPDINYPFYNSTATTGNVNARRPYGNGNLSTINLMQSNGTASYHAMQLTAKKAMSKHLTLTAFYTFSKSISSAQMDGASTSGGAQDFHNLALDRGRSDYDQRHNFVSAIIWDTSYYSGANPVLRHLLNGWTLSPIINLASGLPFTVASGKDNNLDGVSNDRANVIANPYLDPNRPRAQVVAQWFNTAAFIANPIGTDGTSARNLMDAPGFRNIDMGLFRNFSIHERMKLQFRAEFTNFFNMVSLNSPNATLGSATFGQITTAREMRQLQLGLRMTF

SEQ ID NO: 586 - protein, 735 aa, Escherichia coli str. K-12
MSLVRFSRQYAGSVVLLSVAGSAVAQTQLHDPSQVKDLPAVQVLGTAEEEVKESLGVSIITAEEIQRRPPVNDLADIIRREPGVNLTGNSASGARGNNRQIDIRGMGPENTLIMIDGKPVSSRNSVRYGWNGDRDTRGDSNWVPAEDVERIEVIRGPAAARYGSGAMGGVVNIITKRPAEKPTARATYYVNQPESSKEGNTNRVNVSLSTPINDTLSMRVYGNYNKTNPDARDINAGYAPAGTNGVTTTAGREGVINQDMNALFSWKPDSRNTFDLDAGFSRQGNLFAGDTMNNANTAISDALYGKETNIMYRDNFALTHRGAYDWGTTRANIAYDYTRNSRREEGLAGGPEGAPNGNGFATARLKNWRAAGEVNLPLNLGLSQMLTVGAEYLHESLEDPSGLRQTYTGGTIGGTSPANRDPKATQSSYALFVEDNIEASQDVTLTPGMRLDYTSKFGNNWSPSLNASWAATDAFKIKGGIARAYKAPNLYQSNPNYLLYSRGQGCLASQTNSNGCYLVGNDNLSPEISVNKEIGFEYDPGTWRTSMAYFRNDYKNKIISSTDVLYRLNNGARVLQWANSGKAVVEGLEGNLFVPLAANLDWNTNFTYMITSKNKSSGQPLSVIPKYTINSTLDWFYTEKLSFQANLTYYGKQQGPSVNERTGNTLSGDGLQSVNPYALAGLSTGYEVNKNLRFRVGVSNLFDKRQYREGNASTAGAATYNEPGRAYYATMTVSY

SEQ ID NO: 587 - protein, 218 aa, Escherichia coli str. K-12
MRIFVATLMASTMAAAGFSAAYAADAVNEVPQAPVAYDQPAAVKDWSGAYLGGTVNYDWGRFSSSNDGRDAKGFGGGVYGGYNMQSGQIVYGAEADVNMGDEKGSAGTVAGRAVEGKQGVNGSLRGRVGYDMNPFLLYGTAGLAVSDNKVRDGVNKDSATALGYTVGAGVEAMVTDNITARLEYRYSDYQKKDYTLGNDAFSRGFDDHSVKAGIGVKF

SEQ ID NO: 588 - protein, 739 aa, Escherichia coli K12
MQMPPSPRPYAGAVVSLLLSGTALAQNAAMPHDADVVQEMASVQVLGTAEEEIKESLGVSVITAEEIQRRPPTNDLSDIIRREPGVNLTGNSASGARGNSRQIDIRGMGPENTLILIDGKPVDSRNAVRYGWNGDRDTRGDSNWVPAEEVERIEVIRGPAAARYGSGAMGGVVNIITKQPADKTSASATYYLSQPEDSKEGNTNRVNMRLSTPITDTLGMRIYANYNKTNPDARDINAGHAEASANGNPDTAGREGVINQDVNALFAWRPDTRNTVELEMGFSRQGNLFAGDTMNNNNNDFTDSLYGKETNAMYRQNVGLTHRGSYGWGTSRATLSYDYTRNSRQQEGLAGGPEGAPQDLGRDTARLRGLRAAGEINVPFKLGWQQVATAGVEYLHESLDDPSAMRQEYSGTGGTIGGTAGSERPTRTSQDSYALFIEDNIEAGLRTTLTPGLRFDHNSEFGNNWSPSLNASYAATDSLRLKGGIARAYKAPNLYQSNPNYLLYSRGNGCLQSQTNSGGCYLVGNEDLSPETSVNKEIGFEYDPGTWRASAAYFRNDYKNKIVASTDYAYRLPNGARVLQWTNSGKAVVEGLEGNLFIPLTPALDWNTNFTYMIQSKDKSTGEPLSVIPEYTINSTLDWFYTPQWSFQANLTYYGKQKGPSTNPRTGEDLQGEGLQTISPYALVGLSVGYEPNKNLRFRVGVSNLFDKKLYREGNSSDAGAATYNEPGRAYYATMTVAY

SEQ ID NO: 589 - protein, 680 aa, Escherichia coli K12
MSQSSRCIKVSVLVVATAISSAFAENKNQIYGEKNSGERNTQIITVYATGNERDSFTLPMMSTVIKNNSALTETAGSATELLRHIPGISISGAGRTNGETISMRGYSSNGVLTLVDGIRQGTDTGHIDSIFVDPLLIKQVEVVRGPSALLYGSGALGGVVAYDTVDASDLLAKNEHGGVRVTALGNTAQQSQGFGITAFGQQDNFDGLLALSARDKGTTRYGGGYRAQNDETIINLLSKGRWFIDDSNTLSGQLRYYHNNAQQPKDPQLANNPTPANVATNRTTTQKDAQLTYQYHPSDMSWINLKTQAYYSEVDINAKTQQKGFEGREQKTYGIKIENRTQLATYPFAAHALTYGGEIYKQKQSPSANAESFPKADIRFMSGWLQDEMTLRDVPISFIVGTRFDKYSSQNDRYDDISADKWSSKGAVSITPTDWLMLYTSYAQAFRAPTIGEMYNDAKHFDAPFPGAPTNYWRPNPNLKPETNSTTEYGFGFQFDDLLSNNDNLKIKAAHFNTRAKDYIDTDVAIFQGYTQSTNIPRATIWGWDIEMNYQSKFFSWDLAYNHTKGKDNASNASITSIEPDTLTSRLDIPVPNSDFSVGWVGQFTKKTDFTKHDRFNRPTNRQQAGYGVNDFYLRYEGSASLTGLTTSLVLGNAFDKKYYSSAGIPQEGRNAKVLVSYQW

SEQ ID NO: 590 - protein, 422 aa, Escherichia coli str. K-12
MKNAPKPSLQARPHTLVLPLILAGALPTAQAELLEDAKGTLTLRNFYIHRNFVDDRATRSKAEEWTQSFILDLQSGYTEGPVGFGIDILGLRSVKLDGGKGTGGTQLLPVGKDGKPADDFGRLAVAGKLRFSKTEAKLGEWSPALPILRSDDGRSLPQTFQGGMFTSKEVRNLTLYGGRFRGNSPRDDSSLEDMSWVGNASVTSDRFSFAGAEYAFNDNRTQIGAWFGQLEDIYKQRYFQVLHSQPLGKDWTLGANLGYFDGEEDGSAQAGDLDNSLLTGMFSLKHGAHIFYLGLQRVGGDDRWLRVNGTSGGTAANDSYNGSFDNPRERSWQVRYDYDFAPLGMPGLTLMTRYIKGHNVHAGGIDDGEEWNRETQLSYVVQSGPAKNLALRWRNSTVRRDWGADNKFDDNRLIVQYPLSLF

SEQ ID NO: 591 - protein, 852 aa, Escherichia coli str. K-12
MSENSRCPQIYWYICITSCVVGAGMLLPSHTAQAQAVSQAPDQATFTSKSNRHINKPNPASPSARNVVKQAEAITVSGTATPGNSALSISTREHSTVQVFRYSAEQLRETGQTSIYAAIAQLSPAVTSTPFAGIGGNGLNKSMQLRNLGADQTLMLVNGKRRHVDANFNYYQSGQNYGTDPADLSLIPMSAIDHVEIITEGASALYGQDAEAGAVNIVLKQDTHGGTFDLQNSGYYPGDGQTVDGNVDYGMALGRNGGYLNVAAQITNQLRTNRSGPYLGSLYLDPSDPRAAALGRNVQNLSGSPQSLLETVSLNAAYPVAKNFEFYNTSTFAHKDIQEAQTYRAASNDLIIRSFYPNGTQPYLIGTENDFQVNDGIRSSNFLGMEWDIYANYGRDQMANEIRDTDNPTYGLASPRSFSTARFISDELAAGFKSTKFFHTSLLPRPINFSYGFEYRRDSFHIGAGEPASYTDGGATVLDGPDAGHVVAAGAVDKFGVPPLAAGTQVRNVFDGSVNLDFFATRKWEWTLGGHAVGYSDVGAAATGSIGTRYNFTKNFALRANANTGFRPPTLAEEAFFSETTFPTYRTAQLPVNSPWARALGASKLKGEQSRSFSVGADVTLLPNWTLTANLYRISINDRLYNSSLFGGTNIESILAGVGLPNVLYASYYSNPVNTATNGGDISTSYTLHTTSGTFLFSFSVNIADTEITHHNATPGILTALGQTSFNRTNEEFLLHSAPKNIENLSVSWNKGPYSFRVQEQRFGSYTWVASPSLVQTQWTYAGPSYITNLELGYDVFKRWHIAVGAYNAGNHYPTRANAASRAALQNAFIYAGNSPYGFNGGMYYVKTSLKF

SEQ ID NO: 592 - protein, 865 aa, Escherichia coli str. K-12
MRNHLKHFLLLAVLTICFTATAVAQGTVKGKVVDAENNEPLIGATVSVSGTTLGTVTDMDGNFVLKLTSSKATLIFKYLGYNEITHQVKGSNTIDLGEVKMSPDAIGLGEVSVIASIIKSDRQTPIPISNVKLAKIEEKIGNLEFPELLKSVPSVYVTRESGGYGDSRINMRGFDSSNLGVLINGVPINGMENGKVYWSNWSGLSDVSQFIQVQRGLGASALGISSVGGTMNMVTKSTEAQKGGSAYFGIGNDGFRKYSVSFSTGLMDNGWAITFMGSLNTGDGYVKGTNYEGWTYFGNISKVINDHHKLSLTAFGAPQWHNQRSTMHYIEDYKNSPDGGRFNNGYGYINGELIGGGYGYNYYHKPQVSLNHYWTIDEKSTLTTSLYGSMATGGGRRARGAMSNWLTIDNNTGRPKDGAMMTPDGLFDYERAMAANAASQNGSQVIFTNAVNDHDWYGMLSSYKNHLTENLTLTGGIDLRYYKGYHTEEIDDLLGGEFYLQTSPLAFQTKNQLLKVGDKFNYYSIGEIFWGGVFAQAEYNTDKWSGFLSASLTEEAYRYDDRGGTDSRYSATGADKLDRVSSLQNFLPWSVKGGFNYKFNDNHNVFVNAGYFTRAPFFNSVFASNTAAPEKDVPYEKITTFELGYGFSTEQVNIALNGYYTQWMDKSLRRKIGQEYANLTGLDAVHMGVELEATYRPVKSFELKGMFSLGDWKWKDDIHFTMYDEANNPIGTYDAYLKDVHVGNSAQLTSALSASWEPFKGFKISADYNFFGKNYADFDPQNRVNEADAGIDSWKLPDYGTIDLGMNYRFNITKDIRAIVYSNVYNLTNTEYIADAKDGTNHDWKTALVYYGFGTTWSAGFKVIF

SEQ ID NO: 593 - protein, 745 aa, Escherichia coli K12
MVGVGNKAHSGRAGRFVLATLSGVIAQASQVAAIPTATQSEQTIPRLADLEPMQTGAQGLFESPVAQAEPGTQKPPTSPEDLDEVTVTGTRSYRRSRSSTATKTDTAILDVPQSIQVIPRQVLEDQRIVRAGDALQNVSGIVNLGSYSGYSDSLLIRGFEAAGFDGSFFRDGVPYFQFDYVETADLERIEVLKGPASVLFGQGQPGGIVNLVSKQPQAKPYYSAALTAGSYSDYRGQLDLSGPLNAGGTLQYRLNAFYQNARSFRDFVRNDRSVLTPALTWQISPQTALRFDSYFINEARTMDDGIPVIGRSVANVPIGRFLHEPFSNYRKDEYGLGYSLDHRFSENWSLRHTARYQNVSPERYYPFSLELNEQTGELSRLAYWAAGNYNRIFANADVVGRFNTGSIAHRLLFGVEYRRGRESPIFKTSELYPSINIFNPVYIDQAYAKTPDFFRDDDATTLAAYIQDQIDLLPNLKLLAGVRFDTYRQSRSENDLNQPRSVFVQTDGAWSPRVGLVWQPAPEVSLYGSYTRSFVPQFGTFRNFNGAAFRPETGTQWEVGVKTELFDKKLSLTLAAYDLRKQNVVTADPTNPLVSIQTGEQTSRGIEFDASGEILPGWNVIASYSLIDAVVSADNSLPVGNTLANVPANTASFWSRYNLQGGDLKGLGFGLGLFYVDSRPGDLLGSFTLDSYVRTDAALYYRPGNWQAALNFRNLFDVRYYTGGFRTGVQPGAPFTVLGTLSMEL

SEQ ID NO: 594 - protein, 1016 aa, Escherichia coli str. K-12
MNPLFRISPLAFAITLALLPEAHAVDYVLTNGQDTFSSDRVIDGAIDVNSTDGNTSTLTINSGATVTSEGGRIVGQASRTGVNMAQANVVVEGAGSRWVVPRTSFVLGNTIVVGGVGQGDLTVRNGGQVSVRDLDLGDVSGARSNAFSNATLSVSGQNSLVDAVNIEAGGVFVYRSSITANEGARINSQQVDIDSVVRLSGAGTRWDNSGSFRNRNDLTLENGAVLTSNELRLGSAVVNRSNQVNVTGQGTRLDAQTLTLGTSIVRTYLTLADGAELSATNGMLISLVNDSNTATRGTLAIGGSVAVDPDRTDVDSMTAGAAQAAGRLNPQTAVSFGTGNGSLAFNHTDPDLQFANTLNGTGRVYAFSGNTTLSGDTSGLAGSVVVRGGRLVLSGNVDQVNQRGNTATTQSVSRFNVGNGTLVVNGIAGRTEFGTYTNSAQVLDGGILAGVGQVGTTQVSAGGTLSPGENAIGALAIQGDLDMAAGSRYAADIAGDGRADKINVSGTATLRGTQVNVTALDPAQSYQSGRTYTLLSAQGGLVDGAAAGTAYAQALTNSAFLNVGLQRTANDLNLTIEQKSVEPTPTPTPTPTPTPTPTPTPEPTPTPTPTPTPTPEPVPTPTPTPTPEPAPTPAPEPAPAPGIFQTVMLTQNQFNTAGALSVLAQSGEPLRLYNNLLVLDAEGARDAADQLSGDYHSSTSTALIANSQVVSGVLGTRLRNLLDTGTLRMPAMALNLMPSAPTTQNGAWVQPFGNWTKVDGNNGAGGLQQSTGGLLFGADGSFTPDWRGGVYAGYSRSKFDADNRDADGHSDNYHLGLYTGAQIDALRLSADVGYTWHKLESERNVAFAGFSDHLTGKRNAQSLQASGEAAYRIPIGRVALEPFAGLSYVRYDAKDMHEKGGPAALDVSSDKQDTFFSTLGLRASSNIDVANINTQVYGSLGWRRAYGDLDPRNIQSFAGGPNFEVQGVAQARNTALTEVGAKLRLNQRTDLDLSYQGQFGTDTRFHSVNAGVTVRF

SEQ ID NO: 595 - protein, 1006 aa, Escherichia coli K12
MNVFETLSKGVSSAAICACIATLPGNLHAQTEEAYRLEFDASWYLSAINAEAAYKRGYDGRGILVAVVDSGLDIHHPEFFGRISPLSYSFLDIDPLNVFDPDGHGTHVAGIIGAARNGIGNMGVAYGAELMALKAIGDAEPGSEKGPFVSPDNNALFYAASNGAKVINGSYGPPAFPSPDLDDENENPNYRVMPRPIVQSMEGTDYREDAVAVSAAANADVVLVFAAGNEFEEQPDQAANPTGIGFLPLITAENLRAGVFDILIDATDIDDPDTYDYADPLDPEFDDLDLSDLAGSLIAVVATGRDGTIAGYSNRCGLAWQWCLAAPGGDSPKPGQTIEYSAIISTLPGGNYGPKAGTSMASPVVAGGAAVLRQAFPYMTARQIIELILTTARPIGPQEIYGRGMFDLGRAVLGPKYFGDPLFGPTFDVNTRGYNSVWEGDISGPGGLIKRGAGNLILLGVNTYSGGTRVFGGELTLLGSLGSDVEVLTGATLRGDRSMIAGDLTTSGTLAPGIADGYVGEMLVNGDVSLSAASTYRIDVAGDLADQLNVMDMPQLREDPDTQKGSVTLESGTIDIRLKDGLAPLVPLDIITAQNGVSGTFGSITTNSISPFLDPYLFYGDAVTLSFVPNGTTLASAATSPNQSAVANALDHAPYATAWKHVSRQSLDGARKAFDQLSGEIYATQKTAIVEGSRNVRDAANDRLRSATGGAGALSLPILAYGPDGTEASPSNSERFTVWSAAYGGWGHLDADGNAAALESGSGGFLMGGDLPVGDGWRVGMLTGMGWGDYSVDDRSSTTDMKGYHLGLYGGGVLNALGLRAGLAYSWLNLETWRKIDFPGLKEQLNAEYHGGLFQAFGEVSWKVDKEEFKFEPFVNLAHVTLRTGAFSEGGTVGLSSQRETFNTTSATTGLRASMELEKLPVPAKLNASVGWRHALGGKSPTSELKLDGVPSFTTTGLPRVRNEAVLGVRLDLGVAERATMSVSYNGSFSADARTNTFDARLKIRF

SEQ ID NO: 596 - protein, 675 aa, Escherichia coli str. K-12
MINCRKVKKRYSPARCFWHAVLAGCLLATSAAAADDRANGVFVLGEVEVVGNEEQSAASVLTERVTEEELRGFNRDDVAEALDLLPGVHMSKTGARNESTVYVRGFDLRHVPLYLDGIPMYVPYDGYPDLRRFTTFDLSQIVLSKGFASVLYGPNTMGGAINLISKRPEKAFEGNCGAGYASGDSYQAYLNLGTNQGWWYLQTGASWYNIDHFRLSDDFRETAAEDGGQRENSYQRDRKINIKLGLTPHGDDEYAFSYIYQHGVKGTPPYTGSDSSTRVRYWRWPYWEKESYYFNSRTALGEASYVKTRLYYDRYMNSLFSYDDAEYDTITRPYAFRSNYDDHTYGGSLEVGTDLLPRNRLKLAFHYKRDVHKEHNWPDPYQRFEDEIYSVGAEDTVTLTDRLQMVVGLSYDAIKTLDAQDLISGEPVDFPKDESDAWNPQIGLFYELSDTATLYATVAHKTRLATIKDKYSYRLGTAIPNPDLKPEKAINYQIGYRDRLWDRFSLSAALFYSDIEDFILQATVQDPDDPTATTKQNQNVGKVEQYGLELGLSGDLTETVEAGINYTLMERNNRSSGDKLTNTPNHKLFTYVRYRPLSWLSLQADLDYSSNSYSSSDGVRIAGEFVVVNTKAVFEPLPGLTVEAGINNLFDTNYAYDEGFPEAGINYFGNVAYRF

SEQ ID NO: 597 - protein, 121 aa, Escherichia coli K12
MGYKVGNTRVAGDYTHHGKVDGTKIQGLGASVLYDFDTNSKVQPYVGARVATNQFKYTNRAEQKFKSSSDIKLGYGVVAGAKYKLDGNWYANGGVEYNRLGNFDSTKVNNYGAKVGVGYGF

SEQ ID NO: 598 - protein, 783 aa, Escherichia coli str. K-12
MKIKTILTPVTCALLISFSAHAANADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKGDKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQ

SEQ ID NO: 599 - protein, 878 aa, Escherichia coli str. K-12
  misc_feature (647)..(647): Xaa can be any naturally occurring amino acid
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNXSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 600 - protein, 256 aa, Escherichia coli str. K-12
MRNKNIKKLALALSLSLAGTGSAFADQDNGFIFDYGSIKVGYANWDMGLEDVGRGDLLKIFADYGAIHKGYEYYGFLEYNRFDHPDDTRNQVFTANTHIRLFDSNFTAFGKFYAQYENNPKFSDDVSTILGMGYLGYSSKAGFFKPFVGAHIMSGDVKSTSTGESSNGMNGVMVGWVGAYHLSPQFSLTNWNEFEIARNDAYAEQQHGDFGINGGLTLSYKPTKHFVADVTYRYFYNKLAVEGYGDQIIFMAGYKF

SEQ ID NO: 601 - protein, 260 aa, Escherichia coli str. K-12
MSAGFAAAEVTVSGDARMGLVYDDTAVNKITNSSRVRIAFTASGETDGGLTWGATVRNSQTAAVGDVSLGGAFGTIKMGSPTGADSVANVLADVGYTGIGIDNQVEGNSASSIGGHNVSYSTSVSGFSFGISGDMNNSDVAVGIGYSMDGMSIGLGYDAQGNDSTMTLGVSYAMDAVTVAAMYSQDEVAGVTTNAYGISMAYDTGSGTVTVAMSDSGAAVDSQAFGIGYSMGLGGGATLAVGAGKVGAATRAQAGISFSF

SEQ ID NO: 602 - protein, 734 aa, Escherichia coli K12
MMMKTSLWVLNPVLLAMAMPLYAEQNTEENLVVSANRSHRTVAEMAQTTWIIEGQEIEQQVQGGKEFKDILGQLIPGMDVSSQGRTNYGMNMRGRAIVVLVDGVRLNSSRTDSRQLDAIDPFNVDHIEVISGSTSLYGGGSTGGLINIVTKKGQPESQVDLELGGKTGFNNSNDRDERVATAVSGGNDHAFGRLSVAWQRFGGWYDGNGDALTFDNTQTGLQHSDRLDVMGTGTIEIDETRQLQVVTQYYKSQGDDDYGLNLGKNMGAVTGSGTASTQSGFNSDRVPGTERHLISLQYSDTDFWGQELVGQIYYRDESLRFYPFPTLDAQTKAVTSFAASEQNTDQYGAKLTLNSTPLDGWQMTWGLDADHETFDSNQMFFDLAQSVPSGGMNNHAIYSTGRYPGYSITNIAPFLQNSIDLSDVFTLSGGVRYQWTENRVDDFIGYTQQQAIANGKARSAEAIPGGKTDYDNLLFNAGILAHLTENQQAWFNFSQGVELPDPGKYYGNGSYARADAQGHLALVKSVNPQDAKLEGIKVNSYELGWRYTGNNLRTQIAAYYSLSDKSVDINRRDMTIDVNQQERRIYGVEGAVDYFIPDSAWSLGGNFNVLKSEIKTNGSWEKWDVTQASPSKATAYVGWSPEPWSLRLQTQQTFDLTDAAGNKIDGYNTVDFLSSYALPVGKLSFSIENLLDKTYTTVWGQRAPLLYSPTYGSAALYEYKGRGRTFGLNYALTF

SEQ ID NO: 603 - protein, 386 aa, Escherichia coli str. K-12
MNTIRALPIASLALIGVASTAYAQSSVSLYGLIDTSITYINHANASGNSQLGVGSGNLLGSRWGLTGTEDLGGGLKAIFTIENGFNPNTGALGQDGRMFGRQSFVGLASARLGSITIGRQYDALVDVSWPITASYSFGSVYATPGDVDNYDTSSRTSNAIKYTSPTLAGFTFVGMYALGGVAGKTGAGQTWSAGLSYGNGPLSLAGGYFHAENPAASGKTRDTWGGTSDGTFDGSLVNGAYASAKSIDIARATVQYASGPLTVGVDYSNARYKPDAFSTFRTTQRYDTGRGFVNYRATQALLVGVGYSYTKARGDASAAYHQVSAGADYVLSKRTDLYLVGAWQRASGTQRTLDGGTQRAQASIGSYGYGGTDTQSIVNIGMRHRF

SEQ ID NO: 604 - protein, 372 aa, Escherichia coli str. K-12
MKVWTMALGGLALGAGAAAAGDIERSQQSVGILFEEGRYAEFTFGAVNPDVSGSVGGLGSGNMAGNFNTWSLGYKQPLGANMDLALILDQPIGADVDYPDEGLYPLAGTTAELRSNAITALLRYKFQNNVSLYGGLRAQSVEGKAHILFDIYQSGTFVATTDYNLETNRDWSLGYVLGVAWEKPEIAARVALTYNSAIDHTLEGDESGTNAVFGNFSGKSDFDTTVPQSVNLEFQTGIAEDTLLFGSVRWVDWTEFLIDPEIYQYYFPGIPLVAYESDRWTYTLGVGRRFNEHWSGAVTVSYEPQTGDDTGNLGPNDGFRSIGIGATYSHENMKITGGIRYVELGNATTRGVGAEFDDNNAVAAGIRVGFTF

SEQ ID NO: 605 - protein, 794 aa, Escherichia coli str. K-12
MTMTNSRRVRLLSGAAAALLGGFAGTAAAAQAEGGSIDVSEVVVTATKQAVRLDKVPLSVSAYTPEAIEKRGIRDIRDVALQTPGVDIPNDGGGRSVQRVSIRGIESTAGAATAAVYIDDTPIQARNASINYSGSTIPYIFDLERIEVLRGPQGTLFGASSQGGAIRFITPTPSVTRYTAMARARASVVEDGDASYELGVAAGGPIVEDRLGFRASFLYRDEGGWIDRQDWQDPTERHSNVNSTESTVFRAALNFKPVDWMSIQPSLFYQNVKQNDRSPLYSACPDSLPLAPGFDPCPRGVADPDDGKFLSYSTIAQPGSDKFYLPSLKMVADKGPVTFTSVTSYLYRHVIQLNDATYNNDRVSLGNNWLFPVIPGRELQTYQNPDTEQRLFTQELRLASADPSARVRWTAGVYYSRSSLKSDLPITSAHYPDAYAIRFGRPLAATPFMVDGIHRYYGNENTIEKTLAAFGNVDVTLLEGLTLSVGARYSRDTIDFDIVERGVSYAGGISTAAGTLKEKPFTPRVALSWQQSEDTLVYGSYARGYRAGGVNKAVPDICEADLATLGIDGGNTYDSDKTDTYELGVKSALFERRVTFQASVFRTKWKDIQQQIRLPCAFSLVANTASAVSQGGDLSVSFRATDNLTLTAAVGYTDAEYEKTIIVGTSPLVFEGQSLGATPWTVNLAADYSFMAFGRDAFARAQYTSKSAEDGPYPYQNPMSSLYDPTRGGGYGTSQLDLRVGVDVTPLVTVEAYVENALNEVSYLSNAPTYIRGPLWLATAAKPRVIGIQATARY

SEQ ID NO: 606 - protein, 237 aa, Escherichia coli str. K-12
MSELSDSTQFGLTAQTGTEFELKGDAEISGFPKQQTPGVFVPITMKEAASVPLAIPESITVGARHQLNNSVTVLAGATYARWSRFEGLDVFSTEGDGGQISQALGRTGDKPLSHVTEKWQNTWQFNVGGIWQATPAWAFKAGYAWDESPVGEFVTARVPSSDRHWLTLGTQWKDAQSGWTVDAAVGTLLFTDDPKINEFVYQYDSPSQKDPAARDLNYKGEYELDAWSASVQVSKAF

SEQ ID NO: 607 - protein, 730 aa, Escherichia coli K12
MSIVIRSHRHAVRFGASLSVLALLGPAFGANAKEAAPLDAKADTEISEVLVLGRGAQRLRIAGSSHVVNEADLERSRVLTVNEALRQVPGVYARDEEGLGLRPNIGIRGLAPTRSTKILQLEDGLPLSYAPYTDNASYSMPPFRRFVRIETLKSASQIRFGPNTVGGVINFITPSAPETFGGDLFMAAGGRGYQELDLKIGGPVLGELAAIGHANRTRSNGVRDNTALEIQDLWGKLEGRLSAHHAIALRVGHATEDSQVTYSGLTAAEYAADPRQNPFANDHFKIKRATAAITHGWTLSESLNLKTSAYSLWFDRDWWRQSSNSGQRPNDASDPACGGMANLNTTCGNEGRLREYNTYGLDTRLTWTGALVGAQAVIEAGARHQWERQNRLQLNGDRPTARTAGTSVNGGVRENNLRYGEASAGFVSLSLTWDRLTVNPGLRVEQIDYRRVNRLNGTTGETDLSEVIPGLGFAWAVKPGAYLYGGVHRGFAPPRAEDIVSGTGGVVDIEAEESVNSEIGYRSAVRPGLFVDINAFRMDFENQVIPASVAGGVGATLTNGGKTRHQGVELSLKGSLREMGMIRGDDVFFRSALTWLPDAAFVGTRRSSVSGFGGVSVSGNRLPYAPRWLASAAIGYSFGVHTDVQLEVQHTGKMFTDDLNTVAQTADGQRGLIKSATVWNASLNTRPFGDRTTLFLAVKNIGDKLYIADRSRGILPGAPRLAQIGLSQRF

SEQ ID NO: 608 - protein, 829 aa, Escherichia coli K12
MEFGFGVGASNAINNDRVTKRARRLLPTLISTTMLGSASLFAATAATAQQAQPPAAQLVTLAIPAQPLASAIAAFIRTTGWEVGYSSQIVGGKTSSAVSGVMPPQRALQTLLAGTGLRVRATGPTTVALVDPRMTAIDAIAGDGVIAIDTINVDGQSAFEHVDGYVAQNASTGMKGDIPILQTPQAISVVTSDQIKDQGAQSINEALRYTAGVRTEASGSQALDNPLYVRGFLQSSLDTYQDGLRSVTPGYFGFFATDPYGLERVEVLKGPTSVLFGQQTPGGLINAVSKRPTANPVNEIELTYGSFNHAQTAFDIGGASPDKSLLYRFVGLGRNADTQVDYVKNDRVYFAPSVTWLPNPDTNLTVLTSYQRNEGDFYAQVPAAAVLLPNRYGHIPFSRFLGEPSWEGETSERTALGYELEHRFNETVKFEQNFRYTHMTNHRQYLQASGALVNERTLNRRYTLRDIDSDAVTVDNRLRFNFDTGPIEHKAIVGLDYLWGTSHWLEQSGAAASIDIFNPVYGAVVNTNAYTSRSLQDITASQAGLYLQDQLKLDKWLLTLGVRQDWAWRDTDNLIANSSRSQDDGDFTKRAGLTYLSKFGLAPYISYAESFTPVVGTDRLGNSYLPETGQQYEVGVKYQPTGYNSFVTLSAFDLRRQNVQTIDPVNTNYSVQTGEVRVQGVEIEAVASLDSGWSLTAAYTYTDAEITKTNTAGQIGNTPYRVPAHSASLWLNYEFQTAALAGFAVGGGVRYIGETWGDDANSFRVPEFTLVDAALRYDLGKKFLAMKGFTASVNVTNLFDKYYVPACFTVNACNYGSSRTIMGKLAYRW

SEQ ID NO: 609 - protein, 661 aa, Escherichia coli K12
  misc_feature (335)..(335): Xaa can be any naturally occurring amino acid
MHNFPRHTQLLLLAGLCALPVCGAVAADAQEPTLQSVTVTATRREESLQKVPVAVSVLEGEQLERDNRNGVVSIAQQVPSLNFRTGASNKDTSLFVRGVGTISTSPGVEPTVATVIDGVVYARPGQATLDLLDLERIEVLRGPQGTLFGKNASAGVLNITSKAPTAQTHGFIDQSFYSGNESRTRFGIGGSLVPEVLKGSISTLFGSYDGNVDNRHNGQEVNGYNHKGIRGKLEFTPNDDVTLTLIADYMQSHDDAPNGVVSKSLSPAFSNALRPVRASSDNRDINTDTRSHVEDINKGLSAQLDWNLGDYTLTSITAWRGWDNTQYQDGDRLGXYTLTSITAWRGWDNTQYQDGDRLGTVTAAFPGTADKGDLAFDQYSQELRLASPKGEFLEYVGGLFYMHGKDEETYQRTLTTTARVDRGIADYSTTSDSYAAFGETTLNFTSRFRGIAGLRYTHDDLKYDHRRVSTSPTTVSGIQPATSSSGSVDEDGWSGRLGVQYDLSDNITSYLTYSRGYKGPAYNVFFNMQPRDTDALKPETSNTWEAGIKATAWNNRLTTNLAVFHSDYDNYQANFFDTVAGQVVTRLINAGSVSTEGVELDTRASHPATQALRCPGLHPGAHRSVRVPARRSGDLQRQWQATTVQPRLEKLRARRLQHPLG

SEQ ID NO: 610 - protein, 823 aa, Escherichia coli str. K-12
MPKLFTGVFIILFFQVSQVVFGQSSISGFIHDELTQVPLEFASVAVYQLSDSSLINGGITDEEGAFLISELDAGDYLLKITYIGYGSKTISDLHLGDKESKNLGVLSISPDQTTLEGVEIQGQKLSTEFQLQKQSYSAESFQAAQGGNAADILKNLPGVAINVDGQISIRGTSGFVVMINGKPVQSDPMMILSQLPANSIEKIDWISSPSAQYDSEGKAGMINVITKSGTTDGLYMQFNTKLGMPPIENYGNAERAKRYGADFNLNYLKGKWDISVGASFQRNDIAGRRVGNVMTMSGDTTTFFPSEGERSIDEKNYSGRFTIGYNPSERSAFSLGFYGAVRDKLRTADILYYDNHAIANGQELYNFQYFNANDQSRRGDVVLGSLDYSHIFENESKISTSFLYEYSMLGGPTSNLNLGYPDLSTVYQEEYNTNDNPLNGIRYNLDYTFKPYSFGQLLAGYQFRKLDHKGDFLYERKNNETGEFELVPEFSSNVELKRNIHAAYLQLDKEFEKFNYGIGLRVESMDRSFDLEDKAGIVDTVYQYDFIRPFFSANLGYQVNEELQLKASFSQRVERTTTFKMNPFPEREHSETLEQGDPNLLPEFINQVELGVIKTWDASSFYATAYHSRVKNLVNRVNTVYNDTILNRIYSNVGTGKSTGIDMGLEIFPTSWWKVFGGLNLYHYSIKGSFDDRPVNTESWVHSININTTFTLQKNWSIQGTLNYLSERVTALGEDSRFYTPSIVVKKSWMDGRLAANLVWQNIDMGILDTNEQRITTYRDGEFYTTTNYIQEVDMIILNLSYTLNRSKNKAKFVKSEFGEKEF

SEQ ID NO: 611 - protein, 824 aa, Escherichia coli str. K-12
MKPVSNLPTLSIAALLAASSSTAFGQAGSTPASDEIYELEGITVTPLEEFSNRAIYGETPVAFSELSKDDLDRYLASQEIPMALNYTPSVYSTNQGGGAGDARINIRGFDQRNVAVMINGVPVNDMENGWVYWSNWDGIGDIASSVQVQRGISNLDLAVPSIGGTLNIMTDPAAKDKGGMVKQEFGSDGFSKTTVIGHTGLINDKFAASAAIARKMSGGYVDGVWADAWSWYLGASYKLNEANTIEFYGFGAPQRHGQNLYARNIGTYSESFALGLSDYDPAALDRYYERGYAYNETWNYVDASYSEPQADHHGIGPRRFEGYINERENFYDKPQVSANWYFRPEDSQWSWDNVLYYSGGEGGGTGTYGSVSRVSDSGGYFHRNRDWDAEIAQNRANLDSTGRAESTGILRNSRNNQYTIGLISKATYEASENWSTSFGVDWRTAEIQHFREVRDLLGGDYYLYNGQQKTLGGVIAYNNTNTVDWLGGFWQAAYEKDQFSGFGMIGLSQISYSFKDYFKELSPGRYYEIDSDTFDGMQIKLGGRYDINETTSMYANFGYVEKVPIFDTVIDDGSGQAYVNPPNEVFVNVEVGVNYTNEDGTFLLGANFYNTDWSDRAFGEYVSLFDAYVNLSGVDQRHRGFEFEGTYYFNKQLKLDATLALNNWKYTNDVTAKYDPDNDPATAIDFDLYIAGIKVGDAPQTQFTTSLTYMPQTGMNFTARMRHNQDNYAGFDPLGRTDPTDRTQSWKAPDHTVFDLHANWAIQSNTDIQYELFASVLNVFDEKYIQDAIDNDSFNSFDGDHDADDAAVHFGAPRRINAGVRLTF

SEQ ID NO: 612 - protein, 427 aa, Escherichia coli str. K-12
MKQSPFQLHAISCALTTLCFGMIGQANAAGFALNEQNASGAGVAYAGKAAIGEDASAAWFNPASMSGLKERQVVLGGHYIDLNSEFNNEGTTTPAAMPGNPGRNVGDFGAEGYIPNFHLVVPFNSKINLGLSVATPFGLKTDYQADWIGRFQGITSDIKSLNINPSVSYKVNDQWSVGAGVSAQKLDAKLSASTVLGLNTESLTTIAGDGWGYGFNLGVMGQVTQATRVGIAYRSAIEQDLEGNVTFSGPAAATQNSNLVSKIRLPSSLSISSVSELNSKWQLLADATWTEWSTIQKLQFDRVNAGGAAAPIPVQDYEWKNSWRFAVGGIYKYSDTINLKAGVAYDITPVPDERRKVRLPDEDRITFAVGSQYKLDKATTFDVAFQYVMPDKAKIDSTEGTGGAQSRVLGTAEGDAFILSGQVSYKF

SEQ ID NO: 613 - protein, 440 aa, Escherichia coli K12
MLSLLAGVSPADASSESLSTSENAASLSQLQSAPVVTSSDSALTVATKPDQAVPQLAVPQLAAPAATAPTTGTLTPAPITIAEVPPASTSATQLAAADSMDQVTSVSQLSDVRPTDWAFQALQSLVEKYGCIAGYPDGTFRGNRAATRYELAAALNACLDVISDRFATKEDLAAVRKLQEEFAAELATLRGRVDGLEARTAKLEAQQFSTTTKLQGLAVMSFQAGAYSGGKDNFLGVFPKFKEQLINSQNGNLIDGDELNPTVIAATLLSLNTSFTGSDLLQTTLAAGNGGQDAIGTANLGTTPSLPGNTQYFNPSQYYWSGFGTNFFLYRLSYTFKPFKDVTITAGPQFYPSDIIDFNSFANAPASDFGSWFFINNPFIIPYALNFFGGAGAAVQWNPGQGPFTVKALYMAACAGIASRDACGNGIRGGFAGDPYQGEP

SEQ ID NO: 614 - protein, 215 aa, Escherichia coli K12
MMNKTTVSTLIAATLLAAGFSASVSAHQAGDIIVRAGAVVVAPSESSDPVATFGEFQISNNTQLGLNFGYMLTDNFGVELLAATPFSHDVSLKGVGKIAETKHLPPTLVAQYYFGDAQSKLRPYVGVGVNYTNFFDNEFTNDLDGALTDLSMSTSWGLAAQVGLDYQVNKNWLVNASVWYAQISSDVKFKLAGDTVVIDTDINPWVYMVSVGYTF

SEQ ID NO: 615 - protein, 254 aa, Escherichia coli str. K-12
MKLVFHPNFKAGFEMKNFFAVCIASLLVTHVVTASAKEGAYITGKAGASVVNLYGINSTLIDDDVVVNGQPKLPDRTKGVFGGGVAIGYDFNDQFQLPVRLELDTTFRGETDAKGGQDFTAFDDTVHMNVKNQVRMSTYMVNGYYDFHNSTAFTPYISAGIGLARVKLKNNTMSEDFDINETLAASKNNFAWGAGIGAKYAVTDNIAIDASYKYINAGKVSISKNNYAGDEYTSYYADTKAASNDFMIGITYAF

SEQ ID NO: 616 - protein, 671 aa, Escherichia coli K12
MESIKVTARRGEEQAKDVPFSISVIDGDTLDAKGDPDLETAVRDTTGVNVSSSGPYDANVLIRGVGSLNQISQEDGSVVLNVDGVAMSARQLSLATLDMERVEVLKGPQGTQFGRNSEAGAINVISRKPTPYLEGYLRGRYGQFRQYGLQGQSQQYRLEGALSGPITESLSARFALRQSQEDHWVENVNDGEPISEPRLLSYRGSLLWNAGENTTALLIAERQRIRSGAAVQALHPFGNPTEIDITPGLFDDNRNTVERYSANIHHDFATSRLTSITALLRTDALLVTGFGRRINEALFGMPMEFMREDDFGQRVVSEELRWSSLPGASNFWVIGLYTSRSKRDFDSVVETTGTQQNRDFETRSSALYGEATYPLTDTLDWTFGVRHTWDRKTYEADYFNGAWQHDDRRLDDDYTTGRTGLSFALTPTLNLYGTLARGYKSGLFSDYTTQVEDSKPTEAAVVDNVEVGFKLETSQRKYALNGAAFLSRVKDDHLLGFDAATQAIRAINADTRSWGAELQGTANLNRHLALSGSVSYINAQITSDAIGVQGGDVRSGNRVPNAARWSGDLALSYQRNLPEMLGLELPMLKARLGYHHVGARPADPQNHFNLDHYDLVDIRVALLTGSTELYLYGNNLLDERYDLSGYQLAPGVRTGAPHRGRALGVGASYYF

SEQ ID NO: 617 - protein, 885 aa, Escherichia coli K12
MWFAPIFNQTAYIPKKTFIPMKNYTPKSYTMKNLLIIKLLVFGLILGFTSTQAQQKKPPVKKGQKRQMPAIGKVYGVVKDASTGKPVEFATVALVNMRTKKIVTGAIANDKGKFSISEVKLGMYQLKVNYIGYKVKTLGPIKLFPKKYRGDGIEQNMGEVSIASSTEKLGTVTVTAERETMEIKADRKVFNVEKNITSTGGTSLDALQNVPSVDVDQDGNVSLRGSANVTVFIDGKPSGLTGSGRQAALEQIPASSIKKIEVITNPSAKYDPDGMSGIINIVLKKNVLRGMNGFVNLNVGTNDKYSGSLRLGLRTGAVNAYVNYSGNLFNRFMNSTNVRETYNDARDTTTFLNQVGDGDMQFHSNLLKAGIDINLNEKNTLTFSGLYSIRGFGRDMITDQVNEQQVNGGNRTFLSRSLLNNELGSDGNNMDFNAGYKRYFNNPDKVLALDIRHSRSSSLFSSDLALAPRNEDGTPTGGNSALTINETDNKFNITTAQLDFELPVNKSVKLEMGLKTTIRNIFNGYSVLNDATGTGNYIPDLTQNNDFRYDEQVHAAYGIYNHELTKKLSFQVGLRVEQTMSDAVVENTDQSYKNEFLNMFPSGFVSYKISKQGTFTANYSRRINRPRTRALNPFIIRIDANNQFQGNPALLPEFINSYELSYTHTHKGITLNMTTYFRDIRGNIQRILLEDNVNNIITRSYDNLESGRNYGIEGAFNMRATKWWNFTLSGNFYKTEIDGSNLENELNNEAFSYQTKLLSNFKFSSKFNAQVTGRYRAPIVLAQGEMEEVYSIDAAINYKVLKGKGTLGLRVSDIFNTRRYGFLTNGTDFMQVGNFKPETRIAFLSFSYRFGKMSMDARKMRELRKKRRKRKKRRGNNVPNVDGIN

SEQ ID NO: 618 - protein, 772 aa, Escherichia coli K12
MDGRHRLMAGIAVILAPMPAMAAEEAEAEATAPIVVTAPGGAVDLDDAIRLTGEDIARAGRPDLLGALTRQIAGISLQDAQNNPWQPNLVYRGFIASPLQGQAQGLAVYLDGARFNQPFGDTVQFDLIPEAAIRRMSVLDASPVYGLNALGGAILLDTRTGASDPGLEASATGGRFGYAETSLSGGLQRGAFSAFGAFQYRSEHGWRDHSPSRLYNGYADLGFDIEGGGMHLKLIGADTDLTGNGVAPVELLAADRRAVFTWPDNSRSRYGRISLHPWVALSDRTRLEGTLYAQRLTLRTVNGDAADIEGCEDDDDAGLVCLETVGGGDDDEEAQARLIGADGRPVADVLGGEGYGVLNRGRTRTDAMGALFQIIDERPLGAGDNHFALGLSYDTSRTRFATATELGELTDERSVDGLGTIIVQPDGAIAPIGLVAHADYWGVFMQDRLPILPGLSAEIGLRYNHARIRLVDRIGTALNGRHSFDRINPGIELDYRVGPGLALRAGYAESNRAPTPAELSCADPAAPCSLTNFFVADPPLRQVVARTWEAGASGSGELGGVRLEWLLSGYRATNRDDIQYIASAIRGRAYFQNVGNTRRQGIEATLKARRGGLTATLGYAFTDAPYRTPLTLSSPANPAAGADGTIAVQRGDRLPGIPRHSATLAVDYAGRGWSLGGDMIVRSGQYLVGDEGNDNPRLGGYAVFNLRGSVDLIRGVTLFAELRNMFDRRYATFGTFSEVGEIELEEAPGASNPRAYGPGAPRRWYAGMRVRL

SEQ ID NO: 619 - protein, 885 aa, Escherichia coli K12
MAYGAASKRDTQFTTRYLRGFLLSTSAAIAVVCTAPQLAAQEIAATPQQSQAVRNFDIPSQPLASALALFNRQSGIQISQAAAGRTSNVTTRAVRGRMTPEQALAQLLDGTGVHYQFTANRAAVIGPAGDAGAPGSEEGATVLKRIVVTGKTGRNANSGAGFQGTPDWVYEEPASVSVVSRDAVQSRAARNANDVLDSVAGVTSNRSEAQNPGIAINVRGLQDQNRVTTMIDGARQDFQRAGHGASQRVYVDTAFLRSVEVEKGAVAGVGGAGSLGGAVNFRTVTADDIITPDRDRGVELNAETGTNAYYFNGSLIGAARFSEDFSVLGGISRKRVGDYDFGQNGKSPLLDLAVTTAVDDSFLFSRLETFGTLLKVEGSPSDDFTFDLSWLRNDSEAIQGGLVFGDLRDDPQNYLNNTVSSSFEWDPDSELIDLKGRLWYNRVVNDELRDYTPRLPITYAMTSFGGSLDNTSRFETALGDLSLNYGGEAYSDNGKTTTPPLVDDQGFDEAYGYKGLNPVGRRSMTSAFLNATLEHDDWLEVGAGLRYDRYRLKGFTEVGGRKPRYIVVPGVCGYFYDDGECAYYDEDPVYGGGEAVLERVDIDKSGGALLPSARIAVMPFEGIQPFVTYAHTYRPPSVMEALTSGGHPGDAIATYIPNPYLKPERGRTWELGINIARDGLFTAGDSLRLKTVYFDRTIQDYITLGNGYFATFDKNLFQHVNLDGDTTMNGVEIEASYDMGSAYVGASYTYLKTDYADTYSYSGPTASGTPLAASGNTPVPSVLFVPPENKFTLDAGIRLFERKLVLGGRATYVSDSKPTVGQLAGLFNTAGYKVFDIYGSYSFSDSAKLRLAINNVTDEQYAPALGAFYYPAPGRTATVSLNFKF

SEQ ID NO: 620 - protein, 421 aa, Escherichia coli K12
MPARCCAATATSRRRDRSHAPRHDGIARAPAGFPHRSSAWLCSGFVATDTAHAPSKTTSPVWRNEAMTTLRLRSPHRCRPPALAAAATLAALSGPAHAQSTLTLYGVADAGVQYLSRADGRHAAWRLQNYGILPSQLGIKGEEDLGGGWRARFQLEQGINLNDGTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSRGLSASAVLHRSHGTAQGGADRSAQRRDIGTFAARYAFASLPLTVHAGVQRLTGELDPARTIVWGGARYQASGRFGFAGGIYHTDSPTPQVGHPTLFIASTTCSLSKRTVAYLNLGYAKNSGRSAQTVYEYDPTPLAGASQFGAMLGMYHVF

SEQ ID NO: 621 - protein, 231 aa, Escherichia coli K12
MLSCLSPTLVCAEQPHGFIDYRHEYLDDTRTHADRVEFGTFFSNGIGLMGELRYNTDEGDKDKWDPSQFGNNGTGLSVVYRFKPLDDKKFWLEPMFWLDTTQYWSTYEYGLSAGYDFSKEWKVSGRFRYDMDKATDKSKGYGNDDRNNRRYDVWIDYRPQKTNFQYQLNLVYYNNGYLTWNDGHKNYTASFKVGYKMGSWIPYMSIADYKGVDKTSSNRQIRWRWGLTYTF

SEQ ID NO: 622 - protein, 370 aa, Escherichia coli K12
MMTLSRGAAVVTLMSLGCPAAHAQSSVTLYGVVDESVRYLTHANKAGDSSLGLGTGGMTQSRWGLKGVEDLGGGWSTFFKLENRIYINSGQSDPTLPFFNEAQIGVRSTSYGQVIFGRQYNVMIEGITVGGYGSNPWIPYDFSFQPEVTMTGGIWTSNQVQYQAKYNGLTFAAGYAFGGNAGNSYGSQIGAAAAYAPAGGPFTVGGAYEESKDSVNGASAKAWTFGGSYTWDKTRFSLGYIVNRADAGFSTFANGPFSAASLTALKYTDFSRRRMFMGGITQQIGNAWHVAANVWRTLQDGKTPAKDGSAWQYQLVADYNLSKRTDVYVEGDYSLYRGDLIGAQLQGVNAVGLAQKGSQIGLMAGLRHQF

SEQ ID NO: 623 - protein, 122 aa, Escherichia coli str. K-12
MEKNMKKRGAFLGLLLVSACASVFAANNETSKSVTFPKCEDLDAAGIAASVKRDYQQNRVARWADDQKIVGQADPVAWVSLQDIQGKDDKWSVPLTVRGKSADIHYQVSVDCKAGMAEYQRR

SEQ ID NO: 624 - protein, 288 aa, Escherichia coli str. K-12
MIKFLASLAAFTALTAAASAADLPRRAVPPPVFTPVPVFTWTGFYVGVNAGYGFDANSRNTTNYALRGGTLANSPDTNAVVSVNNRSSNNGFSGGAQIGYNWQLTPGSGIVVGFEADAQYVDFARRANGTLNYGLAGTPGFAFSAPRAYVATSGNGLDYFGTARGRLGYAFDRTLVYGTGGYAYGSGQDDQNFAGRNFRSSFRNGYAVGGGIEYALPTDSFLNFFRSSAVTLKVEGLYVNLDRQKNTASGVFIPNLLPPRGVAYLNGAAANTEFAVVRAGLNYKFGSY

SEQ ID NO: 625 - protein, 211 aa, Escherichia coli K12
MQAVFRRGRAIALAALCGTMLSAPALAHEEGDWLVKVGVTQVRPQSNNGSVLNGSVDLDVNNSTRPSFTVTYMATRNVGIELLGAWPFEHDIRGSGLGTIGKTKHLPPTLSLQWHFLPDSTVQPYVGVGLNYTHFFDTQARGALAGSNLKLKDSWGLAGQVGVDVKLSERWFLNADLRYIDISSKVKLDGERIGTARINPWVATVGVGYRF

SEQ ID NO: 626 - protein, 375 aa, Escherichia coli K12
MCFFWITALIDIFMKIIITREYIMKRKVLAMLVPALLVAGAANAAEIYNKNGNKVELYGKMVGERILTDRENGEKGDNSQDTSYARVGVKGETQINPELTGYGQFELDLEASNRHNPDQTRLAYAGLSYKDFGSFDYGRNVGVAYDAEAFTDMFVEWGGDSWAGTDLFMTNRTNGVATYRNTDFFGMVEGLNFALQYQGKNEGTGNYKANGDGHGLSATYTIDGFSFAGAYANSDRTDWQSGDGKGERAEVWALSTKYDANNVYAAVMYGESHNMNSDDGDVVNKTQNFEAVLQYQFDFGLRPSIGYSYSKALDVAGYKDSDRLNYIEIGTWYYFNKNMNVYTAYQINLLDKSDYVLAHGLNTDDQLAVGIVYQF

SEQ ID NO: 627 - protein, 1034 aa, Escherichia coli str. K-12
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFYNNYCTHNKGGGAIRSGGPIRFLNNQDVLFYNNTSAGAKYVGTGDHEEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGSRQSSPKSNGGAIQTTQGFTLRNNKGSIYFDNNTATHAGGAIDCGYIDIRDNGPVYFLNNSAAWGAALNLSKSSATANYIHTGTGDIIFNNNVIFTFDANLLGVRKLFHINNNIVTPYTLSLGAKKDTRIYFYDLFQWERVKENGNNNPPSPNSRNTITINPEKEFSGAVVFSYNQMSSDVRTLMGKERNYIKEAPTTLKFGTLAIEDGAELEIWNIPFTQESTSLLALGSDATLTVGKNGKLTITNLGVILPAILKENYIPPCIRVNPQDMTQNTNANQPPPSTKDVSIQMIFFDGDLALVDENYESVYDSMDLSRGKAEQPILSIETTNDGQLGSNWQTSLNTSLLSPPHYGYQGLWTPTWLTTTYTVTLSNNSSNPTSATSIAEQKKTSETFTPSNTTTASIPNIKASAGSGSGSASNSGEVTITKHTLVVNWAPVGYIVDPIRRGDLIANSLVHSGRNMTMSLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHKMRSFYGTKKSSKGKFHSTTLGASLRCELRDSMPLRSIMLTPFAQALFSRTEPASIRESGDLARLFTLEQAHTAVVSPIGIKGTYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 628 - protein, 671 aa, Escherichia coli K12
MRLPCALLDPSRIAQMFAVAVTSLSTTALAQTDATDLTALPIEQLMQVQVVTGASKYAQAANEAPANVSVITAADIKAYGWRTLADILGSLPGLYTNYDRSYNTLGARGFLRAGDYDTRFLLLIDGHRTNDPIFDQAAVGTEAILNVDLIERVEYVPGAGSAVYGSNALFGVINIITKRGRDIDGVQASASTGSANARDARLTWGKRAENGAEWLLSASVSDAPGRDLYFAEFNQPGVSDGVARGMDFDRAKRLFAKGSFGEFGMTFGYVDRTKGVPTAPYNQSFNDPRSRAVDTRQIFNGTWQHALDDTTDVSARLFWGRYASLGDYTYNPPPAGINRDVFDTAWYGTELKLVTRRIERHTLVMGTELQRDYRDAMRNFDTVPYVSYLDDHRTNNRVGAYVQDQFMLHPDWVLDTGLRYDHTSFTPGIFSPRVGLIWHAAPTTTVKAIYGMAYRAPNDYELNYQSSAPGGQQATHGLSAERIRTYEAVVEQQVAAGGKATLSVFQNNVSNLISQSEDPNTGLLFFSNVARVRTRGAELGYEQNWPGGTRLRTSYSFQRSEDIDSGQTLANSPRHMLKINATAPVWRDDWRAGIEARYISNRLTTTGQVGGYWIANLTLLAAQLAPNLEMSASVYNLFDRRYADPAGPEQPQPSIEQDGRTFRVKFTYTFR

SEQ ID NO: 629 - protein, 1158 aa, Escherichia coli K12
MLIKSYKCMNNHGIFSPDRTKVRTLLSIKSIFLFLLFTFAFEMAYASSVYSQTKVFTMQSAEKTVLQVFKEIEKNSEFIIFYRDGVIDLNRKVSVNVVNQSVDKILEQLLAHTDNGFTIKDRQIIIYKKETSATPSVSQQKNKIKVTGVVTDAKGESIIGANVVVKGNPTIGAITNMEGRYEVMLPSDDVILLVSYLGYNTEEIKVKGRRNINVVLHEDSKALDEVVIVGYGKQKKESVVVSMSSIKPKDIVVPSRSLNNSLAGQVAGLIAVQRSGEPGYDNAEFWIRGVSTFAGGTSPLVLVDGVPRNMSDIEPDEIETFSVLKDAAATAIYGAEGANGVVLVTTKRGRVEKAKISFKTEHTISSPTRLPEFVGSADYLSLYNEALRNDGEGPQFSDELIAHYRNNDDPDLYPNTNWIDELLRKNTFSHRYTLNVRGGTEKAKYFVSGAYYNESGLFKNRPNGIYDTNIGIDRFNLRSNIDMAVSSTTTVGVDLAMQYLINNYPGTGTSTIFRSMLITPPYAFPAVYSDGTVATYAQERDANMRNPYNLLMNSGYAKEYRTGIQSKVNVNQKLDFITKGLSANLNVSYDYDSEMIIRREYNPTRYHATGRDELGQLIFSTVVSGNPDIQDPKNSATSATKKIYIDASINYKRTFGKHDVGAMLLYMQKETQQHNVPLPFRKQGFVGRATYGYDGRYFIEGNFGYTGSEAFAEGNRFGFFPAIGAAYYLSNESFYPEAIKKVVNKLKLRASVGRTGNDKTGQERFLYRPTFTTNAGGFTQGIGDTGGTNGIGNGIVEGRFAAPYLAWEIEDKQNYGFDLGLFDNRIDIIFDYFRSERRDILLQRRTVPQLGGLRQDPWQNFGKVRNQGIDMSMNLNQQIGKLKLSARGTFTFTRNKILEYDELPQKYGYQAVTGTRVSENTLYIADRLYTEDDFIVSTNANGLKTYKLRSELPRPTLGGLIGPGDIKYVDVNGDGVIDSYDQVRGVGNPSTPEIIYGFGLNAEYKGFYASIFFQGAGNTSVLLGGATSEGWYPFSWGVDQSNYRTFALDRWTENNPSQDVIIPRLHKNNANNANNRVASTWWLRNGSFLRLKNIEFGYQLPKKFMDKIGFEAARIYIMGYNLAVWDDIKYFDPEAGNANAGLNYPLPRTFTLGLDFTF

SEQ ID NO: 630 - protein, 566 aa, Escherichia coli K12
MESSSMRRGGSVARQALAALVCLATSGGALANADEWWTPANQVGSDSVLVAPESAPTLNSFGGMLSNQYSAAPMSAQDGLLEDTLQSTAADVDQEPSGLQTLADDEQNQDALADDESFEDRLDAFASRLEALDTLEEEWTDYQDGLAADAKAKKKKSTIKIGGRVHIDHWSFSNTDAGINRIESGGDPDQSPENITAFRRLRLEISGTVPQNMKYRLQVDFNNPQTPEIKDAYLGWTDLPNNQTLLLGNQKRPLGLDHLNSSRYNVFAERPLAVEAFNEDARRFGLAMYGHNDEESFCWTYGIYNLENINTDGRFIGDSAQAGGYSRLWGSPWYDDTSGGRGYWHWGLAGAVAKPDGNAGANDTNNNEGRFRTRPLARSSQRWLNTGRIDGADWYQNIGFENILNLGSLQITGEYILTPMQVEDPAAGVDDNLFFHGGYIYASYFLTGEHMPYNRSTGTLSRVKPHENFFLVDRCNGCRGNGWGAWQLAFRYDHLDLTDGGVNGGVGNLYTAGLNWYWTPYSKVQNNLVWGEISESGLAANGDNPLDAPVNAGNFLIFGTRFMIDF

SEQ ID NO: 631 - protein, 396 aa, Escherichia coli str. K-12
MNSLTTPRRIAAAVATLAVAQVVQASSSVTLYGDVDAGITYTHDQQTTNADGSVRGGRNLQLGGGNLAPSRIGLTGSEDIGGGTAVTVKLENSFWTGSGSLVQAGTLFNQNAWVGLTNERYGTLTVGRQFDSYTTTLAPYASSIPWATLYGSHIGDVDNLNAALNLNGAIQYASPTFAGFSFSGTFSFGGVAGDFSRERGWAVAASYNDAPFSFGAGMLDLNRPLDAALGGASGYIGDFACSNPAAMYCTLQNARALTAIGAGGSYAIGPLTLGVVYTHTTLDDSRYFADAAHPHGADARFDIVEVNAAFAVSPALTLGAAYIYNAMKTDASGSPKFHQVNLGATCNLSKRTGLYAVGFFQQPRGAESAAIRQPAGRPIMRRFRICRIRTATGNSR

SEQ ID NO: 632 - protein, 857 aa, Escherichia coli K12
MSGALALPALAQQQPAAAPAQPPSPAVAQDAAPTNPSVSTLDEVKVVGYQASLGKALNVKRNADAIVDAISAEDIGKFPDTNVAESLSRLSGITVDRQFGEGEKVSILGTDPALNRVLLNGQTIASTSWGGDPNDPDSRSFNYSTLAPEVVGLMEVYKTPEARIDEGSIGGTVIVHTRKPLELERNTLTGTVSYGYNDRSEEGKPNASALYSWKNQDETLGVLTSVMHSQRVLRRDGVEIFGYDDVAGAGFPAAVVGNNTGVFPTSINTALFQQTRKRDGVSAALQWKPDADFELNLTGLYVKESFDNYNQSRYGYWGSTPGDAQALGFENGIATSGTFGDQSTTFLDGYLRNSEVSTGSIHLRADWHGDGWNASSQVGYTSSQGGAERIYGIQFRNLAGYSYNIDGRRTAMDYSTDPTNAAAMQLNNASASHSPQYDKERYLQLDFDHAVEWGPFTQILTGIKLTNHATGQSSYSRTWNPNDGSTLAAFSPGTTPSGYLDGLSTSADMQRWSTINSGAISQYIGGLEGDEGLPISYAGNYSIEEQNRAWFLQGNFSGERYRGNIGVRYVHTRDSTDGYSYAPGGGYTPVNFLSSYGKWLPAFNIAYDLRDDLIMRFAASKVIARPRYTNMTPYVATDDTTLTASTGNPGLSPYESTNLGASLEWYFTDSSVLSGEFFSRDISNYILTTVQDRVFFNNATGGSSTYQTSVPTNAGDAKVRGVAVNLQHNFGNGFGVVANYTYSDSNTDGDYSLPYNSRNAYNISPYYEQGKWSARVNLGWRSEYFTQIGRLNGQQMTDAFTQVDASVGYQATERLRVALEATNLLDETYFSYIGNKNQPYYLYKNGRAFMLSLNFKL

SEQ ID NO: 633 - protein, 729 aa, Escherichia coli K12
MLSTQFNRDNQYQVITKPSLLAGCIALALLPSAAFAAPATEETVIVEGSATAPDDGENDYSVTSTSAGTKMQMTQHDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDHVGGTGWNSGKRKVDALDLFADGSYELFGRQHNLMFGGSYSKQNNRYFSSWANIFPDEIGSFYNFNGNFPQADWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYLAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNMEGSIVYGAPRNFSITGTYQF

SEQ ID NO: 634 - protein, 981 aa, Escherichia coli K12
MLFSGIQARGASLEVQQERKISGTVVDEKGEPVIGASVVVIETKQGTITNIDGKFQVNTPQNGHLKVSYIGYETQEVAVKDRQLLKIVLKEESTALNEVVVVGYGTMKRKEMTSAISHVGAKDLNQISSLDASMLLQGKVSSVSVSNTALADPNSTGSIQIRGISSRNAGLGPLIVVDGVPGGDMTNINPADIESIDVLKDGAASAIYGTRGSNGVILVNLKKGTRDGEVHTTYSAAVTFNKAKKELDIMNAEEYRAYRTVSNPLSDMGASTDWFDAVTRLGVTHMHTLTFSGGNARTNYRVTADYRKAQGIDLRSDRREYGARATISHTTKDGLFTFAANMTPRVIDRNKSASVYGSVIKNNPTMPVYDPESANGYYRFPSGGDSSNIVEQLNEEENGTEIKLLEWNATAAVNLLPLFNPNNPNMVLKSQVTVSQYQVDKFNGWFIPSTYGPNVNSGVAGKASRDFDKNTNNNLEWVTNFSTRIKDHQIRAMVGYSYNYGVSSGMGAENWDFSSDGLTYNNLGSGLEAAKEGKTMMSSYKNDHKLISFFGRVNYDWKERYLFTFSLRHEGSSRFGENHKWGNFPAVSVGWRISDEKFMKGLSWIDDLKIRYDYGVTGNQEIGNYQSLATYKAYGWYQYGGNNFHVWGPSKNVNSELRWEKGHNQNIGLDFSLFKHKVTGSFNYFHRKQSDLLGSYSVSVPPNLFSTIYANVGTLRNTGFELDITVNAVRTKDFTYSFTLVGATNNNKFVSFSNDVYKGQKYYSTCNMANPNNPGYLQRIEEGERIGNYFTYRYAGVDKKGDWLIYDKKGNVIPVAQGTEEDKAVTGNGLPKFTGSMTHNFTYKNFDLTVALRGAAGFDIFNVHDFYFGLQSMSTNQLTTAYSKNSHITTGKNVITDYFIESGDYLKIDNITLGYTMNLNKKYIEKIRLFGTANNLYTFTKFTGVDPSTYEVNGLTPGTFGGGYNYYPSAFQFILGLQVSF

SEQ ID NO: 635 - protein, 614 aa, Escherichia coli str. K-12
MSERSLNAWLWSPAVLGASLIASSPVFAEISVTPEAESKRLEIATDASRFPTTYLEPTRSQPSEQLAQVPVNPHSGGVGSPQNVSQVQVSDLDTSLDGAEADSSQQLNDYFREGRGSKKKQQVTSVSQLSDVQPTDWAFQALQSLVERYGCIAGYPDGTFKGNRALTRYEFAAGINACLERINELINASTADLVTREDLAKLQRLMEEFAAELAALRGRVTVLEARASELEANQFSTTTKLRGEVIFFIGDTFGDRAEYTTVGGPNVEDSDDPTQSYFGYRARLNFDTSFTGEDLLRTRLEAKDVPNLSREGLTNTLMTRLGTDGGDGDFTLDDLYYRFPIMNGKGQVYFGAKSLDLDDVQDPLSPFQSTGGGSSSRFGRYNPTSLRGPEGTGLALKYQLNDRIRINLGYLASQDDAPDPTEGRGLFDGSHSAAIQVVFEPTDNIALALDYNRRYFREGDVSVSGGTGSFLANRPFGDNPTTSDNLGFQANWRISDSFELGGWLGVAWADDKPTGEGDDLDATILNFAVTLAFPDLLKEGDLGGIIVGMQPKVVYHTLDNLEEEKTGIHIEALYRFQLSEYIALIPAVFIITDPEHTDDNDTIVVTTFRTQFRF

SEQ ID NO: 636 - protein, 799 aa, Escherichia coli K12
MQMITVIMRAFHINKCYLIAFQGSTMKPRPLYLASIISVLLSSGSVFAEDDSAQNMEVMVVTASGYEQKLIDAPASVSVVSRADLQNKPFTSLADALRDIEGIDVGAGQDKNGNISITMRGLPANYTLVLIDGRRQSDVGNIGPNNFGNSQFMYMPPLEAIERIEVVRGPMSTLYGADAIGGVINIITRKNMNSTHGSMTLSSNVQADSQYGNDNKIDLYLTGPSGIDGLTYGVRGSFYDRDESAPTYSDSLPLPNGSMWVDDGSFGDKKIVAAHNWNAGLSLNYQFDSKNDFAFEYDIAKQRYDNTQGQTGTLDSPVSLWRVSKGIVQPRVGYTPYQRVEREQFVFAHVGRYDFGTLSTSLTQSRSENFGRSLPLNVQERLGVQAIWDNAVAEQGTSKPKLTDAIYQQLEAQFLPRPVRTLQIENLILNSKLESNIDNHYFVVGAQYFDASMEDGVFGMYGDGFRSGTTQDHRQSAIFAEDNWELSRQLTATFGARYDHHNIFGSQVSPRAYLAYSPTNEWTVKGGVSTGYKTPEPNQLFPGITGFGGQGTKPFVGTPDLQPETSVNYEVAAYFNGSDALSGNITVFYNDFKDKIINQDNLPNCEVAPANTPCVEIGKGWAGVGSTSFTQAANVDESQTRGVEVSARYQFIETLALSGNFTYTDSEVKSGRDSGLPLVNTPKNMYNVTLAWQPMEQLSVSLLAEIRSDRFRGTANISGPQGPETQKLYYKAYDLYHLAASYKLSNNLAINARINNILDDDLSSRTCLLAASEEEYECTSDYNTTQKARSYWVSLSYNF

SEQ ID NO: 637 - protein, 962 aa, Escherichia coli K12
MAVPSPRPSWNLCGSSETLRLRGRRRPLYNSPRLFVISLNKKQPRAQLLPMRLPLLAMLLTVVLSSGAVLGQDTDELTLHGVVSNADGAPLLNATVRVQENHVALTDTTGYYELRVPRNGLPTRIDVEVRYVGKRTHRATLQVPEDSSRLRHDVRLPALDLYMDEVTVTAERARESVSNSTYIIDRAAVEQSQAFTLAGLLQLIPGQSITNPSLQGAQTINFRTDASGPYSRNNAFGVGIFMNGREINNNANMQGLNPVENPRVPFRSLEGGRFGDREYETGDTPGGGFDLREIPVGNIEEVEVVRGVASAEHGDILEGGVFIETTAGQSPWNAHLRRSGGEFNLGVNKGFQISPRHILNASLDYLRSNDDPRDQIKTFNRISSSLLWTSYYGSDRDIRNTLSLSYRTNVDGFKIDPDFDTRKRVFYRDQRVSFSNRLRLAAENVLYDEMTLSASGSWARSKSLLNEYVNPGVQPGNDTKQEGVNEGFFIPPNYRGKRKILGEPVSLSARLKLNRAVRVGDWDLNLAYGGDVSFDANYGAGRLINPRRPVPRNISSSRSTSFEARRPALVQGGAYVESTVSGTIGGHKLVSTIGLRGDSQHGYETLSPRINTRFYLTDHLSLTGAYGLQVKSPGLIHLYPGADYRDYALLNSYTGDVGESVYLAYTHVERDVTDNVQPMRSRRLEAGLEWSAQGTTISTTAYRNVTDNGITVQRRPEHINLPVYEMQGQGADGAPEFVDTGDTERVVYPQGYVTNALYTRNWGVELTASTPKIEVIQTSFSLNLSYNQSYYYNRSNSFNATDPVTKPENEIRYGVYPNTKQKSGRLQGTLTSTHHISDLGLLLTLRTEAFLYDYERTLDNSNRAVAYVNDEAEIVPIPEGEVDDARFDVLDRAPSEGTFRHYPPFAYFNLHANISKDIGKAVRLSFFANNVLNLRPRVWKNGRPKERLNQPPYVGMELRLTL

SEQ ID NO: 638 - protein, 187 aa, Escherichia coli K12
MLVGKGIMKKIALAGLAGMLLVSASVNAMSISGQAGKEYTNIGVGFGTESTGLALSGNWTHNDDDGDVAGVGLGLNLPLGPLMATVGGKGVYTNPNYGDEGYAAAVGGGLQWKIGNSFRLFGEYYYSPDSLSSGIKSYEEANAGARYTIMRPVSIEAGYRYLNLSGKDGNRDNAVADGPYVGVNASF

SEQ ID NO: 639 - protein, 2174 aa, Escherichia coli K12
MPWDSVGGVIMTYTMGGAGVDEGTAGAGGAVTITNYGPITLTTSTDPGSIGSLISATSFGGSGDGDNDNYKSNGGAGGSGGSLTITNYGALSVESLSPNTARSMAGIHAVSKGGTGGNQNSGAAGDQFGGVGGSGGSISITNTGQVNLGSATNPLNGLDYVWGLAAESIGQAGGHDNGAGGAGGAIQIHNGSSGGNASIGAINIYSNSADSARGIYAFSQGSYGTASQDSSDDGGAGADGGQFSIDTYSDIAVVTTGSDPNELSGGIVAISQGGDGGAGTASTTGGRGGNGSAFGSTLSVQSGVTVSTKGDYVAGVVGLAQGGRGGDGASGEKDSSGGRGGDVGAIQINVYGGSIETDGIQAYGLLGGSIGGQGGNGGDDTAVVGTSGGGGFGGNAGGVGAYVTTGSKITTTGDFSAAVTLHSIGGGGGTGGDFTDVLGGGAGNGGNGGNGNTATINNAGGTISTSGGHSYGILVQSIGGSGGTGGIAEGLTLELGGDGGEGGSAGAASVQNTGAITTDGYSAHGILAQSISGGGGAAGTAGGILSIGGTGGNANYAGNAEVQSSGAISTGGDAAIGILAQSIGGGGGSGGGAKGIATVGGSGGAGGYGTYASVWLNGGSIATRGEMAHGIMAQSIGGGGGNGGNVIDMSVGIPALGVGGSATGGGSGGWVCVTNENPGGDCSTGSGAPQAVAIATAGAGAVGILAQSIGGGGGNGGNATGGDAGFGSFQIGGGGGGGGYANTANVGFKGLTLTTQGSHAAGIVAQSVGGGGGTGGTASSYSAGIGFTASVAVGGTGGNGGAGGEVSVSLTDSAIRTGQGGGDVTDAIGVLAQSIGGGGGNGGSSIADALTVAVPTGEDVSLAMSVATAVGGSGGSGGTAKEVSLTLDGSTAVFTKGDSSHGLLAQSIGGGGGNGGSASSMSSTAGTVDTISADIGVSVGGSGSAGGNGGAVTAALKDSASVTTADDYANAIVVQSIGGGGGNGGVGSVNSKEIGSGFNLTANVGVGGSGSGGASGGNAIVGLDSGTHLQTSGSGARGVIVQSIGGGGGTSQGASVGLSASASLPGGGEEAAEAEESEEGSGAFSASVGVSVGRTGGSGGSSGTVNVTTAGTISTFGADADGVLAQSIGGGGGLGGSVGQASSGDSEPLDDEGDSECASEGGNGDDGHGYCFGVSVGATIDDGGTGGTAANGNAVTLTHAGHIATAGDWADGIVAQSIGGGGGAGGTSTASGSQATANITVGVGGSGGAGGNGGAVGITFDDNHGNSISTAGYSAYGVLLQSIGGGGGQGGDGSDEAAGRITVGGGFGGSGGAGGSGGMVTAKGWINLSTSGDDAHGIVAQSIGGGGGVGGAGSSTAAEKEHSHTIDLVVGGSGGVGGSGGEVDLSVGTTLSTSGARALGLVAQSIGGGGGIGGAGEADSIASLVVGGSGGGTIDGGAVTVDLTSQSSITTQGIAAHGLVAQSIGGGGGVGGAASGAPLSFTGNSPGSYGDGGDVAVTADGSIFTRGDYAFGVLAQSIGGGGGFGGNATSAFIGSNGNLSSDGKSGNVTVSLDAGRTIQASGKDSIGIFAQSDAGTDNNGTIDVTVNGTVTGGSGDNGAGIWVSAGKDNVVTVNSGGNVSAASGVAVQYTAGMNSPEDSTLVVNNAGTISGSVKGALTVAAKMPRLARSGRDTVVSVVNKTGGVLTDAEIYEADVMNHGRLTIGQSGGIDATRITGDLTQDAGGILGFTADFAGFRMDRLIIDGDATLSGRFTVNAISVLPDISLPFLTVAGTLDHALSAESSIFDYSISRAGNELSVSADSAHFTDPGAMLNEDQINVAGHLQEVWDAGGGSFGTLFGTLGSLADRNSGNYAAALSDMSPGISGAAAAGSIAMTQQRLDLLLSCPMFADGTSALVETSCVWSQAGAQTLDQKASGGMSGFDTTTYALRAGAQMEVSPDWFVGIAGGYDRSSIRGDDGRVDADGDIIYAGASLKHEIGPWLLSGAVAGSYGWYDNTRTIRIPGFAGQAEGDPEIYNLSTRVRAAYTFAQDPYYVRPLVDLDLIYSHASGYRESGTGALDLLVDDAGQWSFHATPAIEVGTRVEVNETTVMRAFAGAGVSFSTVDSWDTSARLAGAPAGIGMFDSEVPLADVVGRVTAGLDLATDSGFGLRVEYNGSFSDTYNSHAGSLRLSHKF

SEQ ID NO: 640 - protein, 453 aa, Escherichia coli K12
MPDFPFSRDSAISTLRLIGGCTALGLATCTQAAPAFDSESPWMLGDWNGTRNELAAKGIDFKLDYTGEMGSNLHGGYDHDRTARYSDQWGLGTHLDLQKLLGWNDAEFQLTVTKRSGNNISNDRINDPRVGGFTSAQEVWGRGQTTRLTQMWYQQKFFDQKLDIKVGRFGEGEDFNSFPCDFQNLAFCGSQVGNWVGGIWYNWPVSQWALRVKYHLTPELYAQVGAYEQNPSNLDRGNGFKLSGSGTQGAILPIELVWKPKLNGLPGEYRAGYYYSNAKATDAYKDSNGQPAALSGEAYRSASSKHGVWLGVQQQITSVASDNSRGLSVFANGTMHDKKTNAIDNYVQAGLVYKGLFDARARDDIGFALARVHVNPAYRKNAEATNQARAVYDYDDPSFLPPQDTEYSAELYYGVHVTNWLTVRPNLQYIRHPGGVDKVDDALIGGIKIQSSF

SEQ ID NO: 641 - protein, 711 aa, Escherichia coli K12
MMATFEKYESFSSKEDAVKLCFHRRLPSRAGAIALSTLMAPAGAFAQGTSGSGGESNALEAVVVSGEKVRRELKDTASSVSVKAGKDLARQESGNASVHEVLHDVPNVVYTDTVGAPIIRGQDTQGPNNGQNVFWGGTVPRATINLDGHYLNYNEMFFGATSVWDVESIEVFRGPQTTSQGANAIAGAIVVNTKDPSFKREGAYQLEAGDYHSRRASIAVSGPVGEELAARLAVDYSGRDTFIDYTNPQFQRGQADQDFRALNARMKFLWLPSRIPGLEAKFTYSHNDSNRPSQEAASAPFTALEHWTTTMPSWKQKTDTGILDLSYELGNGVRLVNQSQYSRSSVQRYTGIPGEGDADIRQNNVSNEFRALVGSDKDRLSGFGGVYYARTGTDESLLLRGLSAFDDTKKNLGVFGELNWRLANRWTLTSGLRYQQDEVVRTGTSVLAPTALDYTKTFSALLPKLSLAYAATPRWTVGALVSRGYNPGGVSLNLTSRQWAYFKKESIWNYELFSRASLLDDRLMLNTNLFYMDMRDAQYNIPVVISPGVAQSYTINAEKAHAYGFELGADYRALDNLRIKAGVGVLRTRIEEMGSNPGYEHNRFARSPGYNLSLGVSWDASPRFNVSGQVRHLDGYYSDTANTRAYAVGSNTIADLRMTYAYSARVQLYGYIKNVFDRRAPTYLQQNRGIGGIEASMTAPRMIGVGVRGTF

SEQ ID NO: 642 - protein, 289 aa, Escherichia coli K12
MFGSAHGDTTSSDTSGRRPLRLVVLPLLLALSSCKVDLYTQLQEREANEMLALLMDSGVDAVRVAGKDGTSTIQVDEKLLAFSIKLLNAKGLPRQSFKNLGEIFQGSGLIASPTEERARYVYALSEELSHTISDIDGVFSARVHVVLPHNDLLRAGDTPSSASVFIRHDAKTNLPALLPKIKMLVAESIEGLAYDKVEVVLVPVERSAQEQRSLLATDLAQASRPIPEPLLAVAVGVSAAVFAVTCYLLFIVLGHRRRQLTGELSRVQERPGVSALAAIRKKIPGLGRR

SEQ ID NO: 643 - protein, 362 aa, Escherichia coli K12
MRKQWLGICIAAGMLAACTSDDGQQQTVSVPQPAVCNGPIVEISGADPRFEPLNATANQDYQRDGKSYKIVQDPSRFSQAGLAAIYDAEPGSNLTASGEAFDPTQLTAAHPTLPIPSYARITNLANGRMIVVRINDRGPYGNDRVISLSRAAADRLNTSNNTKVRIDPIIVAQDGSLSGPGMACTTVAKQTYALPAPPDLSGGAGTSSVSGPQGDILPVSNSTLKSEDPTGAPVTSSGFLGAPTTLAPGVLEGSEPTPAPQPVVTAPSTTPATSPAMVTPQAVSQSASGNFMVQVGAVSDQARAQQYQQQLGQKFGVPGRVTQNGAVWRIQLGPFASKAEASTLQQRLQTEAQLQSFITTAQ

SEQ ID NO: 644 - protein, 154 aa, Escherichia coli K12
MTDYAISKKSKRSLWIPILVFITLAACASAGYSYWHSHQVAADDKAQQRVVPSPVFYALDTFTVNLGDADRVLYIGITLRLKDEATRSRLSEYLPEVRSRLLLLFSRQDAAVLATEEGKKNLIAEIKTTLSTPLVAGQPKQDVTDVLYTAFILR

SEQ ID NO: 645 - protein, 254 aa, Escherichia coli K12
MFFKKNLTTAAICAALSVAAFSAMATDSTDTELTIIGEYTPGACTPVVTGGGIVDYGKHHNSALNPTGKSNKLVQLGRKNSTLNITCTAPTLIAVTSKDNRQSTIVALNDTSYIEKAYDTLVDMKGTKNAFGLGSAPNGQKIGAASIGIDRSNGGIHAADDTGEIPVDLIQTDHWSAATPTWKASSNGAFCSLTSCSAIERGYSVAKTGELTPVAITAVTFPLLIDAAVNDNTILGSDETIKLDGNVTISVQYL

SEQ ID NO: 646 - protein, 646 aa, Escherichia coli str. K-12
MNKKFIYMSVFCTLATTFAYAQEQDTLKVKSLKEVVVSDTKFAQSKEKSGKIIEVITTEDLAKKQGQTVTNVLSQVAGVEINGNQSFNGKNLGYYIRGGRNRQVAIYIDGIPVTDASGINLEYDLRLIPVEQIEKIEVMKGASSTLYGTGAATGVINITLKKSAKKEISGNAYINMGTQNTSETSKTSAQDFNQGVSVNGTINKVSYMTTLNSTETKGMSEAAGEDFEEDTFSRVNVLQKIGFKANDKLSFEFFGNYDRIKNTFDNSFDGVIANSDDLNNNSFSEQFRIGFLPKYKYNKGEFAINAGASTIDRTINISNSWSGTVDSYNYNGRTASIDAFNKYNFSKQVYLVLGVQYQYFDMTQKDDYTDVAKEGAKFNLIDPYATIVYNSDFGLNVNAGARLNTHSEYGNQVVYNFNPSFSFDDLPLKVLASYSTAFITPSLYQLYGPYGNLDLTPEENATAEFGFELQLLDKKLTINAVGFYREEQNTFGFFYNSATFESYYINIDGTYNAKGIETTIRYALSEKINIGGNYTFTQAEKQLNRLIPKHKGNVDVSYLFKRGTFGIQYQYVDQRNDAFYNSNIWATQAVDLSAYQLVNSNISYELLPNRLQVFGAVTNILNEDFQEIIGYNTRGRNYKLGLNFMF

SEQ ID NO: 647 - protein, 1003 aa, Escherichia coli str. K-12
MLRDLRNSMQRFHSYRVRLSVLAVAIAACSPAVQAHSVGASSDAARLASPTRPNSTSSDESQSPAETASAAEQPSSNEHTPSLNDTGGSDAPAADAAKGSVQTLDAMQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASMVSELQVVKTFTPDLDPNATGGAINLKTRSAFENGGKPFFSADAALGHANDVGKPRDQEDPGYRVNATGSRTFGSEQQYGVTVSANYQTLSSYTETHMTTDTVHYGFYDNNGVLQSGANLGNGWAVPQQDKYWYVQDQRDRYGVTGKFEMRPSAALEAYAMAGYYYFKDDMERNEVIIDPRNRGKVFNQTATSGSYPGGDIEVGYSNQIVTTRTKVAQLGTIWRPTDRQQFSARGAWSDATYDEPIRMIKYATGITRPVPVPVGQTGSGVTIHATPNYAFNYDTSGFDQRFGVSPQAYNNLDNYSLLYWRPDYKRTAADRILTGRLDYGFNQGESDQGIGFAAGVSYTTDKPSYDIYRVEYQPNSTAPAFGLADVAGTGRPPMRYVGLNLLSIDPNKANRVLAATPLSAFNSTDQQAFSNQDNFTHTEKTFGSYGLISYRSDRLNVQAGVHFDSTTLDTVGRERQLDRASNRYVYVDNPTTADYNYLLPSAVMTYHLTDALDLRAGASRTLGRPPYDAYAARTSIGFVNTTDAGNPNAQGVTVTIGNPDIKPRVSNNLDLSLEWRLPGDFDAFASAAVFDKHIQDEIFTLSRADSFTFDGTTYANALISTPANAAKARIRGVEFNGIVNTLGPIAPWLSGVGFSANVALLDGSLDVPYSVGSGSSVSQSERKLDNLVGQPDYTANATLFYNTGGLELRAAYNRQGKALRSIVSNTDWQDLYWSPRSQLDFTATYAVSKQLSVISQVSNITHSRITSVTGPGQNLLKDSYSVPTTYWVGLRFTPTL

SEQ ID NO: 648 - protein, 381 aa, Escherichia coli K12
MTITKTALATTIGAAVALMSFAAQAEITVLKQDPQAGNPLSRLNFTVGGSIRPQFQNMTGDDGKNSYKRNGFDGGTRFRFAADYYLFDDISWVSYYELGVNIPAQFNWDHHYAEGAHDTSRRMLYTGLKSDTWGTLTFGQQNSVYYDVVGAKTDIWDYDMVGQASGNGINGDYDGSYRSRQMLKYKKTVGDADVYASYLFEDSEYLPGNGLRYKRKGGGSLGLDYHLTTDLTWGAAWNYTRADMRNPDNGDSKTYDQNILGTALSWTPDNWTFSVGGGWYQNFMTTKKVSVNDYFAGDAWGIEYFAGYKIPVGQYALKSVQPYFMGDRIEYVNGRNYQRIDNGVGISFQLDYGFRVDYEHVFTSSTDNLGDMNLVRLRYDF

SEQ ID NO: 649 - protein, 867 aa, Escherichia coli str. K-12
MKIIKTILVILRAVSIERFVTLKKRISFLFLIFLTVPTMEVFAEVSFRARVYSRSKNSGEANVRVLLFETKKFYQTDVEGYFQAVAPSSGVYTFRILKDTGAQEIRKEIGEGEELVILDSDQSTKSGGGGSKGSINVTGEREKQLMSRTKLRFEEIKRMPGTFGEPLRSIETIPGVVPVSAFGGGASNYSFRGADPTTNLYLYDDLPILYPFHFDGLTGTLNGNLIKSMDVYTGVLPANFNNALGGVIEIESPDKVERSSGNFLSSLWAASANYQTTFANGKGYILGAVKVGYMDKTFETIGTITGVSSLPDGVRLPHYTDSQVKMVYNFNDQHQISFYSLTAKDDTAFNPPVKRYNDPTKDQFAEYSGGNLSVGQGYRTQALRYIWRPSEKFVNRITLISYDPFVDYNVLFGSLKAKQKASGAYNGIRQDAYWDPNKHLTLEFGSEMRFLNYRTSGNTIQQTDPNNPDPNPYDTVTPDFKTVSDTNRVQSKYYNAYTTMKIKFGGLLIEPGARYDYIPYIKNGALGPKAQMSYKFEEGPLKGTTVFGGAGNHFNFPLDTRFSEQSGNPHLKFQKAFKYGGGVEHELTSNWQAKGEVFKQEFSNLIVTDPYITEIIGTNPDQYGKVFQPYILNKPLNYSNNGTGHSQGYELLIRKIATPGKRDDWFGWISYTWSQTFRNPNIYKPDGMIAPVATGPEQRLLAQSYHNSKETLYDYDRTHIINVVFGWKFSQNWQLGGRWSYLTSMPITPIVGDDGGRFSNPANNQTIWAPVSANNPYLADYVNTKRLADYHRFDIRIDKFLNYEWGYVNTFFEIINVYMRQNVSGETFNVTRPYSSTNPKPSPTFGTITLSGGVVIPFFNIGIEVKF

SEQ ID NO: 650 - protein, 821 aa, Escherichia coli K12
MSGNIGANPVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYFDKGKMQLSIFAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 651 - protein, 401 aa, Escherichia coli K12
MKLMRPVALAALATSLTTPALAERQETIYINPFAGFQLFDDKRDLSETGTFGVGVEYRFRPHWSVEAVYSRADADRKYVAGESDFDEVRVDGTYYFAGPEAAWNPYVSLGAGHADFGLGDSISYRSAGTDHDETRVNVGTGFRYNVSDGISIRGDLREFHGIDESTFDTMVSLGLSWAFTRTVSAPAPKAPADADNDGVPDNRDQCPGTPAGASVDSRGCELDSDNDGVADSRDQCPNTPAGAEVNSRGCELDSDNDGVVNSQDQCPDTTAGATVDETGCEGITETVETIELRVQFPTNSSVIDNAYDNEIRRVADFMEEYPETTVEIAGHTDSAGEAGYNQFLSQRRAEAVAGRLTGPLGVDPDRVSAVGYGEAEPVATNDTPAGRAQNRRVEARIQVRR

SEQ ID NO: 652 - protein, 364 aa, Escherichia coli str. K-12
MRRLLVVAAMAAGSSSVFWSVAPARAANQLELYGVVDVGLATTRVSGLGTRQQVLGGGQTDNLWGLRGTEELDGGWRASFGLESGFDAANGTRNDDARLFDYGTWVGLGHAGVGELSLGRQQSIGLQYGGQLEIASWRDMGMGALFKASDNYRVNNLVNYLSPEFSGWQWGVGYAFDVESGDTGRFDRSPAFSTGLKYEDGPLLAAFTWDKLNLHDTSATGGRSPQALQAGFTYDFEALKMALAWSRQRNGFVGLNGGGQIGLGPEPFAHGGAINAWLLGLEVPVHGNGAWLVQGSMARPDWHWANGQQASKAYVVTLGYRQDLSARTSLYAYGGYMKGYDPEDPFASDVGRATRFGVGMTQRF

SEQ ID NO: 653 - protein, 413 aa, Escherichia coli K12
MDCTSLAAQTPFPPPVAHHNNKLMQCVLNHEKTTPMTQQFKRTVAAFGATACALACQTAFAQSSVTLYGVADVGIRYLTHSNANNDGRLFVTNGAITNSRFGIKGTEDLGNGLKAIFQLESGIDLQSGAQSDSQRLFNRAAFVGLSSNYGTVTLGRQKTPLFDLLGDTYDPLTVGNYFENAWLPVALGAGLYADNAVKYDGTFGGLNVKAMYSFGTNSTSTGANGFSGQIPGHLGAGNMYGFTASYSFGALSIAAGVQQNSDNSNNKQTIYNANAVYAFSTAKIYVGYLHSKDDTGFVDSTLAQRDLTLGVDILKGSGRKDDGPFAGVTWQATPALLLTGAFYYDHMKNAAIGGGAVGSGNRYTGVAVAEYALSKRTEVYGTVDFNKVTGAATVELPGSSNQTGVSVGIRNIF

SEQ ID NO: 654 - protein, 179 aa, Escherichia coli K12
MAPENVRPNASLIAMQHPLIDLGQARGPSGQGDLKSWATDVPITHCIRSIPAAFAVHQPWSLSLDDTNDRFSSVSFVTDESVSGRRGARLQGETTINGIALQPYLKANIWHDFGGTDRVSFDTTDITTEGRSTSFEFGGGVVAKVTDKVSLFATGDYTTNLGGDKRRILEGNVGISMKW

SEQ ID NO: 655 - protein, 1055 aa, Escherichia coli K12
MLLLAFFFVGIGLVTAQNPEGYSVVISEEDGQPVIGASVLVKGTQIGAITGVDGDFTLPNVPSSAKTLVISYIGMQTQEVDIKPNIKVFMRSDSEMLDEVMVVAYGTAKKSAFTGSASVIKSETLEKRQVSNLSNALSGTVSGVQTQSTNGQPGTSATVRIRGIGSMYASNNPLYVVDGIPYEGDISAVNSQDIESMTVLKDAAAAALYGARGANGVILVTTKKGKSGDTQISLDARWGVNSRLVKNYDVLQNANTYMETAYSALYNGYLYNSGYTAERAYQLANADLFPKLGYQVYTIPDGQYLIGRNGKLNPYATLGYSDGDYYYTPDNWSDEMFQSNLRQEYNLSVSGGSDKLSYYLSASYLNDEGIIENSGFERISTRMNVDYQAKKWLKLGVNLSYSNVTSRSPGDQDTDAATSSGNAFFVGNFIAPIYPMYVRNADGSFQYNANTGYHVYDYGDGSSTNFTRNFMSMSNPMSGFLYDTEKYLMDILNGKWYAKIDIIDGLSLTASLGLHIDNTRQHSVGNKYYGQSASYGGSVMQYSSRVYSLDQQYLLNYKKTFGNHNLDILAGYESMDFNTESHYILGYNMYSDKNWTASNVIDRKNGSGSYNEYATIGIITRASYDFNEKYYGSVSYRRDASSRFHPDNRWGNFWSVSAAWDMAKENFISQYDWINMLKLKASFGQQGNDNLYYKGYTNYYPYLDQFTVSGSDGVFSDGVLYYKGSKDITWETSNSFNVGVDFALLGGRIDGTIEYFNRQTKDMLYYKPVAMSNGYTQLPMNIGSVRNSGVEIELNYTPIETNDLKWVINWNGTLMKNKILELHPDLKGEMIDGSYIYREGESLYQMYLTKYAGVDPDSGEALYWAKDENGVEYKDKDWSAAYNSNRQASGDLLPTIYGGVGTTLEFRGFDFSIQCAYQLGGTIYDSGYQAFMHGGDSHYMGYNWHKDILNAWTPENRNTNIPRVDAIDKYTNSLSDRWLTSSDYFSINNITLGYTLPKRWLRSLGIGSLRIYGAADNVALFSARKGLDPRMSYTTASTDRYTPIRTISGGLKVTF

SEQ ID NO: 656 - protein, 833 aa, Escherichia coli str. K-12
MRRTEQGGRGTGTVSALRNVLLGSAAALALLTNAAVLGSANAQAIPSQQGASQAIAFNIPAQDLGGALNTFADRAGLRLLFPSNLVAGRRSAGLAGTLTRNQALTRLLAGSGLTYRFTSANTVTIADPAPTPVGAAPAGAIALDTIDVDGVPSSDPGRTEGTGSYTPSVTATATRFQLTPRETPQSISVITQQQMNDFSLRSINDVVNQTPGLSTEQAGSGITNYYARGFNVQSMQFDGMQTYLNGAYPGTDTSRDMAMYDRVEVLKGTSGLTTGAGNPGATINLIRKKPTRAFQGYTTLRAGSWDDYRGELDLSGALNESGTVRGRFVTAHQDSRSYLSHREHKSSLFYGIIEADLTPDTLLTVGADYQRYVPRGYTAGMIPLFNSLGEFNTVPRSFNPGARWGTWEQNASNVFTMLEHRFDNEWRIKLHLLRQVSGYDMAVASASGGNPNPLDGSGVSLWRYNYTGKTRNDTAELFAAGPLWLFDRKHELVVGGRISRRDWRNNNFDVDPTGPGTSNIVSDFYNWTGNIPQPRLLPDPTYSNREVHNESGVYAATRLNVHDRLKVLLGARIADYEANLFNWGNRDRLKKSGQVIPYYGAVLDLTDALSAYASYTGIFMPQTAQNEQGATLPPLEGINTEFGLKAAFFDGRLNASAAYFQLKQDNYAVPSGGLTPTGTPAYRPADGVMTEGFELEISGQLSPQWQIQTGFTHNVSQLDNVRVVTLIPANQFTFYSTYKLDGALDGLTLGGGARWMDKTWENVRNPVHGTVLHTAPSYWVVDAMASYKFNDNLLGTLNIRNLLDNKYYTFYNWYNGYAWGAPRSVLLTMTYKF

SEQ ID NO: 657 - protein, 625 aa, Escherichia coli K12
MRIIILLFLILSLGFSGVVLKFDEVDIKTVAVQVAKLLGKNLVIDPRVKGKITIISNGEISESEALELFSQALASQGFSLILEKDTMKIVPASQGYPFTEIKAGKGGEFVTLVYKLKNTNASQVVSALRPFLSPYGRIAFHAQSNSVIITDYADSVNKVKKILFYLDSGGGEVRVYKLKYVKPSYVVKLLNPFSTLSTKRYGEPVVIAGVDEMNAVAVYANKEIHRIIEKVISDLDDPSSLEAERSFYIIPLNFVSAEEIYESLNSVFKGIKSVSVGTKKAKKGKGVQALTSITLKSGMKIGFDKRTNSLILYATKSEYEAVREFIKKIDKRRKQLLLTATIIEASAKSILEAGIRWQILGTHGGAAFKGSSLQDVYNAIKSGNFVIGGFSKSGTTVSIGGIDFFFPDLVFLFSLLEQGTGFNVVSNPKILTLDNQEALIKVGQVVPFPTGIKYDVNGNPIITYDYKDVGLELKITPRITGETVRLVIELKLQEITGYLTNEVSGVNYTVPITSNRELNSDVVVENGRTVVIGGLISRKSLKSTEKIPGLGDIPVMGRLFRYDRDEKDKTSLFIFLTPYVITSPQELAKLTQEHEKLARELMKALKKKEEKKVEVEEEDWWDEDI

SEQ ID NO: 658 - protein, 700 aa, Escherichia coli str. K-12
MKKKRGIAPFGVLCACSLASTGVLANEASRMLDEVSVTATRETRSTGEVPQAIAVVGKETLADKKMFNVKEALQEVPGVLIDSKNGGSDARLIIRGAGLKAAYGIREIQVLRDGVPLSDPDSFTRLDFVDTQDIERIEIAKGPGNLFAAGSAGGAIQIISKSVFDARANNLKIGAGNLGTQNYHLRVGGMIDDRQALALTVTRREMDNDWRTWNRFETTQASLKHGIQLGDGDILESEASYAESDMQLPGAVDEAMFQTFKQTGKQNGTSEAWRHSGRYSKVWFLNSRLEVQRGNFTFKPRIYYNTWYHYHPVTGIINETESWVSNLGMDLEGNYRHAQGTLVAGITARQERAPDSRKYEYRDVTTGGGGRIVATRSDAKGRLAEIDDATTLLTGAYIQESWRPNERWIIDAGMRYDIVDFDDNNQQFRKYDYASGKYVAGAGSTQISKTFYLPAPKIAASYRLLPGLNLFAMAAQAGQIPSFSEVSTNPALEAPVARNYEVGLKARAADWSFDTSVYVNPVSKDIVQQSNGGVTTYLNAGKTDKKGFEFAGRYALDKHWELGGYYSYTKYRYTEFSEPVRVGAITVNQERAGNTLPFVPRNQYGVFAGWKQGGWRARVSANTWGEYWMDSANTQKYEGWEWIVNASLGYQLQQHSLTLNADNLFNERYAAEAKKDTTGKVTYTVGAPRALMLTYRYDFR

SEQ ID NO: 659 - protein, 631 aa, Escherichia coli K12
MIRVVQVALPALLFSLSTVSSASDEIHAVSDEVSTIVNEDVSNDIEKITVESSTTANTKPVGTFGSPVSNLEYDPRVDLQSRNMAEAQADVTIRGGIFENTGFRVGSATLLDPQTGHYFAEIPIAQEMLSNANVLTGADNALHGVNSSVGTVSRNWTPIKTAGSASIGAGNNNFNLQRIHSGVSMALGDSTDWTLGLEGEFSRSESDGTIENGDHDFQRASARIQLVGPSSQTDLFFGSQDKFFGWPNMYTPFNVNETEDLETQLLILNHKQEYAQDSTFEISTYYRNNKDHYVFSRENPDIFEAFHETDVKSIALSGRHAQTASFALNYSTQFIADSIKSTTLENNFTSRHYYKLSVLPEYRMDLHNDQALTVRLGAAFDDTNRDDSQVSMIGDITWDTINADDTSQTIYLSYAEASQVAGYTAIGGSDSGGLFRSNYNLERETTKNIELGLVLDRETWRLDSAIFYRQDNDLTDWTYSLSSTSARSANPVDIDTLGLELLAVKRFENAEIITSYTFLEKSEDYGAADIDASFYALNFPDHRVTLGVIWHPSDIVEVRVDNEWRKQEENILRNGDDDALFTHLSLKVSPSQIKGLDIVLAADNLWDESFEEIPGTPGRGEQYTISATYNW

SEQ ID NO: 660 - protein, 993 aa, Escherichia coli K12
MVLIFQLIAVEAIASPPSVALKHPPVAITGKITDEKGDPIPGVSIKEKGTKNGAVTDVNGGYRLTVNGPASVLVVSYVGYNSQEVTVGERTTINFSLKESSNALDEVVVVSVGYGTLDKKEVSSAITHVSARELQTVASNSPLQGLQGKVAGLTVTNTANGDPNSTPSIQMRGVSSRNAGLGPLYIINGVIGGNIDNVNQNDIESIDVLKGGAASAIYGTRGSNGVIIITLKKGSEQSQLFYDGYSSMDYITNAYEVLSKDAFVANRVPNNKGVDYGGNTDWQKEVSRSAAIGQKHTLQLSGGSGTTNFFASADYRDADGIDLRANKREYGTRINANYTSKDKTYEVSLMAAPRYAQTRKADYSGFKNSLTLNPTFPVYNERGQYNYLNTGFDASNPVENARMIKAQEEIKKIDISGSLKVNLLDNLNTMVVVSEASSSFKNLDFRPSTLSNIVYNNQTIKSNYAQQEQTESDVKNLEWTANYSTAFEKHRIKLLGGYSYSLSNYKQFRASNYDFPFDAFSWNNLGSGLYNGGAAGNGQDAVASTQNGSTLISFFGRINYDFDHKYIVTASLRREGSSKFGIDNKWGNFPAVSAAWRITEEPFLKEKISWLDDLKLRVDFGVTGNQDFDNYLSLLLYSGFGYFPFNGTNYQVYGPNKNSNPNLRWEKAHNFNAGLDFEVLKGRITGALNYYVRTNKDLLGEYDVPVPPNPHERTYANVGTLKNSGVELQIQANPIKTDDFSYSITLAGAYNDNKFISFSNDLYKGAAYLDVAGLPAPGSPGTIQRLEEGRRIGSFYTYRNAGISEDGTLLVYKKDGSVVPANQANNDDKQYVGNGLPKFTASLGNTFTYKQFDLSIFLRGNFGYKVFNTPAFYLGTPATQADVNVLTSAYDSGSKYSKLTNSSSLSIPSDYFLENGSFVKIDNVALGYKQSVNSKFVHGIRLYAAGRNLHTFKKYSVGDPDLIPVNGLTPGVNTSLNYYPSTLQLIFGAQITF

SEQ ID NO: 661 - protein, 877 aa, Escherichia coli K12
MPMVAETIKGTIVDKQTKEPLTGATIQVLGSTVGAVADLDGNYTLDVPGGVYELVVKYVGYTDIKTGGVKAKGKDVVLNFEMESDAQALSEVSVVARKNLEGERALSMERQKATVAIENLGAKEMSVKGISNVQEGVKKITGISIASAGQLIVRGLGDRYSTTTLNGLPIASPNPDNKLIPLDLFPSSTVRNITVSKVYEAGTFADYSGAHIDISTKENTGKDFFSIGFNTGGRFNTIFQDFYKMDQQYSLFRNPGINQKYIDMPKADFSTAITKENPFHTTFDVNKSISLPEFGGNIAGGKNWDVNGQNLSLLAALSASNTNETTKDAFYRTLEAGGTTLDRFNYDSYRQELKLAGLGNLAYTLRDADRIGYTFFYARNAENTYMLRQGEDYEDNELIGNNSVTHIYTLQNHQLNGHHEFGKQWDLNWSGSYSKTSSEEPDRRQVMFEKAGNSLELFDLNKQENMRYFGSLNEEEWVGDLRSSYRYGDNNLIRMGATYKDKSRTFRSTRFYYDVSRFNPEIEDIYQTSSFMGYDHIANGDISIIRDQQPKDQYDAGHSIYAGFIDAEYYPTANFLVNIGVRYEYSHQWVNYATDGGEAKRNEVNCHDFFPALNLKYTVNDANSLRFSFSRTVTRPSFIEMAPFLYQESYGAAMIRGNAELKNGYNYNIDLRYERFDQQNSNNMFSITGYAKILEDPIERTQTLSGGAAVHSFQNADTGVAAGVEVEFRRELFRDFRVGANASYMYTNVQLPEGGAYTNAQRSLQGASPYLVNADISYAPKFKNDTQLTATLLYNLQGPRIHAVGISGLGDVKQEDLHTLDFVATYKLNDHWNFKLQMTDLLNQDIVFKQEVKDGRKLEVERYGRGTAFELGFSYTL

SEQ ID NO: 662 - protein, 234 aa, Escherichia coli K12
MLMIIKKSGGRWQLSLLASVVISAFFLNTAYAWQQEYIVDTQPGHSTERYTWDSDHQPNYNDILSQRIQSSQRALGLEVNLAEETPVDVTSSMSMGWNFPLYEQVTTGPVAALHYDGTTTSMYNEFGDSTTTQTDPLWHASVSTLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 663 - protein, 399 aa, Escherichia coli str. K-12
MKKRVVVAMTAAGLAAATAAHAQSSVTLYGIVDNGLAYQNNAAPSTGATSGGHSKVSMSTGVWAGSRFGLKGNEDLGGGTKAIFQLEAGVNTATGASQWSGGIFTRQAWVGLTNAAYGTLTAGRQYTAYYTLLSPYSPTTWLTGAYGAHPGDIDSLDTSYRANNSLVYMSPKFYGFTVGGSYSFGGVPGSVNRGSTWSAAIQYLNGPAGIAVGYQRVNNSTLGGGAWGDNSTVTSGGQPAVSAINNGYATAQSQQRLGVTAGYQFTPAWDVSVSYTNVQYIPGVGSSFRNTAIFNTAGAVLHWKAAAQWDFAAGYSYTAATKSNGISSSAKYHQVTLSQYYSLSKRTGLYALEAYQHASGNTLSKAGAIQSATTQIGDGVAAGAGQNQIAVGVGMIHRF

SEQ ID NO: 664 - protein, 689 aa, Escherichia coli str. K-12
MILTITFLKYILEQINFILKEINIMIKSKTINLSFLAFILLTNNLVAKEETTTLEAITVTAQKKEENVQKVPISVSVFDEMSIEDKSIDSLEDIAKYTPNLMLYNTGQEGLIVPSIRGISGNVLSYSTPVGLYVDGVPTTSAFGFDDAIGDIERIEVLRGPQGTLYGKNSEAGVINIITKQPNNETRGKIFSTIGNEGRKDIGLNVSGPIIKDKFYAGVAYKHKEKDGFIKNTVTNEYINDKKSDYAKLILRATPTDNLDVSLISSINKEDNGDHNWVSSTNNKKEVTSNLKGSSTPKDTTFALNVNYNIDENSKIKSITTKKEYKDKAIVDADFTPLTLRHIYKNNELNTISQEFRYETIFNKTELISGIYLDKKDDDLYTRIFAPFNPTGFANPQDMSSRSIGIFTNIIHPLNDFWVLNAGIRYDKEKKEMEVKNTTIDLENSYSSVSPKIGIQYNINENQMSYFTIAKGYRSGGFNPFATSNAQAYDEENLISYELGYKGMFFDNRLKFNTNIYFMDIKDMQVEETPMLGTTYMVNAATATSKGFEVEIEGVISDEISLFASAGVNETTFDDFKDLAGDYSGNYNPLAPKYNFNIGTLYRANNGLYARVDFNGYGKTYFDKANTTSQKAYSLVDTKIGYEANDFDIYFYVNNLFDKDYDAIGAYFSGTTTILRPEQEFGIKLAYRF

SEQ ID NO: 665 - protein, 113 aa, Escherichia coli K12
MRGKAGFAVNPQLLIYATGGAAFAGTRATDTFIDGTHDITAKATSSGWVVGAGGEVKLARQVSFGFEYLYADFGNKSYAFDSSHLSGGFAGLPLAIDAHLKLNIVKASLNYHF

SEQ ID NO: 666 - protein, 685 aa, Escherichia coli str. K-12
MTLNAMTVEDNALGTITENTKSYTPGTIATATRLVLTPRETPQTVTVVTRQHMDDFNLTNINKVMDHTPGVTRRGTDNYRSYYYARGYEIRNFQYDGIPVLSDGINFMGETTSDMIQYDRVEVIKGASGLTTGAGSPGATINLVRKKPTHEFSGHATAEYGRWDNYRTEWDVGGPLDESGSIRGRFATAFQDQQSYMDHFKEQKRALYGILEVDLSPKTMLTFGGNYDKTIPTGSSSGGTPFFDSHNNEVNISRSFNPAASWSRVEQFSHAFFTQLDHEFDNGWSSRVYYTFQRNAYDANLGSIKYTPNGDTGSSELLTSQNRYKTRSQALEAYARGPFELFGRTHELAVGVSGYHNHLKGSGHNVIRVPIDNIGEWDGRAERPDWGGILYRAEDRINQRAVYASGRFSLSDDLAVILGGRVTNYRRGGDSNMRETGEVIPFAGVTYDLNNNFSLYASYTKIFRPQSVRDESYAVLDPDEGDSYEGGLKGEWFNGRLNASLAYFEIRQDNRAESIGGLTNSNGITYTAYRGTKAKTKGIELEVSGELMPGWNIQAGFTHQVIREDETNEKLTTQAPENQFKLYTTYRLPGRLSKITIGGGGSYQGTTWRDGTDALGNEHQFKNEAFWLVNLMGRYQITNNLSATLNVNNLFDKYYYSNYGDRWTGIATKMYGEPRNMMLTTRWDF

SEQ ID NO: 667 - protein, 805 aa, Escherichia coli K12
MIILNRFTPKKLALMISLGCVISVPAAMAQDTKEDVVELETYTAEGQVEDTMGLMPTEPVKSVFGFGKTILETPRGVTSVSADMMESYAITDIDDLVLISPGAFTQSFFGVAGSLDVRGTPGEVYFRGVRRVNNPGNYPTPIGATDRIDIVRGPASPIYGPSKIGGYLNFEPKSARAETGQFLEKPTGKISLTRGSWDKNVVSAEVGGPGSIGEKSLGYYLYAETENSGSYYENSGTDQNILQASFNLDFSDKTRFEFGGMYHEYDGNQVAGWNRLTQDLIDNGTYITGSPTSVDTDGDGYNSPDEYDAWIASFGGGGFFVSPGDVVNGDMKSAWALQDVGTTKLKGSQTMVAPEDQLVTTVTTLYFDVIHNVSDSFTITNKAFYEKLENINENAYGFSQFVDTYAFEDQLIFAFEAEHADWLKASYQISPSIRYTDFKQGDDFDYEYFDRRDLSKPSTALDRKLLATVTDSDYANYLVGDFTDYGLAFLADYTIAEKLGVLLGARYDYLDLNSTQVGEKRRGTPADVVASETEDGTSWTASISYKTDFGLTPYITKSTQATIVMGQGSEISPDLINGGNAIADSELEEVGVKGSFFDDRLYVAAAWFEQTRTNYSAQDQVSNNTTESKGYELEARFLITSNFTMTAAMTHLEITNLTALDGGSQFGFLGAGDLTGVTDPSLFYGYVMKGLNGVASEDDAKKSGIPENMYSLTGAYDFGNGIRFTASAVKADATYSGFSRAIKLPSYTLLNAGISYTTDEWTFGLQGKNLTDERYFRANFPDLFGSTIVLPELPRHFVATASFKF

SEQ ID NO: 668 - protein, 887 aa, Escherichia coli str. K-12
MDSVMRPLRRCANGSVACDISRGRRRMMQSQRLTASPPGNPMHIDHRRGGRLALAIFVATHAPWLYAQAQSDAPAERTEPATLAALTVTAQKREEALQDVPIIVSVLPEQLLLDNGVHDIKDLQVLVPGLIVTSTQSAAQTTARIRGIGTVGDNAGLESSVGVVIDGVPRARNGVGFSDLGELERIEVLKGPQGTVFGKNTSAGVINVVTRRPSFTRSAEAELTAGNYGAFGLAAAFNDAVGETSALRVYAAKRRRDGFENVVTGAGPRTATDDGDQNLETGRIQLLWEPSHELAINIAADATNRNENCCVTVTTERGPTAAILNALTPGGQGTIGQADPSRRLAYSNRSTAQDIRDRGVSAQVDWTTPWLGAPVLTSITALRDWTSVNGLDFDFSAADVLYRAPQQDEMLTGFRTFSQELRLAGSSEQLDWMVGAFYADETVHRNESYRFGTAYEPYLSTALLGRINPALAARADAPRFLADATGLPTGSLFRGQGSQDRFRQDGRSVAVFTNNTWHATDALDVVVGLRYTYEHKALASSFENPDGSPACASYFAANGQLDPAAARRIGAALTARGVPAAAVPSIAPQVVGFSCLPWSNVAHDGRRTQQQLTEREWSGTAKLAYRWNDALMTYVSAARGYKAGGFNLDRVQSADGLSTGVQGIVPVDDTAFPGEFVDSYELGAKTTWLGGNLLLNAALFYQDFSDFQLNNFLGTSFVVRAIPTVISQGVDAEVLWQTGLPGLMLQGGLSYTDTAYGQDRLPDADLALLPGSRTSFAPRLSGNLALSYEHAIGSQLIGRANLGAKYSSDYNVGTDLDPQKLQPSYTIVNARLGIGASDKRWQLEAWAENLGNVTYRQVAIDAPLQAGSWNAFLGAPRTFGMTLRLRY

SEQ ID NO: 669 - protein, 838 aa, Escherichia coli K12
MHRRRSRAQLVGFTLSALAFAIASERLQAAEADTTEHVQVVGQAASIDNALKEQRSSDSIKSVVHADGVAQLPDQNVAEAVQRMPGVSVERDQGEGRFVTVRGLAPDLNSVTINGTLVPAPESGRRAVALDVLPAELVQSLSVIKTLTPDMDANSLGGTVDVESLSAFDHKGLFYTGSSEASYDKNTHQTSPKFSGAASNRFSLGDGIDNFGVAAALSWQKRDFGSDNVETGGDWDGSRLQSFEQRDYDISRERTGGGLNFDYKPDDLSKYYLRTLYSRFKDDEVRTTNGFEFANAQSAGQTGDAEGTRKLKARTETQEIQSYVFGGERMVGLWTLSGQAGYSESSEDSPSHIAGATFVGNDDFADTGFYDRDKPRPIVDPSFYDNSNFTLDKVDREKQYTKDTEKNVRLDLARDYDFKGYASQFKFGGKVSRRDKSNDLEVWKYDDFDDQGFSDQQLNLTQFQKGTIDYRLGNFGSGISPTAVKGLIGGLNAADAYDASESRANDFKINEDINAGYFMNTLDVDKWRFIAGLRYEGTEMNAKGTGVRDGAFESSTTNRRYHHWLPGLHARYQIDKSTQLRAAWTKTVVRPTFGQLAPGFVIDDDEASFGNPNLKPLESSNLDLGIEHFMGRAGTVSAFVFYKDIQNFVYNTDLAGTGQWANFSEANTYANGDKAKLYGLELAYSQKLDWLPSPWNGLLLGANATLSRSDASINGFDQSTGTNRKRDIDLPSQSKTVGNVMLGWENDKLSLRLSANYKSAYLYELASIGDKDHDQYVNAQTFVDFSARYSLTKNLKVSFEAQNLTDQPYFVYSGHRAYNGQYEEYGPTYKVGLTFTHF

SEQ ID NO: 670 - protein, 731 aa, Escherichia coli K12
MLLLFCASLSAQNLTGTVTTQAGQALENVNIYNLNNGKHTHTNANGSFVLSSVAVSDSIAFSRLGFATQHLVVNKRNGINISLAEASTSLDQVLLTSEVNSLSSVVAVDLKLNPVKSSQEILRKVPGLFIGQHAGGGKAEQIFLRGFDVDHGTDVAISVDGMPVNMVSHAHGQGYADLHFVIPETIDNIDFGKGAYYADKGNFNTAGYVDLRLKESLDASSLSLEAGQFNTSRLTGMFSLIDEQNHSAYLASEMYLTDGPFESPQDFNRINVLGKYTYTDANKDKITLTASHFQSKWDASGQIPQRAVDQGLISRFGAIDDTEGGQTSRSNLTLQHLKNLEHNAVLKTNAYLSKYDFELYSNFTFFLEDPINGDQIKQKEERFIAGLQSTYERKHIALGETRLDYQAGVGFRYDNIDDVSLSHTLNRQTVLEPLALGDVDELNAFAFLNTEFKTGKFTFNPAVRLDYFKFDYYNKLTETYDNQSESKVAFSPKFNTVFAPSQNWQLFLKTGIGFHSNDTRVVVANGGEEILPAAYSADLGTIIKPMPRLALNATLWTLFLDQEFVYVGDAGIVEPSGKTRRMGVEAGARYQLNDWLYVFADANYTHARSTEEADGEDNIPLAPKFTSAGGLSVDNLSGFSGSLGYRWLGDRAANEDNSIVAEGYFVTDFNLNYTIENWTLGVIVENLLDTSWNETQFATESRLFNEPAPVEEIHFTPGTPFYLRGKITYRF

SEQ ID NO: 671 - protein, 233 aa, Escherichia coli K12
MQAIPLLKTEKHNRIRLTADSRNDYYNGYMNSLAGAGWNVGGTLVADKVKDLIIFDRAHGQSGTASKDGGIITRNVDARLFTAQAYARYNFNPHWAAGIKAAYNYGHNETDGRPPYQIRPFEAAVQADYKNYFAHGSYNIGAATRFVAKQTRGDFDMASGLGIDKREAAKGFTVADVYAGVNIKDKYGLRLGVNNVFNKKYVEYISGDHVLALSPSVVYAPGRTYWLSLHAAF

SEQ ID NO: 672 - protein, 685 aa, Escherichia coli K12
MKCKAFKKSTIAAIVSSLLISSAYAAADAESSEPIERITVYGEKIERSLKDTTSSISVIDKETLDSGQYQSTSSALSEVPNVVVLSGSVPDIRGVSGNGSASGFNSFTGGARARVSTLVDGVAEPFVADLSGDTGLWDIQQIEVFRGPQSTINGRNSIGGTVFIKTEDPTFDWQGAARVGYRDQDNFIDSAVMLSGPILDDELAFRVSGQNVTGETYNKGLEYPTNPATFDQNELITNRWRGKFLWQPSAIEDLKVLYSLSYNDEKGDSGRNYFTGDDPWAYKPIFQRYIETKSTTHSVKVDYELGEGQAFDLIVAYMDYNWGFESYEALATAQQYVDMKDKSYTVDGKYSFGLKDKDFNGFVGLAYFKRSQDFGSTGSSIYSGDDSTKSASVYGEVTYGLADSLWITVGGRVMREEQLRNFTMLYQGSQLLEKLDDANTVTLPKLVLQYALNDNTTLAASVRRGYNSGGGALSLVESEYYYYDEEFVNTYELSSRSAFANGDVNLSANLFYNDFDGYQASNSARKITNIDKAVSYGVEAEFSAMLTENWQFISGVGLLDSEIKQADPSYGDIIGNQLNSAPHVTANAGLKYWLSDAFSFGFAGHYVGEYFADINNTESRVAGDYVVARVSLDYQTDSWRVSGFVNNLFDEQAMTVNEPASRSYPDGYAAIIDPRNIGVSAMYRF

SEQ ID NO: 673 - protein, 574 aa, Escherichia coli K12
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGMVLPELKDIQKVSRAIAFAVGKMAQQQGVAVKTSAEALQQAIDDNFWQAEYRDYRRTSI

SEQ ID NO: 674 - protein, 854 aa, Escherichia coli str. K-12
MRIVPTLFLFCVCVSIKAQQQNMTEMKKAIGLMQRMYDITFVYDSSLVTAKPQAFPSAGNSLKENLERIFGGTDIKWEIRDEYVLLFRPNNYTFSGYVCEDSGETLINVTVLDLNTLKGTLSNEHGFFSITLPEGKHKFRFSYIGYQDVVKEVDLSSNYNGVIYLKESSTSLKEVVVVADMNAPLRTTQTGKVSLTSEQLNTEFSLLSSPDLVKTLQNLPGVASGTELLSGMYVHGGKNDENLFLLDGTPLYQINHLGGLFSAFNTDIIKNVDFYKSGFPARYSGRLSSVVDVRTKEGSMKEFHGTFSLGLLDGRVQFEGPIIKDKTSFNIAIRRSWADLFTAPVFFLLNRSNPDDKKNVRYAFYDINGKITHHFSDNNKLSLSVYSGNDLLKAKAQQVFDKGEHYDSDFKAKWGNLTTALTWNCQITPKLSGSFTGAYSRNISMYDYVEVSRFFSDGEQTSMTGVERSNHSTIDDMGYRMEFDYRPGTNHHIRFGSNYLHHIYHPQNTASRNQTDRDTLSAESASSYKGNEVAFYAEDEMRLSSKAKLNTGLHYTLYQTDGKIYHSLEPRLAMSYQCSKKATMKVSYTEMSQFAHQLSNTYLNLPTDSWVPSTRKVRPMRSRQVAAGIYTELPRHIRLNVEGYYRTTSQLLEYDGGNSLMLPADNWDNLVKTGKGKSYGVELSLVYKDCYNVIEAGYTLSWSLQKFTDFYPDWYSSKFDNRHKLNIAFRHKFDDHIDAYAAWVYRSGDRATVPTQYVNGPSFPGTPDSSEPELIYEKPNNITLPAYHRLDLGVNFRRITKRGFERIWNISVYNAYCRMNAFYTRIERLPDGGFRGKGFGIFPIIPSFCYTLKF

SEQ ID NO: 675 - protein, 171 aa, Escherichia coli K12
MRYSKLTMLIPCALLLSACTTVTPAYKDNGTRSGPCVEGGPDNVAQQFYDYRILHRSNDITALRPYLSDKLATLLSDASRDNNHRELLTNDPFSSRTTLPDSAHVASASTIPNRDARNIPLRVDLKQGDQGWQDEVLMIQEGQCWVIDDVRYLGGSVHATAGTLRQSIENR

SEQ ID NO: 676 - protein, 206 aa, Escherichia coli K12
MVILLPQSVFYGDCLLISIELFTSKELYMQRIFSPWIMAALLFSPALAVAMENHTLSVGYAQTHLSALKNSASKDLRGLALKYRYEFNSDWGVLTSLTATRHEVQNYKWDAGKLHKDGDNTTSYSSLMIGPTYRFNDYISLYGNVGMAEMKIKNRDNHSSSENAFAYGAGVIFNPLTNLSLGLSWETAKLLFVDTNTFGVSVGYRF

SEQ ID NO: 677 - protein, 438 aa, Escherichia coli str. K-12
MKRFNKTILAVAVTLASSQAMAAGFQLNSQSATGVGRAFAGDAVIADNASVLSRNPAAMALFDEKQLSMGLTYADVEVSVKDVYIDSLVGPIHYGHVDDAAEAKIIPNFYYVSPVNDKFAYGVAMFSNFGTGTDTTPMSQQLVNGLPAPLDLLGKTEVTTLNFNLSASYRFNDHFSVGAGVDVIYGQGTLTRGGLVPTQAGAVQQDLVDVDADGVAFGGIIGAVYEINADHRFGMSYRFSPDFKATGDINMYNPVAGANVAFDEINIPMPDIFQVAGFHQLTEKFALHYTAQLTTWGDFKEITVTDGTIGGVPVAPEASLKTYAWDDSWLFSVGGTYTLNQDWTVRAGYMFDQGVVGEVSSISIPDSDRQWFTAGATYNLGKHASLDFGVAFIRGEDVDLIEHSAITGGLPIGPDTGMVHATTRSNATYYSMQYNYKF

SEQ ID NO: 678 - protein, 68 aa, Escherichia coli str. K-12
MNQNIQNAVSQVKATHKPTVTNTNNYGQMYGMDAMAWYKWFFGKKKNFGFRSYGYYSYNHANLSFVGI

SEQ ID NO: 679 - protein, 168 aa, Escherichia coli K12
MMSVTLPATAELASFHQLNDQWAIHASINWTDWSSFKELTAVFPEKSDLIKSENWEDNYRFALGTTYQYDAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 680 - protein, 409 aa, Escherichia coli str. K-12
MLPRAGDASRPIHSNETIMKKYLAIPAAVACLLASAAHAQSSVTLYGTIDAGLDYISNQKSAAGAGPVYGVQSGNVSTSRWGLRGNEDLGGGLAAVFTLENGFNVANGKLGNGGDEFGRQAWVGLASRQWGTVTLGRQYDFLVDFVAPLSATGSGFGGNLVDHPYDNDNLANDTRMNNAVKFRSANYGGFTFGGAYGFSNQGGGFSNDNAYSVGAQYVNGPVDLAVAYLQSNQPGGVDAPQNTGGSLSSADGDAMLTGGRWRTFGAGAHYAFDHAAIGFVYTRTILNDPRELSQGGAYGRVNGQLLTFSNYELNGRYFLTPALSLGGAYTFTQGRFDDAGRGIAPKWNQFMLQADYALSRRTDLYLEGVYQRVTGADGVAVLGHAGIFNLAASGNDRQAVVAAGIRHKF

SEQ ID NO: 681 - protein, 730 aa, Escherichia coli str. K-12
MTTAVTQAIIDGFFDASNGDPFATLGMHETEQGIEIRTLLPDANRMVVIERESGKEITELDCVDERGFFVGVIPNCRQFFAYQLQVFWGNEAQIIEDPYRFHPMIDDLEQWLLSEGSMLRPYEVLGAHFMECDGVSGVNFRLWAPNARRVSIVGDFNYWDGRRHPMRFHSKSGVWELFLPKASLGQLYKFELIDCHGNLRLKADPFAFSSQLRPDTASQVSALPNVVEMTEARKKANQGNQPISIYEVHLGSWRRNLENNFWLDYDQIADELIPYVKEMGFTHIEFLPLSEFPFDGSWGYQPLGLYSPTSRFGSPEAFRRLVKRAHEAGINVILDWVPGHFPSDTHGLVAFDGTALYEHEDPREGYHQDWNTLIYNYGRNEVKNFLSSNALYWLERFGVDGIRVDAVASMIYRDYSRAEGEWIPNQYGGRENLEAIEFLKHTNWKIHSEMAGAISIAEESTSFAGVTHPSENGGLGFNFKWNMGWMNDTLAYMKLDPIYRQYHHNKMTFGMVYQYSENFVLPLSHDEVVHGKYSLLGKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVLAFERRSSNGERIIVVSNFTPVPRHNYRIGVNVAGKYEEILNTDSMYYEGSNVGNFGCVASEQIESHGRENSISVSIPPLATVYLRLKTK

SEQ ID NO: 682 - protein, 843 aa, Escherichia coli K12
MTTLRSALSRGAFAALLTGSALALSAPALAQEGPAVDGQAAEEAGEQGGIQDIVVTARKRNETTQDVPVAVTAISAATIQKYDLTSLERIAASTPSFVVGRSPSGSGATLVLRGIGSNTTSIGLEQSVAVIVDGAYYGQGRTINEGFFDLGRLEILKGPQALFFGKNATAGVVSITTADPGDRLEVIARAGYEFRAHQMVGEAIISSPLTDTLGVRLAVRGSKMNRGYFKQLGTDQTYPTLDRTSTSQVVTPTNHVSGPAGDGRSEEFYVRGTVKWEPTDQFTATIKANYGTNKTDNPAAASVYYNCPTGKTAGNPAIPCARAFQSSSNRFPSALAASVPYANKDGQTGNQYKSWAVNANLVYEMDNVTLTSVTNYNWNRNIFQFDADSVSRSGAPGVFASEWSTFHAFSEEIRALTSYDGPVNLMVGGYYQKTKRDYLAWTASGGLENSSAPQPYQRYLANSKDSGTDGKTVAGFGQVIYKPVDRLELTGGVRYTHETKDSYFLQPYSHPIRVTQGIFLPGQTIVSNQSFDDWSPEVTFSFKPTSDINIWGAYKTAYKSGGFSNSGILSPNAGLPDFEFDPEKARGLEGGIKTMLMDRQLRFNVTAYTYKYTNLQLDFFRSDIFAFTTINAGSARTRGVEVDFEFAPRALDGFDVHGSVNYNKSRYGNAIGAPCYAGQTRAQGCNLVYVDDGTANGTARPFIAGTDTVANRQNLKGQSTANAPQWTATLGMNYDARLPGGLTLGMGVDARYSDSYLASAFGNPATRQGSYVNLDATLRLRTEDDRWELAVIGKNLTNRWYATGGTDAPNTGSGTGGTTGVIADQIGFANLPRTVMVQATFKY

SEQ ID NO: 683 - protein, 882 aa, Escherichia coli K12
MLAKNFKKSLLAVNIGLIMTAGLTGTVYAADEVKVKEDVEVIEVRGIRRSLEASMNTKRFANAVVDAVSAEDIGKFPDNNVAEALGRVPGVTVSRQFGEGSSVSIRGASNSLTLTTLNGQNVASAGWYSQQAIDRTFNYSMLPPELIAGMDVYKSSQADLLEGGVGGTVVVKTRKPLDLDALTVFGSAKATKSSIGDETDPALSALVSWKNDTENFGILGSIARSDYSLERRGVEALPNWGGRIAPTAFVQERERTAVDFVLQYAPTENLDFGLHYMNLELGADGVNNQVWVPQNLSDACEKNADGVEIKCTTDQAWVTENGLGGNGYYDVRPRNATMETELFAFDFKFQGDGFKVEGQIGTSEATGGTNFETNVAYISGVGGAVGTIDATGNVIDLDLVDKSFPLPSAGEYVGWEGLQPNSIVNEPRTDEETYAQIDLEFDTDFGLITSIKTGARWSDHDVVRDQNRPILKGFDGDAQAALVDSSRFVNGTIAAGMDNTSIPKADGGAMVAYSKEFIDGWVRARSGYASLNEESIALYVMANFQGDNFRGNFGLRYVSTDASSTAYALDPTLVDTVNPINNGYSMNTVTEDHDYSEFLPSVNIAYNYSEDIIIRASASTVISRPNYNDMFANSALSGYADNDPQNQTVVKGTPTLSPFKANQADLGVEYYFSPSSLVSAAIFWKDVATFTTFSQVADQAIGIVDPGTGEDSWLLQSYKDGDGGDVLGLELQLQHSFDNGFGAIVNYTYADANANAENFVDHNPIFSDSSEHTVNTVLFYENDDFSARAAYSWRSEYMIRETGFYGAREHQDFGTLDLSATYKISDNFTVIADITNLLEEDSVQIGNHQKWGGSDAKRFSKGYPAYAYQGEARYSLGVQFRF

SEQ ID NO: 684 - protein, 650 aa, Erwinia carotovora
MLLLSGSVLLMASSLAWSAEFSASFKGTDIQEFINTVSKNLNKTVIIDPSVSGTITVRSYDMMNEEQYYQFFLSVLDVYGFTVIPMDNNVLKIIRSKDAKSTSMPLATDRQPGIGDEVVTRVVPVNNVAARDFGRSSRELNDNAWRGTCGDYEPANVVVMTGRAGVIHAVMTIVERVDQTGDRNVTTIPLSYASSTEVVKMVNELNKMDEKSALPGMLTANVVADERTNSAAGFGEPNSRQRVIDMVKQLDRQQAVQGNTKVIYLKYAKAADLVEVLTGVGDSIQTDQQNALPALRKDISIKAHEQTNSLIVNAAPDIMRDLEQVIAQLDIRRPQVLVEAIIAEVQDADGMNLGVQWANKNAGVTQFTNTGLPITTMMAGADQFRRDGTLGTAATTALGGFNGIAAGFYQGNWGMLMTALSSNSKNDILATPSIVTLDNMEATFNVGQEVPVLAGSQTTSGDNVFQTVERKTVGIKLKVKPQINEGDSVLLEIEQEVSSVADAASSSSTNLGATFNTRTVNNAVLVSSGDTVVVGGLLDKSTNESANKVPLLGDIPVLGYLFRSNSTETKKRNLMLFIRPSIIRDRSQFQSASASKYHSFSAEENKQRNVSNGEGGLLDNDLLRLPEGGNAYTFRQVQSSIVAFYPAGGK

SEQ ID NO: 685 - protein, 795 aa, Proteus mirabilis
MVRRQLQRISLGSLFLIIGAISIFAQPKIMVSGKVISKEKQEVVDFATVYLKGTTYGCTTNEEGIYHLHAPAGKYTLVVSAIGYETIEKPITLVHGERIKMNVMIAPSVTELDEVVVVSNGVSRVKRSAFNAIAVDTKEFQNSTKNLSDALAKAPGMKLRESGGVGSDMQLMLDGFSGKHVKIFIDGVPQEGVGSSFGLNNIPVNFADRIEVYKGVVPVGFGTDAIGGVINIVTNKKRRNWFLDGSYSYGSFNTHKSYVNFGQTFKNGFTYEINAFQNYSDNDYHVDAPVEDFETGRIDKDKRVRVKRFNDTYHNEAVIGKIGIVDKKWVDRLMLGFTYSHMYKEIQTGVRQEIVYGEKHRKGHSLMPSLEYNKRDLLIKGLNVALTANYNKNATANIDTASYKYNWLGDRKLMNSPGEQSNQYSRADNNNWNGTLTVNYRLAKIHMLTFNHVLNTFRRSNTSLLAKVESEDAIAKETHKNISGLSYRLMPSDNWNLSVFGKYYSLYVAGPMATTTNQDDYVRTTRNMNSIGYGAAGTYFILSGLQAKLSYEKAYRLPTIEEMFGDEDLEMGDISIKPESSDNLNFNLSYNRTFGRHSVYMEGGVIYRNTKDYIQRNIADLSGGKYAAKYINYGKVLTKGYTVSARYGFGNWVSIGGNFTKMDVRDNMKTSISSSAENLAYKERMPNLPYMFADSDVTFYWRDLGRKGNMLTVSYDNQYLHSFTYYSSRIGSNKGDYVVPDQFSHNISLSYSLQKGRYNVSLECRNFTDEKLYDNFSLQKAGRAFYGKLRVCFGN

SEQ ID NO: 686 - protein, 601 aa, Legionella pneumophila
MGLDQNTVAFEQERERSAIAATFQYAPSDSLNFVFNAMDMQMAADNTNYALWFTQADTSWSGAPGSGAWDNTEWLGGCGLCGGDKPDASQSGSQVAGPVNLAYWQARPREATMKSQVFDLKMEYSGDGYQFTTQIGDTSSTGGTDFEMVVEDGLGGTALNGATYDFTNGHQTWDLNGFDTATYDPGSLVMGTGSNFNKTPKTDDETYIQADIKFDVDLGVVNAIKTGLKYAKHNTTSRRFDFVQADDFNPVISTAGLNTGTFAVGTSEYDIIRFDPDALKDWAKSSIIGETEDFGSYREIDEDNYAAYVMANFASEGVRGNFGVRYAGTEATSTYYVDGKKTDSSANYGEWLPSLNVAFDLAPDLILRASAARVMARPQYDDMYVNPNVLGANDDVPNNQKWVVGNIGLKPFIANQIDLGIEWYFNEESLLSAALFMKDVKNFVTFSEYHADSADIPFTGTLKPDEVAGGWTVQEKANGESATIQGLELQYQQDFGNGFGSIVNYTYTDSETSENTYTDRNPFLSDSSKHSYNLTGYFENDLFQVRLAYNWRSEYMIRETGSYGNRLHDAFGSLDLSAIWHVTDYMDIKLDGNNLLEPEFR

SEQ ID NO: 687 - protein, 388 aa, Vibrio cholerae
MRKIVCLSVFAAAVFGAPSAYAQNSVTLYGVIDVGINWQSNAGGKHLFSMVDGMAGANRFGLRGTEDLGGGWKTVFVLENGFYAINGATQFTGMFGRQAYVGLSNAQYGMLTLGRQYDSLVDTLQQYSIVVKLGGAMFFHPGDVDNIGDSHRVNNAIKYTFKRGPLTATALYSMGGVAGQSGRNQIWSAGVNYAGPSFSLGAAYLDVRNPNVSFFPVNNVGASASLDNIGPKPVFSGYASAATYRVIGLGGHYVFDPVTFGIVYTNVRFGGLGDTSSGPNPLGYTGSAIFNGVEVSADYRLSRSLSAGVAYDYTRNNGASGKGAATYNSVMGGVDYSLSKRTDVYLVGIWQSMTGVDSAGGSEAQASLFSPSSNGREAIIRVAMCHRF

SEQ ID NO: 688 - protein, 986 aa, Burkholderia cepacia
MDNLRKTLGCLLLFLFAAVTSTYAQVAKQYSGTVTDADSNEPIIGVNVTLKDAQTGTVTDISGKFSISAPVGSTLSFSYIGYVTKEVKLGTNTSLKITMQEDQNQLSEVVVIGYGAVKKSDITGAVASVSSKQFKDQPVKRVEDILQGRTAGVAVTSVNGLPGGTVKVRVRGTTSLNTSNDPLYVIDGIMSGGLDVNPADIQSIEVLKDASATAIYGSRGANGVVLVTTKKGVEGKVQIYADVAIGVSNILKKYDLLNAYEYATALKEYNGISFADDEMEAYKNGSKGIDWQNLMLQTGISQDYKLGISGGTAKNKYLISANVLNMTAMTITTKYQRAQLRINLDNELTKWLTLSTKINASRTHSHNGGIDIMNFLNYSPTMEMKDPVTGVYNMDPYNSVNGNPYGARVANYGDSYVYALNTNMDLTFKIMKGLTLSVQGAANYSHVPSYSFTSSLAKPGQISGMENASRMNLFWQNTNNVTYNTSFGDHHLTATAVFEASGAEGRNLKLTGSDLANEFVGYWNAKNAKTRDGENGYSAEAIVSGLGRIMYNYKGKYMLTGTFRADGSSKFQKNNKWGYFPSAAVAWDVAKENFMSKQNIVQQLKLRASFGVVGNQSIGAYTTLGMLAPTNYDGYGSDAIHTGYWTGNLATPDVTWESTYQYNIGLDASVLDGRLSFTAEWFRKDTKDLLLRKPAPQYNGGGSFWVNQGEVRNSGVEFTITATPLTDKDIFGWETSLNASYLKNKIIDLAGSDFIVGENYTSIGGGPIQIKKVGYPIGSFYLYEWANFNDQGANLYKHQSNGSLTTNPGADDLVTKGQAEPNWTFGWNNTFTWKNWTLNLFINAALGQDRLNVSRYAMGSMTGVYRFISLSDAYYKSWDKVANKADAVYASHKNSDNRNYPDSDFWLEDASFVRLKNISLTYNIPKKITKVADIQLSVSAQNLFTLTKYTGMDPEVYSESDYGFNGVDMGSYPVPRTFTFGMKLNF

SEQ ID NO: 689 - protein, 254 aa, Brucella abortus
MTASPTSHPSSRIRFIMIKRFALPSTLALLFSGAAFADTVAVPETKKTAELGDAGYYATGRIIGAFDNAVNMELTSPRVASRVGGPDTGSNVTGSLGLGYQFGNGWRAEGEYVFKRTNNFTSYWAPFDANANEFHVSAQRLMLNGYKDFDLGRGFSVYGTLGIGVAIVSADGWQTNDTRRFASKTQTNLAYSAGAGVSYAINKRFSIDLGYRYVDMGNVETGFNTFANRVNARDEQLKSKLSSNEVFIGLRGRF

SEQ ID NO: 690 - protein, 837 aa, Erwinia amylovora
MVEGLLGSPRLSTPYRLKNCFTKVMSMRDFHRTRPNSISNFPLSKLACLLTLGILSPQVSAVVLNNQTLTITPADAPTNYVLINQSVLTVDGAQTTSIGVTNSQLNVLSGTSQVTNGTAVGLTDSRASIANATITSANGVGLALTHAAGAGSTAVVRNSQIQGGTAAVQVNAGGSLDISGSQMTATAAGGNGLRLQGGTAQVSGSSIVGQGAGVLMLTEVARPTVATLRLDGSDVTSTAGPGVDVRTRSDAVIDLSNGASIKAGNGTAIQVAGFSNLALTASDSTISGNVNVLAGGKANLALQRATLTGDVIVGEGSDVAVALADRSQLTGNLNVLAGGKANLALQGATLTGDVVAAEGSDVVVALADHSQLTGNLQQVRALTLDSGAQLTGTTIGLGQASIGPDSIWTLTGNSDVGKLSMGGGTVVFGDTPSFHTLTVTDLSGNGNFHMGGDFVTGQADQLVVTGTSSGNHGLLVASTGQEASVESLSLVRTADGGAQFHLLNDRERVDVGAYSYELSQDGNDWVLNRETRTVAPITMAAMALFNTPITVAYGELSSLRSRMGELRYSEGRNAGVWMRAYGNQYNVSGASLGAGYQQNQRGLSLGADMQLSDSDWLVGVLAGSSRSDLNLDYGTSGTVDSYYVGGYATWLDRETGFYVDTVLKYNRYQNNAKVGMSDHTRSKGDYDTHGVSASVEAGKHIKLNDGYFIEPFVQVATAAVAGKDYTFDNGLRAEGDMAKSLLGKVGTTVGKTIPLDGGAMVQPYVKGAFAHEFAQRNQVQVNNNVFNNDLSGSRAELGAGVSLALSKQFRVHADVEYSNGKNIEQPYGVNVGVRYDF

SEQ ID NO: 691 - protein, 791 aa, Pasteurella multocida
MKKLLIASLLFGSTTAFAAPFVVKDIRVDGVQAGTEGSVLATLPVRVGQRATDNDIANVVRKLFLSGQYDDVKASREGNTLVVTVMPKPVISNVVIDGNKSIPDEAIKQNLDANGFKVGDVLNRAKLEEFRKGIVEHYNSVGRYNAKVEAIVNTLPNNSAEIKIQINEDDVALFKEIIFEGNQAFSSSKLEDQMELQTDAWWKLFGNKFDQTQFNKDLETLRSYYLDRGYAQFQILDTDIKLSDDKKEARVIIKVKEGDLYTVKSARILGDVGGMSAELAPILDAIQLNGLFRRANVLEVEQRIKSKLGERGYATAQVNVHPTFDEQDKTISLDFIVEAGKSYTVRQIRFEGNTSSADSTLRQEMRQQEGAWLSSELVELGKLRLDRTGFFESVETKTEAIPGSDQVDVIYKVKERNTGSINFGIGYGTESGLSYQASIKQDNFLGMGSSISLGGTRNDYGTTINLGYNEPYFTKDGVSLGGNVFFEEYDSSKSNTSAAYGRTSYGGNLTLGFPVNENNSYYLGVGYTYNKLKNIAPEYNRDLYRQSMKYNDSWTFKSHDFDLSFGWNYNSLNRGYFPTKGVRANIGGRVTIPGSDNKYYKLNAEAQGFYPLDREHGWVLSSRISASFADGFGGKRLPFYQYYSAGGIGSLRGFAYGAIGPNAIYRTRQCPDSYCLVSSDVIGGNAMVTASTELIVPTPFVADKNQNSVRTSLFVDAASVWNTRWKAEDKAKFAKLNVPDYSDPSRVRASAGVALQWQSPIGPLVFSYAKPLKKYQGDEIEQFQFSIGGTF

SEQ ID NO: 692 - protein, 1020 aa, Salmonella enterica
MVVMVAAFRRGLVGLSLLALTTAIAGPVQAAQAPSALVPVSAVRTPKGPLKAALLALGRQTGVQIIFTSRAVEGRQAPALDGQFSVDEALDRLLAGSDLEAQRVGPTVLVVRPRAVLVPASATSPTAPDPMASPPTDPIETAPPVQAVNDATMLSEVVVGSHIRGARDSASPVVILDRETLDRAGRTSVAEAMSNLPQAFNGSGSEDTTSTGADPLGTNSSRGVGVNLRGLGTDATLVLVNGRRLAGTGLKGDFADVSSIPMAAVDRIEVLLDGASALYGSDAVGGVVNIVLRKRYEGAETRALVGGATRGGATQWQFGQTVGHAWDSGNLVVSYEHSARDRLRGRDRDFTGNADLRDQGGTDHRRYYSQPGNILRANGSGVLVPTYAIPGGQNGVGLSPASFAAGQTNLENQQLAFDVLPRQRRDSVYLAFAQDLTPAIELSADARATRRDFTSRGGASITTLTVNASNPYFASPTGAASERIAYSFLNELGGQRVKGVADTLGLSLGGTARLPAGWRLETYGAYGLETMHSLTNNLVNSSALAEALGATPDNPATGFSTAASGYFNPFIGAGSNPRSILDFINTAFVDRKTRSDTRSINLKLDGTLWSLPAGPVGLAVGGQIRREGLKSGGQSLASGVSPIPIARKDTDRTVDAAFAEVRLPLFGGAFTRPGLRRLELSAAVRHEDYGGALKSTDPKLGVIWSPVAGATLKASYGTSFRAPALTELNDPQIFAPTTINTSGRETIVMILYGGNPNLKPETATSKTLTLELAPPDWSRFKASLTLFDTRFTDRIGQPGNEYIDRVLTSAEFAPFVTLVSPATNTADRARIQALIDDPRSYAQGVFPAEAYGAIVDGRYVNTGQLRVRGLDVSAQYQARLGGDPLVLSADLSWMMDYSRKITPGTPSVDRAGFVGEPADLRARYAASWTHGSLTTTASISQVGDLSTDGGGRIKGWTTADLNLSYRFGNGRLEGSGLSLNMQNLFDSDPPFYDSPLGVGYDPANADPLGRVVTLQLTRTW

SEQ ID NO: 693 - protein, 925 aa, Proteus mirabilis
MVNILYFLYKKWIFLLQNNIFMLNLSTLFFYVKKDVETVETKVVTNKLIKQITYLLPWSAVAFTHVIYAQTEMLDEIVVSGAQPHLAGSAIEHYQAISNQVIKKERLQKQSATLGNALAGELGVHSNPFGGGASAPIIRGQEGVRIKILQNGLDVVDMSAISPDHAVAADSLLAEQVELVRGASTLLYSSASAAGVVNVVDKRIPTAVPEKGYEGEIFTRFDTASQESTGTAGITFRLHPHLALRLEGLKRYSTHYRVPAFKSGGETIRYLPDSHNRSQVGTIGVSWIKDQSYLGVSYSERRDRYGLPGHNHKYDRCKSHVVDEAARPELGKGYLTPYPHLADDTDIVFAHLDGCIGGIDNDPSHSHDHPFGHEHDHSHGGPWVRLHSRRFDLRGQWDSPTAWLDKVKGSFSYADYIHYEYHSGQAGTDKFDRDSFIERERKKAEKNRGKAAGIYKNSGYNGKLEFYHTPIVGLSGVFGVQYSEYKTAILAPLGSGIKHQHHLVPNTQKQASFFAVENYVVDDFIFEVGARVDKQRIPIKYDQHVLNAHKKEGDHPPDLSTHKEKAVSYLGSVDWLFHPNYRIGLTLSRNERLPTPMELYYHGQHLATNSFEHGNKNLRKESSNNIELGFAYHTDKWDYKLSLYQNKFRNYIYNEDLARYGNAFLRRYTQARAKFHGIEAELNFRPTPDYQVTLFGDYVRGRLFDLPEQYGQRFYQGYIAYDEEGLIQANWEKQPYRIEGIKRNERDAPRVPPARLGMRLSGNVTEHLSFFADYTYVFSQQKTASSLSIKPPRALEASDFIDDDTGENLLLKGIDRDKYNRTGQPIADLSASDKADFESALEAIRLREENEKLPAKIEKIQEDPSKGHHLLNIGVNYQRQIGHLDYSVGFSVNNVLNQRVYVHTSYLPYVPQMGRNYVLNFGVKF

SEQ ID NO: 694 - protein, 241 aa, Neisseria gonorrhoeae
MKLKQAVVGTAMLAGMTTAAYAQSAGSFTVTTGWFHLAPQSSSKPLKVTSIGGSPTNITEPNTGATLSSADTIGLALGYFITDHIATEFVVGYPPSFDLNGSGSLEQFGKIGQAKQWSPTLLFKYYFNAPTATFRPYLGIGVSRIWFTDEKITNGAFQANVLHGPTSVTTDSSWEPVFNLGFTYAFNEHWFAGASVSYLPLSTTAKLNTQAKTPVGTLNVQSETKIKLNPIVTYVNIGYRF

SEQ ID NO: 695 - protein, 1057 aa, Erwinia chrysanthemi
MRNALNLRFCFLVTFLLFIPLMYALPPEGITIKGRVTDETLKEGVPGANVTVKGTSIGTITDFDGNFTIVAPSKKSVLNISFIGYVTQEIVVGDRTIINVSLKEDAQNLGEVEVVAIAYGNQDKRMLTSAVSSIDNKELIKSPATSITNLLAGALPGVSSVQTTGQPGKDAAAIYVRGVGSLNDSQSKPLVLVDGIEREFSQIDPNEIESISVLKDASSTAVFGVRGANGVVLITTRRGKAGKTQISASTKLGLQQPISLVEQTGSYEFARFWNMKQEMDHVTNPKLYFTPEQVEAYRTGSDPIMYPSMDWKKYIFNNIYLQSQNNLNISGGSDNVRYFISVGYTYQNGLLKELPGQMYDNNYRYNRYNYRANIDANLTKTTSMKLGVGGVLGKIQEPRSVVSGTGEDQNPWVIAQIWSHPFAGPGFINGVRTLIPKDMVPLGEVMRDGMFVFYGQGYNQTYDTTLNLDLDITQKLDFITPGLSVSVKGAYDNKFKLEKVRTGGAIEAQTVYYKSYFDTNGTMSQTDPDYDKSLIYVPSGSDTPLTYSESSGRGQNWYLEGRINYDRTFGDHRISGLFLYNQSRNYYPDSYTYLPRNYVGLVGRATYAYQSKYLLDVNVGYNGSENFAPGSTRFGVFPSFSAGWIATAEKFMENQKIVDYLKLRASWGRVGNDKGVDSRFMYMPAVWGSSGSYSFGVDNPISQSAAAISRMGNPAVTWETADKQNYGIDLKFFNSRLSATFDYFIEHRTGILISPESTPSIIATALPNLNIGKVDNHGYEVSLGWRDKIGKDFTYNVDANVSFARNKILYMDEVPKQFSYMNQTGGSTGRQTGVYNYIRLYQYSDFITGADGELTLKPELPQPYQKVYPGDAMYADLNGDHIVDGNDKSVAGYATRPEYVFGMNMGFDWKGFNFTMQWVGSKNVNRMYDIEYRIPYTNAGKRGLLTYFYDGCWTPENQLGATYPRPSEESESWNSEPSTLWLVDASYLRLKSLSFGYTITGKKFLKKLGLSSLGLNFSGYNLLTFSPLKYLDPESDPNRFGDYPLIKVYSFGLNLNF

SEQ ID NO: 696 - protein, 719 aa, Erwinia chrysanthemi
MPVSRPLSRRLPLAAAIALTLPLPALAVTPKPTELDRVQVKVSTATRSERLLSDVPIRTEVLRKEDIALRAATDFSRAAELINGLRVESNCQNCNTSEVQLLGLPGAYNQLLFDGIPLLSTLGGVYGLEQIPAGFVDRIEVVKGGGSALYGPGAVAGVINLIPPLPARSGGHVQAGVDVLKGTPQKNADVRLDLVAKDADAGLSLIAQRNWNSGIDYNGDGYTEITRKNLKVGGLQAWYAPTPGTRLRLDLQVTDETRRGGNRLDQPEYLANIAESLDTKYRRGSVSWDQEINADVDFRLAYAFADIDRDSFYGGLGDVVTDPSAPGYDPSQLDPNVAGSAASRSWRQYGRTQNPLHYIDSQLNWRLGAHALAFGVQYKHEALRDDNRTGDGQRLAVLEDATFHNLGAFIQDEWSLRDNVDLVLGARVDKSSELDSAVFSPRIALAWQATPNLKWRAGVATGFRAPEIFVEDVHVDTLGGEQVRVRNTDGLKEERALTTLFGFDWRSDPANPVWSWDATASYARIRDTFALGEIQRGDDGQLSQLRYNASGSNVLGAETNLGWQPSPQWRLTAGASWYRSRFREPQRIFDDTGDGGDTVIESRDYLKTPRWTGLAQLSWMPAEPWETFVALRHTGPMSVLNNRLGELHRTRSFLVTDLGARWHRHLGAQAQQEVSVAAGVKNVFDQRQKDLEVGALRDSDYVYGPRFARSWYVNLRYAF

SEQ ID NO: 697 - protein, 600 aa, Pseudomonas aeruginosa
MRRLLIGGLLALLPGAVLRAQPLDWPSLPYDYVAQGESLRDVLANFGANYDASVIVSDKVNDQVSGRFDLESPQAFLQLMASLYNLGWYYDGTVLYVFKTTEMQSRLVRLEQVGEAELKRALTAAGIWEARFGWRADPSGRLVHVSGPGRYLELVEQTAQVLEQQYTLRSEKTGDLSVEIFPLRYAVAEDRKIEYRDDEIEAPGIASILSRVLSDANVVAVGDEPGKLRPGPQSSHAVVQAEPSLNAVVVRDHKDRLPMYRRLIEALDRPSARIEVGLSIIDINAENLAQLGVDWSAGIRLGNNKSIQIRTTGQDSEEGGGAGNGAVGSLVDSRGLDFLLAKVTLLQSQGQAQIGSRPTLLTQENTQAVLDQSETYYVRVTGERVAELKAITYGTMLKMTPRVVTLGDTPEISLSLHIEDGSQKPNSAGLDKIPTINRTVIDTIARVGHGQSLLIGGIYRDELSQSQRKVPWLGDIPYLGALFRTTADTVRRSVRLFLIEPRLIDDGVGHYLALNNRRDLRGGLLEIDELSNQSLSLRKLLGSARCQALAPARAEQERLRQAGQGSFLTPCRMGAQEGWRVTDGACPKDGAWCVGAERGN

SEQ ID NO: 698 - protein, 343 aa, Pseudomonas putida
MPVKTTTVSRILFAALATAGASAALAQSSVQIYGRLNTSLEHQKVGANSLTGLLNNNSRFGFVGSEDLGGGLRAGFQLESGFESDTGAGTGSTGALAFQRQSEVNLSGSLGKLRLGRFGAATYFGIADYGALDEPNHDTGAIADALYDYVMRNTNKIAYRSPVMAGLTVEAQASLHEKTAGTVQKNGYDLYANWERGALALGAGFTQLGDDRQFALRGHYLWNALQIGAYYQRSDNGSGSLCSHGGAGCGSRDAARVTAVYRVGASEVALGYGWASRWSHVPGSSARQWILGYNHHLSKRTKLYAAYTRIDNGSGVAYGYNFKGGVGHGQDASSLSIGLRHAF

SEQ ID NO: 699 - protein, 861 aa, Escherichia coli
MIGGAGGLGANAGPGHNSGGGAGVYVVGNSALVTIINNGTITGGAGGLNSAWPDNYGATGGMGEGGAAGSIRTGGSQGTSSQGGAGIIGANIAVINNGTITGGIGGTGGLNAGVQNDAVTFQSGINSLTLTTKSVINGVVSANGNDDTLTLQNTLSKIDGGQSDGANISATQYKGFEHLVVNGGRWTVSGSAIVSGETTLNGGALVVTGPAALGVQAITAQGGAIEASGDQVLDQSFVLKNNPYGASTSGLVVQGADNLVLSGVLSDVGRLTKNGSGTLTLTGDNTGGGTTTVDVGALLQIGTGGTSGSLAGDIANDGTLVVDRSDAIGLSGAISGAGGLTKNGAGTLTFSGANSYTGATTVSAGILTLTGDNTGGGTTTVDARAELHIGTGGASGSLAGNIVNDGALVVDRSGVISGTGGLMKSGTGTVTLSGVNTYTGGTTLTAGTLAAASDNNLGGASGGLTFNGGTLQVMGTSWTSTNWAVSLQAGGGTFDIEDAANNFAVTQGVAGAGGLTKSGSGTLTLSGANSYTGATTVSAGTLTQGAAGGFSTASSRYDVDTDGTLDLGGFDTMLAALYNAGTINMNVGAAGSTLMVNGDYVGHDGTIVFNTVLGDDNSKTDKLMVGGDTAGNTNVQVVNRDGLGAQTVKGIEIITVGGQSNGVFSLVSDYRTKDGQKAVVGGAYAYTLHQGPARGANDGNWYLISQLEDIKPDNPATRRVSDTPDAPDTPAPRYSANVPVYEGYVQTMQALNKPSTLQERVGKRYMTGENGDGRTSGGMVDAHGIWARIQGAHDRLEPTTLTGMKQEINTFILQAGVDGQFYEDENGKLIAGITGQYGTARSNIVGGSLSRSNDMELWCAL

SEQ ID NO: 700 - protein, 766 aa, Escherichia coli
MRAFLLGSTCAATLAAATSPVLAQTNPRDAGAQAAPSSSPSRADGKQSAAELSEVIVTATRRSERLQDVPLSVTAFSQKDLTAKGIVGFEGLAREAPGVVLNKPTANFNNFTARGVATNGYGANLQSTVAIYIDELPISTIGNTTVLDPNLYDLERVEFLRGPQGTLFGSGSLSGALRILTKSPNLHERQASALVDFGLTGSDSLRQRYNLMVNTPLVEDKLALRVVGFYRHEDGYVDNVGTGVDNANTLVDWGGRATLLWAPTDRLSVKLLASYENSNPKDSALFSPSLGRNKRISDRPDLFVGKLTSYNATIDYQFDGAHLTSSSTYSNFDQKFFVDLAGTFNQAIAFGLDAYGYQKTFVEEARLASDAGGKFDWVVGGFYLDRRLDVDYFYRSSPKFLAARGITGLPDEYYQRLYSYANSHELAGFGELTYRFTDKVWVTGGMRYGSVDAQAFTQGGYNSNYLVNALFGITGPLTVTPLAAATGVKAEATKPSYKASLSFKPSSSLTTYATVSTGFRTPVVNAFAGRSSLVNPSDLVIPYGASSDDLKNYEVGAKGRWLNGRLSANLALYLIDWSNIQVQANRVSDQVQFATNIGAAESKGFEFEVLVVPSTGLTLGFNGSINDAKVTKLSPAEAAISGAIPGARLSSPHFQGSTYVNYAWDLSPSAKANMALSVQHVGSYPGSFPRVPGQPATVSPTYAFTQSYENVSATFAVAIDRLTVGVYGENLLDNHSITYVHPEAFLASRFATMRPRTVGVRLGYDF

SEQ ID NO: 701 - protein, 758 aa, Aeromonas hydrophila
MDLLDPVPRHLQCRRSRQKSFARGGSLSMIDRNTLLLLAGGLLLLCAAPTPAQQVAAVPLEVPRLDQIPTASTSAAHLAQQPAEPSQAQAPAQPDAEELDEVTVTGTGTYRRSRSSTATKTDTPILDTPQSIQVIPRQVIEDQGTVRLRDALRNVSGVYLQSTDGNIGEYFNIRGFSARSYTNAFLSSGTDSLLSLDTANIERVEVLKGPSSVLFGRAEPSGVVNYVTKRPLPAPYAAVAFTAGSYNFYRTTADLSGPLTSDGALAYRLNVAYEDANSFRGVQGRRVFFAPVLEWKIGPDTKLNFEIEHNRDNRVFDPGLFAVGTGVAPVPYSRLYADPRGLIFGYATRATAVLEHRFAENLTMRTGGRYANYLESFPLQFTPGELLADNRTLVLAYLEGNQFYENVAFQNDLVWRAQTGSVDHTVLFGLELSKFATGFAGTFGSANSIDIFQPPPYTYEFPPASERFPFMGNTTTSGFGVYLQDQISFSDNLKLVLGGRYDTVSAPFTDLLAGTVNPSEGQAFSPRVGLLYKPAANVSLFANFNQSFAPSFGRSATGTPFLPTRGTGYELGAKAELLGGRLFANLALYKIAKANVVTRDPANPGFSIQVGEQESQGIELDLTGEILPGWNLIASYAYTDAKISRDNTFPVGNRLPTAPLHGGSLWSAYRVSEGALAGWGVGAGVFAVGERFGDLDNSFSVPGYTRVDAALYYRRGWLNAAINFKNLLGTQYIEAATFRYAVHPGAPFTVQGTFEVRF

SEQ ID NO: 702 - protein, 400 aa, Pseudomonas putida
MKFKQTMVSLSVAGALLVMSGSAAASGFALIEQSASGMGNAFAGGAAIADDASTVFFNPAGMSRLSGKQIAITAHAITPSAKYTSAAGVPSGGDAGGTAIVPNGYFVMEVNPALRFGLGVNAPFGLQTEYDANWVGKQQAIKSKLETVNVNPSLSYQVNDKLSIGGGLDYQHIKGELSQDQGGAIGVAVINGSDSTWGYNLGALYQVDSTTRIGVAYRSTMSYTLSGSVATSLPFANGPVSLNIKLPDSLSISGFHQYSDKWDVMADVTFTGWSSFKQVKIVDGTGVTISNTPENWKDTVRVAVGATYHYNQHWLARAGLAYDQAPVSDEFRTARIPDNSRTWLSFGGQYKPSVTSAIDVGYSHLFLRDSSINSPTPAPALVGTYKNAVDILSVQYTYSF

SEQ ID NO: 703 - protein, 1004 aa, Escherichia coli
MLFCLAAIGGAQATPYVESGKPGDPASWRSNEFNAEWGLGAIHADQAYAAGYSGKGVKLGIFDQPVYAKHPEFASQGKVINLVTTGIREYTDPYIPVKKGDVFRYDGTPSVDSDGTLGSHGTHVGGIAAGNRDGGEMHGVAFNAQIISAENGDPGPEDGIILGNDGAVYQAGWDALIASGARIINNSWGIGITEKFDQGGKDPAYPHFTLADAQKQFDQIKQILGTKAGGAYQGAIDAARSGIVTIFAAGNDYNLNNPDAMAGLAYFVPEIAPNWLSVASLQDPNNTGDYSISTFSSRCGYTASFCVAAPGSKVYSSIIEGNSVDNLTTGYAKYSGTSMAAPHVAGSIAVLMERFPYMTGAQVASVLKTTTTDMGAPGIDALYGWGMINLGKAINGPGMFVTEQDIPEEFRVSGAYGPEQFVVNLPGVGAVLDKGKPTERVCDDTHCGLDVWSNNISGHGGLTKQGIGTLVLTGNNSYAGPTLINQGLLAINGSVTSNVTVQNAGVLGGSGTVGSLTARSGGTVAPGNSIGTLNVTRNVSFEPGSRYAVEVAPNGQSDRIQSSGSATIGGGEVVVLQEQNANLLSQGSVSSLLGRQYNILTAQQGISGQFASTSTFSPFLGAGLTYQPNQVTLNVGRNDTSFASVAATQNERAVAAAADALAAGNPVYESILNAGSTGEARQAFRQLSGQIHADIASAQVNDSRYLRDALNGRLRQAEGLATSPDIKADDDGGAWAQLLGAWDHASGDANATGYQASTYGVLVGLDSALADDWRLGVATGYTRTSLDGGYGSNADSDNYHLAVYGGKQFGELALRAGGGYTWHRFDTSRSVNYGMQSDRETAKYSARTEQVFAEAGYSVKADWVNLEPFANLAYINFQNNGISEDGGAAALQGDKQHTDATVSTLGLRADTEWQASKTTSVALRSELGWQHQYGDLDRGTGLRFNGGNSPFVVNSVSASRDGAVLKASAEVAVNKNATLSLGYGGLLSQNYQDNSVNAGFTWKF

SEQ ID NO: 704 - protein, 720 aa, Pseudomonas fluorescens
MKPTYLATILAILLSPQLVVAEEVDSAETANIERMSVIGVRQRLEQAGTLANTIMKTEVINATTIENKNAVNLSEAIDNSPGVKVSNECSMCGVKRIMLNGMKGEQTTILVDGLPVHTMISGYYAVDAIPTTGIERIEVARGAGASLIAPEAIGGTINIISYEPTENGAELDVSAGENGYRKMGFLGKGVSEDGRTRATLVAQYDDRDQFDADHNKVNEAPQQENRSLTARVSQDVTDTDNLVLRIANIQSEIFGGPMLGSTFADGTASSIGNVLSGFDDQFSEPQQLFEDGDVRKPFTGKAWETTEWIKTERNEASLAWLKEFSDDWNMHLAASYAEHKQDSFYEGFDYTAEDKMWFFDARFNYLLTENQLLTFGADLRTEEMRSHSRAGSANPNYASDSFDYDVKGVYIQDTWQATEALEIAMALRYDTITADFTDPNKPGTELDESILSPRLDVRLRHNDEWTSRVSAGRGYRAPLSFFETDHGILDGSLGFDIDIDELERSNSASYALSYEGEKLTSTASIAWTEVEHLAALTTNDLGIPLLTQLDEKATVITSDIALGYRLTDDMTLSLTAEHFDYDSVFKSSYAIAPIEERLTLTFDWDVNDWEFFANVVWVGSRDLSKYGYEGYNRLDANGQVDPDSKKTTDAPSYLTVDLRVSYQLNEYLSLYSGVSNLFDYTQAGDEETPLFYDAEGAFDVGYIYGPLRGREIYAGMKLAF

SEQ ID NO: 705 - protein, 795 aa, Serratia marcescens
MIHRSRSLLAIAVVSAIWQLPAQAEETSARVDDDTRLGTVLVTGTRGTARTVLDSPVPVDVLTAEDLKTAGASGGELGQALQTLLPSFSFPRQSNSGGADHVRAAQLRGMSPDQVLVLVNGKRRHTSAVVNDSSKIGRGTAPVDFNSIPISAIKRIEVLRDGAGAQYGSDAIAGVINIILDDAPEGGEVSTSYGAYHTHQDAIGKTTTDGQNSVTTAKIGTRLGEEGGFIRGGTEYKDRNPTNRAGYDGFADTPGQRNYVMGDGVARDVNAWFNGELPLAGGKAYSFGTYNERHTTGAEFYRYPSEQPQFYPNGYLPQSLGDNTDISATAGYKGLIGDDWDFDSSVTHGRNRFESATRRTLNVSLGADSPTRFDTGDYELRQTTTNLDFSRELRLGSRSFVLAVGGEYRYENYLTFAGDEASYIGSGADGANGLRPSEESDLDRNVFGTYAELSGDLTDRFFVDAATRWEHYDDAGSKLTGKLSGRYKLTDQWALRGAVSNNFRAPSLAQSGFQNTTSNFGDGGTLTDIRVLSVNDPIARALGAEKLDPETSKNFSLGLTFQLNERFDASLDMFRIDVKDRITLSQRIGSDALESYINDNLGVPGVHDVNFFTNAADTSTDGAELVLNYHQPFYDGQLGLTTAYTYNHTKVTSTKGTPSQLTALGIGNDALVGVEERNTLTDAAPKDRFVFSANWTSEHWGLLGRLTRQGETTRVFDFGDSQPEQTYGAVWQLDAEVTYKFTPKFSIALGGNNLTDNYPERSGSAINYGGNLPYDVLSPIGTNGAYYYATATYGF

SEQ ID NO: 706 - protein, 701 aa, Pseudomonas syringae pv. tomato
MRKALMWLPLLLIGLSPATWAVTPEAWKHTAYAYDARQTELATALADFAKEFGMALDMPPIPGVLDDRIRAQSPEEFLDRLGQEYHFQWFVYNDTLYVSPSSEHTSARIEVSSDAVDDLQTALTDVGLLDKRFGWGVLPNEGVVLVRGPAKYVELVRDYSKKVEAPEKGDKQDVIVFPLKYASAADRTIRYRDQQLVVAGVASILQDLLDTRSHGGSINGMDLLGRGGRGNGLAGGGSPDTPSLPMSSSGLDTNALEQGLDQVLHYGGGGTKSSGKSRSGGRANIRVTADVRNNAVLIYDLPSRKAMYEKLIKELDVSRNLIEIDAVILDIDRNELAELSSRWNFNAGSVNGGANMFDAGTSSTLFIQNAGKFAAELHALEGNGSASVIGNPSILTLENQPAVIDFSRTEYLTATSERVANIEPITAGTSLQVTPRSLDHDGKPQVQLIVDIEDGQIDISDINDTQPSVRKGNVSTQAVIAEHGSLVIGGFHGLEANDKVHKVPLLGDIPYIGKLLFQSRSRELSQRERLFILTPRLIGDQVNPARYVQNGNPHDVDDQMKRIKERRDGGELPTRGDIQKVFTQMVDGAAPEGMHDGETLPFETDSLCDPGQGLSLDGQRSQWYARKDWGVAVVVARNNTDKPVRIDESRCGGRWVIGVAAWPHAWLQPGEESEVYIAVRQPQISKMAKESRPSLLRGAKP

SEQ ID NO: 707 - protein, 678 aa, Proteus mirabilis
MLIKDSKFHWSSLYLLLATCIFCCIYTRPVEATSSEPIDDFFALSLEDLINVEIDIASNKKTTLREQPSTVTLITSEQIKYTGAMYLMDLLKQVPGFWLGTDTIGTFSSSFRGVWGMEAKILLIIDGIEQNELAFGSMVLGNRYPTNLIDKVEIIRGPGSVRYGGQAALAVIRVTTKSASQLGNAVSYTSHLGQGGNHQTNVSMRTAHQLTVNNQPMRLGLSATVGQGDYSDKQWTGLDGYQFNLRDNSNSKPIEVNLNLDYLGWQLHLQHNEFKQQDKLLFGDSGLFYAPNRRYTQPNELSFLHQAISLSKLWQLNDALSLESKMSYVSQKPWNSQGQYQHDLTRKLARTRLDLTAMATLSARSNILFGSTIYHETAEVTQSYIFDPSTRYQGDSQSSIDDAAVFLQYETVFDWGNLTLGGRFESHEYAGSKFVPRISITKLWQRLHLKLVYNEAFKIPQFDTVASAQNADTPINQAETTQSWEIELGYQLSDSLALVSNVFLQQIDNYIGFNPQTASNATLGSLGTYGAELQANWHYHQFGLNASYSYFAIEQNNIGALRVLGSENDVLGIPNHMLKIDAHYSFDRSSSLHWVAQSVSARYACIDDINWVCGEEKAMPSETDMRVFYQFDNQQWLVNVGVERLLNNKHVMIQPYRGSQSPIQGQGRQIILDVEYRF

SEQ ID NO: 708 - protein, 240 aa, Pseudomonas tolaasii
MKSTYKKMLAAGAVMALAGAAHAQSAGSNIVSLGWFRVMPNSSADPLTVDSINGRPVGMTRPNTGAEIESADTLGLAFTHFFTDNISGEIVAGIPPKHDVKGTGNYAQYGKLGSVKQWSPALLVKYHFFDAKTRFRPYVGIGVNYTWFTDETITNQNFVNREFLPGARMTASAKPSWNPVFNIGANYAINDNWFVGLSVSYVPLSTRASFTTQAGPVTIQSHTKIKIDPVVTFLNVGYRF

SEQ ID NO: 709 - protein, 821 aa, Pseudomonas alcaligenes
MIDRTAADVKKIAVSPAVSPLPARRWLPLALALAVSAALPQAQAGQAAAIHIQAQPLGQALSQLGLQTSLQVFFSPELVAGKQAPAVDGNLSPEQALGQLLQGSGLQYRIDGGSVTLSPAPAATGGALELGTSSISVVGDWLGDADVQKVQNHPGARTVIRREAMVEQGAMNVGDVLRRVPGVQVQDANGTGGSDISLNVGVRGLTSRLSPRSTVLIDGVPAAFAPYGQPQLSMAPISSGNLDSIDVVRGAGSVRYGPQNVGGVINFVTRAIPEKATGEIGTTLETSRQGGWKHIDTAFLGGTADNGLGVALLYSGVNGNGYREGNNGNDIDDVILKTHWAPTEQDEFWFNLHYYDATADMPGGLTQKQYDAKPYDSDRDWDNFSGRRKDVSFKYQRQVDDRTQFEVLTYYSDSFRGSNIAASDQKTLVSYPRTYYTFGIEPRVSHVFDLGPTTQEVSVGYRYLKEGMHEQASRVALVNNQPVLTADSDGHVYQDRTGGTEANAYYIDDKIDVGNWTITPGIRFEDISTNWHDRPVPGTNGVRVQEKRRSIDSNEPLPALSVMYHLSDAWKLFANYETSFGSLQYFQLGQGGKGDQTANGLSPEKAKTYEIGTRYNDDVWGGEVTLFYIDFDDELQYISNDVGWTNLGATKHQGLEASMHYDLAALDPRLDGLTANAGFTYTRASYEGEIPGFKGRDLPFYSRQVATVGLRYDIDRWTYNIDAFAQSKQHSPGTGVNANGSFNGNYITDGSADGRYGDMPGYVLWNIRGGYDFGPQLSNLKLGAGVKNVFDRQYFTRSSDNNSGIYVGAPRTFFVQASVGF

SEQ ID NO: 710 - protein, 88 aa, Myxococcus xanthus DK 1622
MLEDTTIHNAITDKALASYFRSSGNLLEEESAVLGQAVTNLMLSGDNVNNKNIILSLIHSLETTSDILKADVIRKTLEIVLRYTADDM

SEQ ID NO: 711 - protein, 1005 aa, Campylobacter fetus
MKTKITQILKKRYYLLFFFSLLLQQSYAQQQITITGKVASAAGEPIPFANVVIKNTKNGAVTDFDGTYKITTGSDQTLVFSSQGYKTTEIAINGKTTINAALAEDATKLDEIVVVGYGSQQKKDLTGAVALVKATEIQKRQVTTVADGLQGLVTGVKVRGGGRPGQEANIEIRGLKNLQNANPLYVIDGLVTTANRDFNPNDIESIQVLKDASAAAIYGSRAANGVIIITTKKGKKGPLQVEVSAKTSFQVMPRYDLMGTEEFAKYNNMAYDNAGLPRQNLNMAVDTDWQDATFQTGMIQDYNASFSGGNENSTFFLSGNYFGNEGTVVGTDFDRISFRVNSSGTKGIFSIGENLAISNAKTDEMSGNPIIDVYRMTPTIPLYDASNPGGYGYGKQGVADTFGTNPLALADFSNTTNENFRIRGNIWSELKFVPWLKYRFNFGYETSFDSYKYMRKKGSWTLNQPQDPSQTDQNKGRSETMLFENTLTFKKEFGKHDITVLVGQTFQKDTYNQIYGTKRNLPMNSGTGQYYEVLNQGDSPVVGGFINEAALTSYLGRLEYNYDNRYLFNAVIRRDGSSKFSDGNKWGNFPSLSAGWRISNESFFKSEFIKDLKLRASYGELGSGNIREYESRSFVNNFGQIVLGKDQNLYPSAAQVKLSNSQLRWEKLKQTNLGLDLGVLNNDLRLTADYFIARTEDVLFGFPILLTTGNDGGNPISNAATVENKGFELELAYSKKINEVSFNASVNFTKINNKLVSLGNGQNENIIGNTMTRSGQPVGMWYVLQTDGLFQSQEEIQNYKNADGKVIMPNAVPGDIRFKDVNGDGQITNEDKSIVGSPWPEFEMGLNAGAEYKGFDFSMNWIASHGATVYNGFRSVVDRFDDNSNYRTGIQPWTPENPNTDFPRITKGSTLNSRGDSDRFLESGDFIRLKYIGFGYNLPDSVLKNSGITRARLTLSAQNILTITKYKGLDPEFSNTGDNRIFERGVDNGSFPNLKTYSFGVEFSF

SEQ ID NO: 712 - protein, 908 aa, Neisseria meningitidis
MNTKLSHPFFKISLLSLAVAATAQAQDQALEEIVVTGYKASLKTAMDTKRDSNGVVDAISSEDIGKFPDTNLAESLQRITGVSIDRSGGEGRQITVRGLGPQFNTVLLNGRQMPNANASRGFNFDTIAAEMVSGVEVYKTSTATTQSGGIGATVNVQTAKPLDLGHKVAGSVKGLNETNLNDITPSVSGLFSTTLNDNFGILAAVSYQERDYRTDSVEVRRWDWRSRRPATLGSYLELPDGNGGTVNTDFYPTQTAVKRQEFSRERLNGSLVLQYKPVDNLSITVDTQYSDLQQEGMEYESAAWYGYGNNETYAIDSNGTIIHRTVTDAGLDFFVNNPVTQEVGISSGIEVDWDISDTSNLLFAYSHSTAEAQPDHQANISRSDLQASPLSFTFDVKGDVASHYYDNSQISLANARIWQYDGYSDPRKDEIDQARVDYTFSDDRFSVKTGLMFTDQTKTIEQYMAKAGTVLQGKYNLVGTDPSTSIYRTLADATNAGYSVKYMNHAILGRLAYFDFDPLAFDSWTSYAQQDPGATPAQQDADNSTLVRQDNWSEINEKTMAFYVEGTTFFDLWDRELTIVGGLRYEDTSVDSTSLEQNLQSLTPPAVPGEAYTLNFSGSTAYTDGDGYDIFLPNIALKYNLADDLVVRLAASRTITRPELNDMKSSRTLGEIREGQSGIGSAGNPDLKPFTSDNLDLSAEWYINDFDYVSIGAFWKSIDNFVVTEAMPESVSPQIGDAVIYEMRRPRNLDTKKVSGIEIGGQHIFGDTGFGVIANATFVFADPEYDYFTPLGEVPKADAVVGVSDSANLVGFYENGPFQIRIAYNWRDSFIRGFQYFYSSTSNEPVVVEDYAQIDISMSYDLTDNVSIFLEGINVTEEGSRLHGRESNHMFYSGEGVGRYALGVRASF

SEQ ID NO: 713 - protein, 1015 aa, Pseudomonas fluorescens
MRSLKMACPTLCVMLLTLCWSGLAAAYDPIIHSEFYYGPDSEVHVVGDMLSVPEFSLTGEGIDVVFSGLEEGGGVEKYAVLLEYDSGSADLRDATVSLTDATFFFDTSGGNEDFNFAVGMKGFDESLISLAEGSSLSVDIASYIGYGIEVLRSSATINLDGGSTIDVSGSVEDPVTFPDSAPSRFGYGINAGTPGGYVNLSLDHGSAINVETSAYAAGDTGTSSASSAGARLEGDVVTVALDNESTIRTVATRNIASDGVTVANARNLRLGSISNSTIAVAGNSLISAQAFAEEGAAYAYVLQTYGSGASEFLLSDSTFSATATADGYADALGAYFSQPEVRATLTRSTIDVDAISSSYGARASGFVGQSNSDVRLEMEGATIDVLAQTQGDFANATGVMIIGATNLDIDIADSTVDTFAQAAGGEAEAVGFSLVGSTTISSLVLNRSYILSSAVATDSDASVGEAYAAGLIIGVDTVAENISLVGSHLMSSAHAQTGEAVSYGVFVEDYYGGTPEVTLNLDAHSGILADWAVYTADGVVHLNNSGTLAGRLLVSDLTNNVGGRFMLLLDSDDLLIGEDGVGYFEDEDFYFSVADRAELADGTTFLVYPSDNLGIVSEGDSTSIALLSAGEGDWTLENLSLETPFDTPMIGLELTENAAGNQLIATATFLTPEQAGLSANATAAYEAAVDGGLFTPTSSPEEWSPNVSGAFVVGMAHTLMVSNMNIGNRLGMLSGMNSGDEIAASNGMWFSARFTDAEQDRRDGIEGFDADTDALSFGFDREFGNVVLGVAYTRGNSDAKANDASADFEMSDNLFSLYGSYDGGTWYSEAVVSVGFGSVDSLRSVGSDDYAGDYDSTSYSTLVESGCKISAAGWEIYPYLTLEYSSKDYDSYTETGGSLALHVRSKDYEVFTAGVGARLQKDFQRSWGIVTPEVSGQLAYDVENDRIVSTANFVGGTTSFVAKGIEPSETSWDLGAALTVASLGEQNVSLRLGYDYAGRQDFAAHSFTGKVRFEF

SEQ ID NO: 714 - protein, 196 aa, Burkholderia pseudomallei
MRRTVYAIALATAVSATGAAAQDASQWTGFYAGFATNIISPEFDNSTATTPLQEGTGFGAYGGYNYAFGDNFVVGAELGFSGPATFQTTLGANDFEFERVLNARVRGGYAMGNALVYGTLGYQTVEYGASAGVSTEGAADGLVYGIGLEMLLNDQVSVRLDYTSTHMTPDAGTIIGGSAGEQIDANAVGLGVALHF

SEQ ID NO: 715 - protein, 1032 aa, Salmonella enterica
MRNQKKWYHGRYMLFVMLIFYTLSMYSQKITVKGKVIDAANNLEVIGAAVQVEGTSLGTITDMDGNFVLQGVPTKGNLVFSFVGYKTVKAAIKNGQIYNIKLQEDTKVLDEVVVVGYGSMRKKEVTGAVARVNSDEITKISTSDLGTALQGMVAGVNVQASSGEPGAKSNIQIRGLSSISGDSSPLYVVDGVPFEGDPGLSSSEIASIDILKDAASAAIYGTRGASGVILITTKKGKEGEMKIAVDGYYGVQHITSNIHLLDANESIFVKVMSNRMMEGNQNTDDLAWSNLKTYPVNFFNNSSLYEYVVNNNAPIQNYSVTANGGKKDLTYNLTANYFDQKGVLINSDYKRYNIRSNTHFQRGKWTINTNIAMKIENQLSPAWGLLNECYDYSPTRSQIYPQASIVNAAGDPADLQGVSYTLGRLKEENHKDTESFNGNFYLAYNVIPGLNVSTRLGFGYNNQKAVSIRPEFEVYNQKGEKVTSSNYRSQLKDTHSKNTSLTWETMVNYNKKIKKHDIKFTGVFSMEKYTYEMFYASIMDLVTNEIPNLNAGTSDMTVGTGSGQWGQDRISTMVGMLGRLQYSYADKYMASASIRRDGSSKFSEENRWGLFPSLSVGWNISEESFFDRFRWLVNSLKLRFSYGTTGNQNFPDYSYAPAIYKNYDYTFGTGTSEILANGFTQLGFANPNVKWETTQQLNAGIDMALYNNKLILGLDLYKSNKKNMLFPMVVPPSNGGGQSSTVTLNAGDMENRGVEFSLTHRNKIRGVNYSLTGTFTKNVNEIVSMAGKNELYFFPDGKPVSSGSDYVTAIKKGYEAGAFFVMPTAGVINTEQKLAEYQKLQSSARMGDLMYIDTNNDGVLNDDDRVYAGSGMPDYELGLNFSADYRGFDFSMNWYASVGNEIINGTKIYTYQRRTNKELIYMWTPTNYTSTIPSYRTEGHNNYRAHTDMWIEDGSFVRLKNIMLGYSFPKSWVSKLGLGKFRLYVAADNLLTLTKYDGYDPEVGSNGLSRRGLDYGTYPISIQMRGGFQINF

SEQ ID NO: 716 - protein, 1036 aa, Aggregatibacter actinomycetemcomitans
MQNWFIINFKLIDMLKSISLRLCTLIVLLFVGILSFAQQVQVKGTVVEKSSGESIIGASVMEVGSNSNGTITDIDGNFTLSVTSGATLSVSYIGYKTVTVKAQPTLRIELTEDSQLIDEVVVTGYMSEKKASLTGSVAVVKMKDVADIPTGNVLSSLQGRVAGMNITTDGTPGGGNTSTLVRGKSSFRNDANSPLYVIDGVMTRENISSILSSNDVESIQVLKDAASASIYGAQAANGVIIITTKRAKKGETRVDFDMSLTLQTYQCGFDMLNADEWGQVYWSAYKYANNGATPSSEIYGNGATPQLQDYIGLNGAKVHAVDTDWRDVVYRTALMQNYSATLSKGSDNGAFSLALNYLDHDGLVENTNFQRINTRISSNYHYLDNRLRIGENVAINRWTQTLSPAGVDENAIKQHPAKTVYDENGNYNDAINDVLGDAPNMARLLENEKQNKHDYWRIFGNAFLEIEPIKNLVLKTNFGMNYYDETNKTFEPAWARDEVNKLTQSSNKRLDWVWTNTVTYSKAFGKNNLTALLGTEAKKNHSESMFGYGTGLAVEDEDYIYLDGVTAGKNVGAGASNYGMVSYFGKVNYDYEGRYLASVTVRRDASSRLAKGNNVDYFPSVSAGWRISSEKFMEATKNWLADLKLRASWGINGNDIIDNEAPYTKYLISLKDASYNMNGDGTTLAPGGYKVRSTNPDLKWESTRQLNIGVDAAFLNGRLSASLDYFDKKTSDMLVEKPYIAVIGEGGYCWYNGGTMNNKGFEMALTWNDKVKDFQYNVAFNLSYYKNEVTELSEEIYYTYGGGNGVDKTLVGQPFGSWMGFKTDGVFRTQQEVDEYKSKYNVQFGAPGVGRIKYVDADGNGTIDTNDRVWLGSDNPKVIAGLNLGASWKGFDLSMFFNGMIRDAYNNSKYYTDLFQCWTGNHSTRLLDAMHAYENFEKTGVYNSSVPALTTLNSNNEHEVSEFYIENGSYIKLKSLTLGYTLPKAALDKMKMRHARIYFQAQNLFTITGYTGADPEGLGYPYPLPRTFSLGLSFGF

SEQ ID NO: 717 - protein, 766 aa, Erwinia amylovora
MIQLHPSTLTFKRKDPHKMKYPQYLLLLGASTLSVAAEPIERINVTGNPLEKPLSQKIQASKIELSGTELNKRKADTLGETLSQLPGIDSGFFGSAAGRPQIRGFGGHRVQTLLNGIPVEDMSSISEEQFIPIEPFLADSINVIKGPTAVIAYGGQAMAGIVDLQEGRIPLSPINGFNSRAEVKTGYNATSTALAKLSGGNESFNFNLNMINKDRGDYDIPGHSKDSNCKQWSEVVGAAQFADQCQIQYGQPVWKRNELLNRYEDATPIEQQIITDRSIDNDGTVLNSSHHTTSFSAGGSYTSQNRLLGLAYGYTDTDRGIPGFMRRGTSAPVDFNLRGNIRILSQGNRVDMKYIEHWDNNWLESLTLDTAYSHQVDDEQMAGVSVNQFELTSWVISPKLYHNWSPNFDGVVGLQYDARAYEGEGYDNYMPKVDSQSYAAYTLQTLHLGPVTFELGGRYDAIKHQANTEGYHVGRGLGANVKDRNFYLQSYSGSMQWDILQNWSTRVNYVHAERAPEMNELYASNPHYALLIEEQGNSNLNKEVNRSLELNTTAQIADLQLMASWYQNQFDDFIYLGGTGINRGGTYVREWRQADTNNQGLEVQAVYTFPWQTWGIFELSAFTDRVKNTPRYQYDGSYHIFNSRPPLPGEREEYFRRALEGSSMPRTPQSKTGAELNWQYNALMVSIDYVRYHSQNDLAKFERPSESYSLLGANIMVDQVIASIPTQFYLSLDNLTDEDARPHNSFIRHLSPMPGRSAAIGVRIQF

SEQ ID NO: 718 - protein, 1154 aa, Salmonella enterica
MYYKSIKKIPQEKGTWGQGPFCLNVTSLLRKMKLILAFWLLSINVAFSSVSYGQNIRLSLDFKNKKTAEILHEIERQSEYHFFYNAKLVDVDRTVTIKAVKKPVLAILDELFANSDATYKVIEKDIILTPKKGKTRSSDNAEQQQRTISGEVRDQITGQTIPGVGIMVKGTTSRTVSNEDGKYTIAVPSGGETLVFTYIGYTTQEEFIGDRKVINLTIKSEVLDMNEVVVIGYGTVKRANLGGAVATIDAKTFESRPVRNAAIALQGAAPGLTITRNGGAPGSSPTIRVRDISSINGGSPLVLIDGAEGDMNLINPADIESISVLKDGTAAIYGARAAEGVILITTKNGRRNQDLKISLDAFYAIKTPALLKKPASLYEHASMALEITDGSFPYEYTQEELQLILDGSNTVIPASKWGRWSGYPKFYKDQNWNDMVIGNGSLQNYNLGLSGGGEKYSYLISLGAPSEQGLPKFGIDNDKRYYVRAKTNIELRKNLIYDLNLSYEASNRRYASVLEHGQSVWDLIYKTRSWAPMHNPAGNFYTFEGFDNPAQVLEAGGDSQLIKGNFTINNQLSWKINKDFNLTGRAVIRKNDGDNYIVQKMIYNYNWDNVNHRTARKPNSAERSYTKNLYKNFTAYADYKKTLGKHDIAIMAGAANESSDYDRFWAKRINFDQQESMPLKLGSPQNQDASGEGNAWTINSFFSRINYAFANKYLIEGTLRADGSSRFAPSERWGYFPGANATWRVGEESFIKKMNVFDDLKFRASYGEMGNQSGIGPYDYIELITIGSTYYPFGNGERGQLATQSNLVSKARTWETIISKNIGADFSLFNNRLFGSFDYFWKTNKNMLIPVSYPSMLGIAAPSTNSGRLEIKGWELALGWRSQVGEFKYSVRANISDAKNKVASRVGNNLITLGRNATPLGYSTNSYFGYEFDGIIQTQQELADYRARFPNEGIIQSEVKIGDAKYKDLDGDGRLSVLGNGTAGAGDARYLGDANPRYNFGLNLGAEYKGFDFSAFIQGVGQRTMFLEGDASMPFAQAWFQSASYWYGKTWTPERTDAKYPAITMTGKRSYNYYVSSNTKHNVAYVRMKNLQVGYTVPQKMTQKLKIDKIRVYFSGEDLFEIHNAPGGWDPEENGSFVTYPFTRHYSFGASIVF

SEQ ID NO: 719 - protein, 731 aa, Photorhabdus luminescens
MAMIRSATARGLLRQASLPAFLLAQAALASSVHAQTSGGPAPSASTQTIVNGDTEILLTTLTVQAEDQGGQTHGYQPLSSSSATLTEMPILDIPQAVNVVTNEVIVDQAAHSLDDVLANVSNVTIANTLGATQDAVTRRGFGDNRDGSILTNGMRTVLPRSFNLTTDRVEVLKGPASTLYGIQEPGGVINLITKTPQQTFGGSLSATASSFGGGYTDLDITGPIAGTNLAYRFMAEYQDEDYWRSYGTTRQTILAPSLAWYGDKTTVTLAYNHRDYTEPFDRGTIFNLTTGQAVNVPRRTRFDEPYNITQGASDLFQANAVHQLNDSWKLKLNYSYSRDVYSDNQARVVSYNASTGALTRRSDATQDSTQYDHNLRADLSGTVNLAGFKNEVLFGASYNYYDVLRTDMMRCANRTGFNIYNPVYGQLASCTTVSAADSDQSAQQSVYNAYAQDAFYLTDQWILVAGASLQYYEQTAGKGRPFNLNTSADGGEFMPRAGLVYKATDWLSFYVNYATGFVPQVSIASYIGTLPPETSVSYEGGLKFEIMKGLTGTAAVFDIEKKNVLYSELVDGESVARTAGKVRSRGFEFDVAGALTDRTNIIASYGYADVTVLQDPQYAGNTLANSAATTYSLFATYDFGRIWGDNSLKVGGGLNGRSRAAGDAANSFWLPGYTVFDAFAAYTIGSAKPITVQLNVKNIFNTTYYTSTQGSNLGVAVGDPLQALLSARLAF

SEQ ID NO: 720 - protein, 981 aa, Porphyromonas gingivalis
MNRFSKGTLLAGTVLATAVTATPVYAQDNDSDDNFIVVTGSRIQQRNVETAAPVAVVDAEEFQLTGDVNVENVINALPQVIPGTTGNSNNPGNGTASLDLRGLGETRTLVLVNGRRWVSFDTAQVVDLNTIPNFLIESVEVVTGGASAVYGSDAMTGVVNFNLKKVEGVEMGGQYAITEEGDGRRYQLYGAIGTSFDDGRGNATVYAEYTNRGDIFQGDRDFSFFALGGETFGVNLLQFGSSTVPQGRINTPGTTIINAAGDTAPLGAGLVIDDGIFDTPGSPRPRAGDTYNYAPVNYLQVPQERYLMGGYADYEFTPGHRFYTEVAFVNNRVAQELAATPVTGTFNVDIATVSPFLDQATIDELNILDQREADANAQRVANGLSPLAAPQLGVVSTFLQRRMLETGPRNSLDERNAFRVLGGVTGDIAENWTYDAYYSYARTRNSNVQEGNISRSLFQAGLDGTGTTINIFGAGTLTPAMVQAVSIRAQNGDVSTMEVAAASVSGFLGELTAGAGDVGVAGGYEYRRVGSQFIPDTALASGDVIGFNAGSPTEGGYDVHELFAELYVPIFDNGTQRLELTGAARYSDYSLDAVGGVWTYAGGAEFDVVPSVKLRGQYQRAVRAPNVGELFGGQAIGFPGATDPCGDPAFLSSNAGADQVCIATGVPAANVGNAGAIQLNAQIPALFGGNPNLEEETSESYSFGIVLRPDFVPGLTITADYFDITIEDAINVAGGSLQGLLNLCYGEVQDPNSAVCAPFIGRRNGDGALTVDNPPLVASLNVAEIGTSGVDLEVNYRTSVPFSIFSSDNESGLDFSFLGTWTDTFFIRPVADLPTVNECAGGFGGACFNTGDPAPSFRWVSRLSWNDGPVTTSLRWRHLSSVEDQDPGTDFTQFNGIENIPSYDLFDLTISVEASENLSITGGIRNLFDKLPGAPEFDANGFVTNRPNGLLLGDNQEQANTYPSTYDVLGRDFFISASFQF

SEQ ID NO: 721 - protein, 791 aa, Porphyromonas gingivalis
MKRTILASLAAAVTTTVFAAPTDTDNALVKDTTKVIDIEEVVVIATPKENNRLRQQAISSTSLSQNEMRNNSVTSVKALSGLVPNLFIPDYGSKLTTSVYVRGIGSRINTPAVGLYVDNIPFIDKSAFDFNYSDIERIDVMRGPQGTLYGRNTMGGLIRVFTKSPFTYQGTDIRLSAATYNDYKASLTHYHRISSQFAFSTGLFYEHKGGFFKNNFNNKRIDTDDEFGGRFRAIYLPSENLKLDFTLNYEYTNQGGYPYEYTGRTDDKTEDRGEYIGKISYNRECGYKRNLLNGGLNLEHQADNFILSSVTGFQYLYDQMNLDQDFTEADIYTIMQKQNSKTISEELVLKSKPGNRWQWTTGVSGFYQWLKTDGPVTFQEAGIQSLIEDNINAGLSHLPAGAPTLAAKITTRPLPVSGVFDTPILNGAIYHQSTINDVLVEGLSVTAGLRLDYEKLKLDYNSVCDMNFDFSVSAPFLPTAIVRQLNAKTQFIGKESTDYLQLLPKFTIQYAWNSKNNVYATVSKGYRSGGYNIQMFSDLIQNNMRSDMMNAIKQDEVLGKFAGMMPDVPASDVNVSDATLYKPEYSWNYEVGSHTTWFDDRLQADVALFYMDTHDQQISRFAESGLGRITVNAGKSRSLGAEASLRAQVTDAFSLNGSYGYTYATFTDYVVSDEENYNGNYVPFVPKHTFNAGAQYVFGLRNGAIFDNITVNANYKAAGRIYWTEQNNASQALYGTLNGRVSFNKGNGQLAFWINNALNTDYQAFYFETMNRGFAQKGRPLQVGVDIRCRF

SEQ ID NO: 722 - protein, 687 aa, Porphyromonas gingivalis
MRFPLIKLNSAKTLFSTSAFLFLAAQAATSKNIETVVVEGTKTNAALNENTTSATEVTKQQLESSLAEHFQQVAVNAPGTWVSRGSGVEHLTALRSPVLTGAGACGAYLATEDGIPLFAKNLCNVNQLMVTDFKSANNVTVLRGPQSGLFGGNALFGVLDINTNAASHTEANKQNFAIGQSTLGYSSAAIDLTNNSNGNTQGLSGRLTHNNSPRESAYYNQQFLHAYQQVKKTNYQRTDSLSLMNLEQETAGYIYGDEAYKNSDLANGNSNPEAYRDARNIRGYSKFEWQNSAHSTSATPYFRHNEMQLLMHFVPWQPVEKNQHSSAGLQLQHTRHIANTAFTVGQDIEFTSAELTEIQYKPAPFNQAAFPEGTHYNYNVTAINAGWYIRAEWQANEKLTLTPTLSANIDTLKYRNNVEAGYACENPNNCRFYRPASKTDTFKVVSPTLTASYKLNSNNTLYARAAQGYRTPQATELYRLQSSNQTPLSHITGTSYELGLSGALHSLNYALSAYTMLVNDDILLDSERRFINNINTQHKGLEYTITWQASQSLSFNTSGTHALHTYAKSPTTNNTDSNLDGALLDTAPKNMHQANVRWQASTATMWQLRWEKMGKYYTDSAASQEYEGHQLFHLSHSWQPSNSYVLRTKISNLLNTRYAERADYAFGEARYFPGLDRRLTLELSVYW

SEQ ID NO: 723 - protein, 693 aa, Stenotrophomonas maltophilia
MKPMDMNNGSGKAVRNINKTQLATLIGILCVSTSANVVAEQLEKKEPQRKQDTVVVVGEKLGGTLAENTSSLTLFTDEVDDGESRDYYDLLDRVPNVLNAPSGIPHIRGVDGRGPGEGFLTFMTGATPRVNTTVDGVSESWSGEAFGKAGLWDTEQVEVYKGPQSTNQGRNSIAGAVVIKTKDPTFHREGKVRAGYENEDSKYHLAGVVSAPLVEDTLAFRLAAEGTKGNTPIDYSLPNGDQYPWDPSELESYNVRGKLLWKPQGNDKLTAKLTVGSRNEEGQYTNFVTKPGTLELHSKSGTRRQETKSWNINLDVNYVINDELTTDILVAHRNYTTKFKAYPDTNWYGDVDEDNYTAEAKLTYQSLDEKYNAILGLAGFFKDQYTETDSLKRKDEVLTNSIYFDSRIRLDNRWQLLLGARYERDELKRDFDHATLPLDFKADEDDGILLPKIGLLLDVSDHSTLGLTARKGYNAGGLSYNEYKEEVFVFEREKVWSYELSSRSSFLDDKLDLTANLFYNDYKNYQTSVSGDSGKRFDTYITNIPKGKTYGTEVEASYWFDSGLDLFAYVGLLKTDISEGPTGTSTNLSGNEFSYAPKLSAGAGFTQHLDSGLFFGARVNHVSDYYTDLANTESKTAGDDTVLNLNAGYTLNDMTIRAYVKNVTDEEYVIRQKSDLYEVGGPRTFGIVADYQF

SEQ ID NO: 724 - protein, 1179 aa, Pseudomonas chlororaphis
MSRRMSDVMGRTGPSAHAERASAEKEHSVATGGGFRQFSMLLLGTTFLVSAPVSAALHAAEPGKKPKSIAKSVVPSDLKARLADALRQGERELIARAYDSTYRNPGLRNAVVDYAADLSPAASRHVITAADLGVLTSGQRMMLAPNAAQVLATATTTASGLGATSYQNVAMTNNNNSPNLPNPLPSLAAQTWNLTMIGAQAAYTRGFTGAGVTVTVADTGFDTTNAGLVNKLLINLGKNYVVENGGTYDPNDLSPESAKKLDIHGSHVSGIIAGEKFGNVDAHGVAYDANIIPIRAITEEGYSTVSDSTADALNYFASLSGTMIYNASYGPNYDETLGLKQWPVSGVSAEANAALNALKAGKIIVAAAGNDRLKSPDAADNPSGLALLPFLNPAHAGLGVYDDGGEGYDYTSLQRQNGQIIAVMAVGSTKAAASYSNLCGVTASWCVAAPGGDGNTEIYSTIPYDTYGFAAGTSMATPTVSGAIAVLIQANPTYNAQDLAHLLFSTTEDLGDAGIDAVFGHGLIRLDRATEGPTTLAANAAVSVAADQTVYWSQLLNTQGEFSKIGTGILTISGRTNAAGNVYAQLGTLAVDGTLTMTTGGMLNVAQPATLAGFGTVVGNSTIAGTLSPGKMANIGDFFANNIVPAGTVLNGNSVGELTFNGNVTLTSTATTRIDIDGTLLVPGGPGTCDKIYVTGAGNVFYAAGTLTPVLRGSVGTVSNYTPALGTDFAIVQAQDGARTAGSFSSLVQPVAGLPANGRFDLVYDPTALTLVVTPASFSSLATGANGRSVAAVLDSQRPAAGVLPSGRGKTLYDALYRLESEAQYDQAVTQLSGPGQPAIASASLQAFTGFLGAIGDRQNTLAVGGEQGQNGAAQSFALSYAGRNAMSAETGAAMDALASIAPADRVRDGWSVWGQGFGRNANVRDSGDLAGSKAVSAGFTIGADRWFSNNLMAGGAFGYARTTASSTDIQGKSDTYAGAAYASWMPGAAVVDVRIAAGPSQMSTGRQIMLSPGGLQGNANGIGLGTSVEAGYRFALAHGLTLKPFAGVSWQGFRRDGYSESQAPFGLAYAAQTYDKLTTITGAALSTQLRAVDGTTLAPEFKLGWGYDLRDTTLVSQAALLDQPFLVSAAAPGRNAALVGAKISGWRSDAFRMFASYNGEFRSNATSHQVSAGARYSW

SEQ ID NO: 725 - protein, 360 aa, Pseudomonas putida
MKTHSTGCRIPLLGLSLLALTSAGHAQSSVTLYGVADAGVRYGSGLTAAYAGSADSSSAVNSGINTTSRFGFRGSEDLGGGLKAIFNLESGVNLDTGASANATKLFDRAAIVGLQGSWGTVTLGRQTTVLADVVSATDPLGSRFASFNPNIGIAALSAHRLATEFGPAGSTTGAYRLDNSVKYVGRFSDFSVRAMHAFGEQAGNSSRLASSGLGAGYQSGGYTAALSYAQFRNAAGLSLKGYLGGASAMIGGNKIALTYGSHEAETSATAKTRNRTLGVGGTVPLGASVDLILAHYQVKRTRTAAVDDGFNRSVAFLEYKFSKRTRAYAELDHTRWKNGYQGAAFKSSASGVSAGVVHSF

SEQ ID NO: 726 - protein, 724 aa, Caulobacter crescentus CB15
MSRPTSPHRFNPSRNLLSMAICMAVMTPALADETREVQDTAPPATLELGATAITSTQLGSTTEGSESYTTGTMATATKLPLTLRETPQAVTVITRQRMDDQAMTSINDVVNATPGLFLDYSNGPGRQAYKARGFNIDNLMYDGIPSGYDGVNVGSQPNLAMFDRVEVVRGATGLVTGAGNPSAAINLVRKRPLAEQRVTLTGAAGTWDNYRGELDASSPLNDSGTLRGRVVTSYHDANSFIDDVDEQHNLFYAVTEADLSDDTTLTLGFSHQKDRTNYFWGSSMIGLDGHHLDLPRSYNPGTSWEDKDQEINTVFAEIRQQLANDWKLQVNANYSEQNALFSGSYQSRWVNDTLARTVYQSKADENQAGLDAFFSGPFEAFGRSHELVVGASKRIYDLTTHNYSPYDTNWPINAGKPDFVHTNNTREVTTQDGVYLTTRLSLADPLKLILGGRLDWYDYDNRDGDGDYKVTRNVTRYAGLIYELDDHHSVYASYSDIFTPQSNKGTSGNPVKPIVGKNYEVGIKGEYLGGALNASLAVFRVDQENRAVQVFVPNCPQSSCYEASGEIRSQGIDFELQGALTDNWQIGGGYTYARTHTIKDEANPQNVNKQFDTDTPEHLFKLTTRYNFQGPLEKLRVGGNISWQSRMYNDIELLDGGNYRLKQGAYAVTDLMAGYRVNENLNLQLNANNIFDRKYYSTIANSVSYGGDSYGSPRNMMLTAKYTF

SEQ ID NO: 727 - protein, 732 aa, Salmonella enterica
MIRYQLVSAILVAGSSLPFAYADEIEQKKTVTQLNKISVESTQETVLEPIDISTSTHLAVDKKDKERNGTASLGASLETLPGVNNLGSGSQSGKPVVRGDTSLRLPVLSNGVAMEYQAEGTRHNPNVDPALMEKVEVIRGPQGLKYSSQAVKSAVNVTGLQLDYAAPGETRTLGALMGEVNSNNHETMLGAKAKYSSNGVAVLGGVTKRKGENVVSPQAAEAGAVKPGDPAGSKPLVTGTIPYTNFEGQAAVFGVGYLGNWGSVELHHSIWESKQNYLGVEADPAGYELIPSAGQKLKNEETQLKAEIFQGDWVIKPSYAHTRNQREAMHDVTYEQMSAYENDPEYLDLVVHRNDYKLAVEHPEFKGWSGEFGVSFLDKNQKLRSGHLTPSATENGSGLFMVEKQTFGLWDVEIGGRYDSHRVKAPLSAENAHFWEETQVYDASNNERTFSDWSGALGLAFHATPNWTFTGNVGRSFRAPSVFELYASGAHGGVQAYQVGNPDLKAETSINTELAAVWQSTKLHSSLSVYSNWVDNYIVLENTATELYCDHEGVCQTTQSLAFPYRKMINAQTNALIQGVEWSAKYQMTAQLQWRATAEIMQGRDTKNDRELPLMPAHNATLDAQYTFKGLDGLKQPYVGLGTRYVAEKKAAGLYEPFSQYDNLPFGTASTADYWLWNLSAGTGIAFDKQTLWLDLTVENVLDTPYRDFLDTYKGIALGMGRNFKLNARMPF

SEQ ID NO: 728 - protein, 399 aa, Xanthomonas oryzae pv. oryzae
MAPACLSRTDTMTQHGTSVRRRLSLSAISHNALIWGSLMAGVCPAAMADTVEARTKTHPSVCHATHRTLHPVRCTPHHAAAPAQQSAKAPVATPVASASATAVAQSSADVDGTEAENIQVLGTNHTYTAPAVEAWGKSPVALKDVPQSVSVITQQRMEDSNMLTMADAMRQINGIRVLPGSTANSNYYSRGYQLTTSVDGTPDASGTLNNAAFDLSMYDRVEVLRGSSGLLQGGGGAGGVVNEVTKKPGRDFAVDGSAMVGSFNNYRADVDMTIPLNRSKTLRFRTADLFQDNDFFYKYSHSRKWQAYGALEWDVTPTTTFLVSHAAQQQDITAPYYGLPVTTEKTLWYGGRDANPSQDWGYSNYMTQQTIASITQKLWGDWTATARATFYDQNYNTLV

SEQ ID NO: 729 - protein, 931 aa, Neisseria meningitidis MC58
MEIIMRNLCFLLTLVATLLLPGRLIAAALPQDEKLITGQLDNGLRYMIYPHAHPKDQVNLWLQIHTGSLQEEDNELGVAHFVEHMMFNGTKTWPGNKVIETFESMGLRFGRDVNAYTSYDETVYQVSLPTTQKQNLQQVMAIFSEWSNAATFEKLEVDAERGVITEEWRAHQDAKWRTSQARRPFLLANTRNLDREPIGLMDTVATVTPAQLRQFYQRWYQPNNMTFIVVGDIDSKEALALIKDNLSKLPANKAAENRVWPTKAENHLRFNIINDKENRVNGIALYYRLPMVQVNDEQSFIEQAEWSMLVQLFNQRLQERIQSGELKTISGGTARSVKIAPDYQSLFFRVNARDDNMQDAANALMAELATIDQHGFSAEELDDVKSTRLTWLKNAVDQQAERDLRMLTSRLASSSLNNTPFLSPEETYQLSKRLWQQITVQSLAEKWQQLRKNQDAFWEQMVNNEVAAKKALSPAAILALEKEYANKKLAAYVFPGRNLSLTVDADPQAEISSKETLAENLTSLTLSNGARVILAKSAGEEQKLQIIAVSNKGDLSFPAQQKSLIALANKAVSGSGVGELSSSSLKRWSAENSVTMSSKVSGMNTLLSVSARTNNPEPGFQLINQRITHSTINDNIWASLQNAQIQALKTLDQRPAEKFAQQMYETRYADDRTKLLQENQIAQFTAADALAADRQLFSSPADITFVIVGNVAEDKLVALITRYLGSIKHSDSPLAAGKPLTRATDNASVTVKEQNEPVAQVSQWKRYDSRTPVNLPTRMALDAFNVALAKDLRVNIREQASGAYSVSSRLSVDPQAKDISHLLAFTCQPERHDELLTLANEVMVKRLAKGISEQELNEYQQNVQRSLDIQQRSVQQLANTIVNSLIQYDDPAAWTEQEQLLKQMTVENVNTAVKQYLSHPVNTYTGVLLPK

SEQ ID NO: 730 - protein, 388 aa, Thermotoga maritima
MRKLFWGVVCGAAIFMLSGQAAFAALTLYEADATTFSVDGSFNTFYVHSDSDKNAAMEAIAGSDREQSRVKMGFLPNWIGFNFSKQIGDLKLGGRASFWVTINDSDNNVTESGIDTRQFYGTIDGSWGQVLIGKDFTIFNRSNIFLDEILLGYGNVSDAMGLIDGNGVSFGNIGTGYTYPFPSAQITYRSPEVAGFKLTIGVVDPSRTAAGGEEHAPRFEGELTYNYTYKQGGITAWTGFLTQSSENEDNEIDTNGVSYGIRASFSGLALHASGYQASGLGFELGAGADTTLGLPVVDANGDELDSEGYLLQAAYTLGAFRFVGSYGESELDGDVGVEDWENETKTGAIFYTVNEGLKLVGEYNINEISIGNAEEETKTIALGAIVSF

SEQ ID NO: 731 - protein, 323 aa, Helicobacter pylori
IKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNKVATHVPAVVGKPGSDVYVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIE

SEQ ID NO: 732 - protein, 700 aa, Escherichia coli plasmid pO157
MFTSTRIAAALSGAISVLFASAACAQGADAPAASTLPAINVNATRVPDSLTSKSTGSLKRTLEQTVGSVGFVDADSYRNTYAFTLRDVLKDVPGVFVENRYGQELRLSIRGSGIARSYHTRGLEILQDGIPTNLADGSGDYYQIDPLALQAVQVYKGGNGLAYGASTLGGAIDFITPTAHTADAPNILRVEGGSYGTVRTSAQISRVLGPLDFLANFSVNHADGYRDHSKGQYEQFNANVGYRFSPTVETRFYVGVYVVDQLLPGTLSLSDALNNPTKAAPNAMSGDQARNTRTERIANRTTVKLDSGELQFDTWAIHKSLYHPIFQALDQDGWTYGFAPRYTGHLTLGGMRNDLIVGARFFGGRTQANQYVNVNGNKGAQTLDSTQTAFNYEAYVENRLFFVPTVALMTGVKVLHSVREYIDNGGLPRSPNYKSTNASYSGVNPKLGLLWQPDANTQAYVDITRSQDVPDFTDLTQTFSNTTRFTPLAAQHAWTIEFGTRGSRERVSWDVTAYRSLVRDQLLQYTTNPDVPASTFNANKTVLQGIEAGASVELLRNVTGRGAGDKVTLSGIWNLNDFRFKNDPQYGNNRIAGVPLNVLRATLGYARPSGFHIAATLDWVPSGAWADDANTLRVPSYTLLGLQAGYDFRNGLSLFVDARNLTNKRYVSDISTVADARTANTAIFYPGEGRSVFAGMRYAF

SEQ ID NO: 733 - protein, 370 aa, Salmonella typhimurium
MKIKLSKIVIASSLLIFANMSYAEGVKRFSVSAGWLHVMPQGKANPFNINTSVKNGTVAKVGSISPTSFLNSVDPNATEVDVGGEPFNQKEFLELALNDDFLKGLLLDEEGNIKPEVAGEATIQGLEQWHQNDAGLEVDDTDTLGLMFNYYLNDNVSLQFIGGIPPKVDIKGQGEILAPLGGVALSPHELVKILFPNGITLGQAVPITNLGNKPKAASVRAWTPAIEAQYQFGKSGVNKFRPYLGVGLMYAHFNDIKLNDEIRSDLISAGHMIQNVLDGKAGAALDRKESSGNMVVKVDADDAIAPIFTAGFTYDFNDSWYTVASVSYAKLNNRTQIDVINQNTGARLIHGSTKVDIDPIITYLGVGYRF

SEQ ID NO: 734 - protein, 718 aa, Haemophilus ducreyi
MRRAVSNGGIAISFFCLATAGHAQTLPRQDAIVLDQVVIQGGDDSGKSGVRAKTATIGPLGRREIKDTPYSVSVIDKTLIENQQATTLPDLLKYMPSTQMEARGGGDVGRPQSRGMQGTPVFNNRLDGMNIVATTAQPIEMYERVEVVHGLAGAYFGPASPGGLFNFTRKRPTQDPYNRINTGFTGKGTWLAHGDFGGHAADGMLGYRINVLSEEGDGYVKGSDLDRSLISGAFDINLTDQTTIELNASRYRFDKFGFPGSFSYDNSVTLPDAPDPTKVGYGQKFAGYGLEDTLVGGLVKHRFNEDWSLTAGMQHQRVSRWFVSVSNALLDDDGNYSNSIDGGVSGQFRVTSNIAVLNGTLFTGGVKHDVHLGTTGVNWENYSPRSGNPSVQGYLGDASIDNPVQWDAPTGLVRNGPRYRSFSNRSQSLVLGDSITFNGQWSAILSGSYTWFDVKNYDETGTVTQKYSERGLSPSVALSYKPAENITTYVAYVDTLQSGGTAPTTAANAGQVLAPERSKQVEAGVKADLGGLDASVAVFRIERPFAFTGEDNVYRIQGDQVNKGIELELRGQLLENLNIHGGVTLLDPKLRNTGNPLTSDTDVVGAPKVQANLFMEYFFKSLPELSASANLHFTGKRAGNNINSFKVDSYATLDLGLRYERQMTKDTTAVFNLAINNVFDEHYWASIFPGSIDGATRGANSAFLGAPREVRLSASFKF

SEQ ID NO: 735 - protein, 1086 aa, Rickettsia prowazekii
MSKFNPWAYGAAAAALLAAAPTAVYAQETSSQLRGSIVDASGNPISGARISIIHTPSGTVSTATTNDTGSFFASGLRVGGPYTITVAASGFDGQALEDLNLRPGPQAPLRLTLNPQAADVIVVTGQAINATDLNNGVGSNYTARDISNQPSLNRDVIATLARDPLAISNGPNNLSVAGVNPRFNGVTIDGARQQDAFGLGSNTFATARSPINIDILESVSLVASDYSVTTGGFTGGGVIATTKAGTNEFDGSAFYYYRDQDYYGEESFGGERTYNPGEFDEKEYGITLRGPIIEDVLFFSLSYDKFETASAIDFTASDNNSGVNPQFFDALNSLVQNTYGIDMLSRPAQAAVPSETERYFARVDWNINDDHRLRVSYQKTEDAGISNIGSRNFESAWYDTPTSLESWSGELFSNWNENLSTTLRASHIDFVRGQNCRAADGVGTLEFRLSAADVAGTALDGLLTNSSEQTFTGGCDRFRHANEYSDERLTLFGQADYVWNDFVFTVGGEYEQLDVFNVFVERSRGRFIFNDVDDILNQTARVEYRNATSNNSADGAAAWGYDRYTAFGQATWQVLDNLELTGGVRYERLETSDQPTFDPTFANSVGFDNTATIDGLDLVMPRLGFRYEPFDRTTITGGLGIFAGGDPAVWTSNAYQVPAVFASGNFSGVTGNSVPQPLLDQVANGTALAIDAIDPNFEIPNDLKASLRIDQEFDLDFGGFNLGSGYLFSAQVLYTEGQTTFLWREAAQTNEQPYAQTGVAPDGRTIYADLDDLGVSNRTILTNGSGGESLVYTLSLQNDFDNGFGFFASYAHQDVEMLTEGSSSRGISSWRGQLAVDRNFPEARTSIYQVEHAFKLAFSYEREFYRDLTTRVDLFGQITSGDPYTYTFDVSSSNALFGRAGNGESPYDNSPLYIPTANDARVVYGSNFDLAGFNDLIDEQGLARGQITEVNNLSSRWNQRWDFRFQQDLPGIPGADRWVGDNRLKLVFDVENVMNLINDEWGTYSSGIRNGQAAIVSADLVSAADVAANGIDAAAALTGDAPRTTCLTAGDCVYRYNRFNSGNGSTDRPSSSASVWKARIGIRYEF

SEQ ID NO: 736 - protein, 654 aa, Chlamydophila pneumoniae
MVFFILFFCLIFLVNSALAEESQLEEIIVTATRVEEPKKDVPYSIQVITQEDIKNSTAKNAGDLIVESSIGHVHKYPGLSTSSIGLRGFRTDLFDDLKSRVLILINGNRAGTVNLATIPVDDIERIEIVKGPASVLYGSSAMGGVINIITKQGKQEGIYGSIGSEAGSWKYWKTKGDLNGKKGVFDFYVSANRSSMDEYSTRDYGKIKNTGYNDETVSARFGYSFFDKQYISFGFQHWMGWDIGSPGARYSPDLDDYKDIERNRFDLEYKTETFKGGYYFTKISDEDHEGSTGNSELTLKKTTTQGLSLQKIFSMNEQRIIIGAQWDRIEVKSSRSTGAPYNPNSEYDSYGLFSEGRLSLFNKKLLVNAGVRYDYFEDKILPTEGITSLKPRKENLDHVTVRGGIIYKLTDNLSIKSNAGTAFRAPAPDELATDYVSSWGTRYIGNSDLKPEKSKSYDVGVACTKDLFKSELTFFHSIFKDKILSYYDSTLKAQTFKNVEGAIIQGIEGNFSYDIGLFVGLNFSLEPFLNFTYHTRYSSKDESEIQKYGKTLQYIPKSTAAFGIKAGKDKWDLRLIANYAGDEKVVDWNPSSSNYGKVITKNDFTVVNLKGSYRPLKNCELTISIENLFDKGYEYVLYYPMPRRTIIGGLKWIF

SEQ ID NO: 737 - protein, 169 aa, Chlamydophila pneumoniae
MKTVIFAAIAAATAVSAPAFAQDAAPFTGPRAGVTMGYDKIGGEDGFAYGVTAGYDLALAPRIVGGVEVSLGDTTVDDSGLDVSRDIAASLRAGYVVTPRVLAFGKVGYASTRFEFDGDGAGLEGVRYGGGLEFAATPNTYISAEYQRTEYEQNVGGRDAAMVGVGFRF

SEQ ID NO: 738 - protein, 1070 aa, Chlamydia trachomatis
MKNILFTSNKVHTTARIGVLFFSLCFSPLINAGNAEKPMNGIESSETTQQNKIKITGVVTDSKGESIIGANVVVKGQSNVGAITDVEGRYQIMIPSDNAILQVSYLGYVTEEIKVKGRRNINVMLNEDSKALDEVVVVGYGQQKKESVVVSMSSIKPKDIVVPSRSLNNSLAGQVAGLIAVQRSGEPGYDNAEFWIRGVSTFAGGTSPLVLVDGVPRSMSDIEPDEIETFSVLKDAAATAIYGAEGANGVVLVTTKRGRVEKAKISFKTEHTISSPTRLPEFVGSADYLDLFNEALHNDGELPQFSDDLIAHYRNNDDPDLYPNTNWIDKMLRKNTFTHRYTLNVRGGTEKAKYFVSAAYYNESGIFKGSPTKQYNTNIGIDRINLRSNIDMNVSSTTTVGVDLALQYLVNNYPGTGTANIFRSMLITPPYTFPAVYSDGTVSTYSQERDANMRNPYNLLMNSGYAKEYRTAIQSKVYVDQKLDFITKGLSVRLNASYDYDSEMIVRREYNPTRYHATGHDENGNLLFATVVSGNPELQDPKNSATSATKKIYIDAAINYKRTFDQHEVGAMLLYMQKETQYHNVALPYRKQGLVGRLTYGYGGRYFIEGNFGYTGSEAFASGNRFGFFPAVGLAYYISNESFYPEVIKKYVPKLKLRASVGRAGNDNTGGTRFLYRPTYKMDAGGFTQGYNDTGGGLNGIGNGIIEGRFAAPYLGWEVEDKQNYGFDIGLFDNRLEVIFDYFDSTRSQILLQRQTVPQLGGLRDDPWQNFGKVRNRGVDMSVNAHQNIGKVKLSARGTFTFTRNKILEYDELPPKYDYQAITGKRVSDKDNLYYIAERLYTEDDFTVSTNANGLKTYKLRSEIPQPTLGGLLGPGDIKYTDVNGDGIIDSYDRVRGIGHPETPEIIYGFGLNAEYKGIYASIFFQGAGNTSVLLGGKTSEGWYPFSWGVDQSNYRTFALNRWTENNPSQDVIIPRLHKSNANNANNRVASTWWLRDGSFLRLKNIEIGYQIPKKFLSKIGFEAARIYLMGYNLAVWDHIKYFDPEAGNANAGLNYPLPRTYTIGLDFTF

SEQ ID NO: 739 - protein, 768 aa, Chlamydia trachomatis
MNIVRTNKNRLFAGVATAVMSLYFTGIAVSPSRAQSAEPHVLPPVSVEKPQQRARAASPTRSRNPQRRSARIAPRPSAEPPTSAPAATAAAIHTIGTLPVPYAGGQVAQGARIGMLGNRSFMDTPFAVTAYTSQRIRDQGAQTVADVLEADPSVRSTHSAGGLLDSFYIRGFPIGEGNLGEIAFDGIFGIAPTYRVFTDYAERVEVLKGPTAFLYGISPNSAVGGTINIVPKRAGDTDLTRLTTDYASNAQGGGAVDVSRRFGEHKEFGIRFNGSARGGDLPIDNLERGAFVGSLALDYRGERLRATLDIIGQRENLTAPQRPFYPSSGNFAIPSAPNGSRNVQAPWEWSKSEDKSVLGKVEYDLTDNVTWFGAVGGGNSRVHRLFGLPTMLNSAGDVSIRPENAIFDVDRLSAETGVRSRFETGAIAHTMTLQSSYLNQTLDRGLVSGTTQFSNMYNPAYRPEQYVADPTRVAKASESTLSGVALSDTLSVLNERLQLTVGGRFQQIDSKNYNISTGALTSSSDETAVTPLVGLVVRPWSMVSFYANYAEGLSIGETAPTNAINAGETLAPYKTTQYEVGTKFDLGRFGLTLSAFQIEKPFGQLETIGSNLVFSEGGEQRNRGLELNVFGEVTPGVRLLGGASLIDGELTKTTSAATLGNRPVGVPTVQANLGGEWDTPFVSGLTLTANVIYTGEQYVNTANTQMIPSWTRMDLGARYKTLIDKRPVTFRASVQNVFDKDYWSGVASYSTIAQGLPLTVRLSMTTDF

SEQ ID NO: 740 - protein, 787 aa, Synechocystis sp.
MRSNMKLRPVVVALMASGALLSSVPVMADGITASTQSAENSSVDVGQVNAAAQGTSTLGSREAQSLSQKTRFDSGQSIKVLDKHELAAAGPVGGSAQALSYAPGVSVSSYGYTGSTKTSISVNGIKQGWGGFSGGQIDNGSLSVTFDGVPMVNPSSGLWESPQVPQNGILQGIGITYGPGNPVDRWYNNIGGQIDFVPLQPTNKAGASIKMSYGSYDAKNIVFNVRTGSIDGWSTILAGGSGSSNSYRQTPDGFANPSYNYAWFLKTRKTFSNGDFSLGAYLAKGSGYRPVSIPLNPIAGVTMDGTPNSPLYSQATSGYYSSLPENVWFKRDGNTTWLVYSKLNLALDSMVGLHNTLWYRNGHRLHFHYNNYGLSNPKNLYEYNNPHTDVYGDKLWFSVALPYNDVDVGGFFLNSRYNSRNAFYNTNPPYYGSASVPNAHYRSDYFDQTDLAAFIQDRISPMENLHITPGVRFINYQTRYTPAAQSDFAAAYALSPQNNQGALPTASNSFTKVEPSVDFNWQPMKWLAVFASYAQAYKEPQVGGGGGLYQATPPIYSLEKSADYNAGIKIHFRDAAYLHNFFLLASFYHLHYTNQYIPFYDANGNYLGDANGDSIYQGVNMALEDDPIYNLHVFANLNFEKATFAHYVTGGVSYDGLPVSNVPSSTFNIGTAYSYYLSGVLLEPRIWYQYTGAQNIFNNNTTAPSQQKMPGYGTVNLGFDSTIPTRGSIPGLKDVKLSVDVLNLANNRYNEFQYITAGGLLGGSSAGQVLALPGAPLTVYGSIAVNF

SEQ ID NO: 741 - protein, 938 aa, Synechocystis sp.
MSNQHTFRTSSRTPLARIPFQLSLLTMSISAVLSGCGGGGGGSARNPGNGGPSYVASDLSNADAAHARGITGAGVTVGVVDTDFNVAAPELAGRISKDVYSLGGFVGASGTGNLHGTEVAEALGGTNTGIAPDVRIHGIAAGSSTNGVQLNTAIYDRLYNSGVRIFNQSLTVGSIAAPSNAATYNNIYQPFVSKGSLFVWATGNDYSSQPSMTAGLPTLYPGLQAGWLAVTAVNAVGGGQGFSSADTTPGVISSYANRCGVAANWCLAAPGDFVSPTAGGRVYGTSFAVPVVTGALALVQQAYPWMNADLLRQTILSTATSMGDTATYGWGLLNAGKAINGPALFAQSLALGSNVNVSFNGMSSTFSNDIGGDAGLIKNGTGNLTLSGSNTYSGNSRISGGTLNITGSVSSGVQIDAAGNLSGDGGQIGGNVSNSGRLSNTGTGLTITGNYTGSAASILANDINSTLVVGGTATLGNSHLVATVPTGSGNANNYVTAQASNTPKTVLSAGTVAGKFGDIGFQTVGTAFPPLLTAKVTYTVKDVDLTISRVSTTSVAAQAFAGDATRTNTAANVEQAMLIADASAAANPNGSALLTSAAALQQTASIAALGDALDSLSGQIHASSQALTFQQSQTVNRALSDRMALLGSQDKQVKTGLWGSTFGASGKLAQSGYASGDTGLWGGQFGVDTRLGEHAIAGAALSYSDSKASFDRIGGTAKGQDVSVSLYGRYTIPAADTAGNSKAYVAGRIGAATVSSTVDRVALAGAEIESLQASHTDRMLSAYAETGYAMKASPNTLVTPFAGISYDHLQRGAFAESGGSFGLVAGSQNYRQWMAQLGVRAESDVTWFAGRSTVQTYAAWQHAMTDGKLDFQASFAAAPGSSFAVQGIGLARNTGWTGVGISTAINRRMSWYANYDAQFGRGGLLNNLVLVGIRIKLD

SEQ ID NO: 742 - protein, 824 aa, Synechocystis sp.
MPRAALPRPIATAIALALCGLTVLATSPAAAAQDAQTASAARQRYSIPAGPLAPALRSLAGSANLLLSFTAAQTDGRTTAGLDGDYTAAGALTAVLAGSGLQAVPLQTGGYVLRPAPAAVTSQGEVDAWLLPTVKVTAQAERRAATSGTGSYTARAVSIGRGEQRLKDIPQSISVVTRQLMDEQNITSVYDALASTTGITIVQSPQGGKYIYARGFDITTVQYDGVPLNRGMYGRASNYSANMGIYDRAEVLRGAAGLLQGAGNPSGAVNLVRKRPLDVPGVSVMLQAGSWDRYGALLDASANLTDDGALRARGVIDYQDQRSFVDGVERRTPTYYGTLDYSVSPQTQVSLAASYEEFEGRPFFGGLPSYTDGRDIGLPRSTNLGAQWNRQSSSNRGLYLDLDHRFNADWVFKLSAVQVHERHNLKYASSSRAINPANGTGALLAARTISEADVAGVDANVIGHFNALGRRHELVLGSNYAETTVDTVYGNKNNFQTFNVFSLQRNVRAISDEEIFASAREARHGTSRELGLYSALRWQLTDPLKAIVGARVSWHDTKWNTTTTGLSPSQSIEHTRETGQVTPYAGLLYALTPTWSAYASYADIFQPQNAQNEAGDMLKPMTGANYELGLKGEWLDGRINTAFALFQVEQKNRAQADLSTSPTCRNNDFCYIDSGKVRSRGFDAEVSGEVLRDWNLFAGYTFNRTTYLQDVSSQGQTFNSYTPKHLLRVWTTYRLPGVLQDVTVGGGVSAQSAAYRQIGAATADIPGRAVWNALARYQVNRQWSLAVNLNNVFDKRYYSTLSSFVNGRYYGEPRNVMVTLRGAL

SEQ ID NO: 743 - protein, 879 aa, Deinococcus radiodurans
MRHMATLALCALLAMPEGAVAAPTTMPATPAQTASTGKAAKTPSANTTKPGAANATLPAPATAPASGPASGPATAPTTGAASGMPSTSESEVYRLDPLRVSGETQQMGKTVIDGEKLNSLPSPGRTINDALRTRSDVQFDEGAYSSTQGGEIRPPRVSIAGSRPYENSYVIGGISTANRIDASGEDRSTADGVAPTGEAQSFYIDTDLLDGVTLFNNNIPAEYGGFTGGMVKADIRDPRMDGVHGFLKYRHTRDNWAHITAPDMPSGTTQVDKQDRFQRHDGSVAVEGPLTERLGVILNYSVKHSVIPMETGWGSPKDQYRTNENFISKLAFMDEGPFKGSLTFGYAPYQREMYISSRLDSDFAMDGGGFFTALDGTYDFGPVAWKNTLGFSRSEVSRYGTGNVTSSWLRYKTIGGSRFDSAYATWGSGTTASEGSMGDYEQSQDETTWKSVLDFDPVHTGILSHVFQTGIEVLHMDAAAESTGYTTYYSPSIPNSQADRDKIPAGPGNVAGEQFAQNKTVQDAYSRSASVNSYAWFGQDTIEIGRLTLRPGLRVSHDDLTGNIDPAWRFMADLDVFDDDVVHLIGGANRYYGSQMLAYALRKNTEMHRYKRSFSGGKLGDWVYDKTTGGKNYNLDELDTPYADELMGGITLKALDTRFGMRAESRKHRDQLRTALDANGDTTLNNSGKTDYWGVTWTVERDFNTEHMGDHTVELGITRSNTKSDGTDFDSSFLNGDTGSVIEWEKVYFEGSLMPRSNLPASNYNRPWVGTLTHTARFMDDDALRWFNVLRYKGPGTDIVRTGTFTDTDGLRYDAYEARTFSDSVTVDTAVEWDALRLEDHVLTLTMEVSNLFDQKSNVDSSTGYVMGRQYYAGFKYTF

SEQ ID NO: 744 - protein, 1254 aa, Aquifex aeolicus
MRIIFLRKEYLSLLPSMIASLFSVNSVAEVLDSCQGYDIKASCQASRQSLSGITQDWSIADGQWVIFSGMANNASGGAVFLQQSAEFTISPQNETGMTLFANNSISGEYNNGGAIFAKENSTINLANVIFDSNVAGGYGGAIYSAGTNDAGDMDLNITNAIFANNIANDGKGGAIYSINNDIYLSDVIFDNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEMSIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGEQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGDTSYNRSVIFTDPQQHSEMDVTTDVDTRSATTGQGRNIEMRADGEIHVEDGVDTQWGGLMADSTGQQLDSVSTLTKSGGGTLELTASGTATSAVRVEDGTLKGEAENIIPYVSSLWVGEDGVFETGKNQDIRSIDATSGGDIDITDGTVLRLTQQDTNQALDASLFSGDGTLVNATDGVTLTGELNTNLETDSLTYLSDVTVNGDLTNTSGAVSLQNGVAGDTLTVNGDYTGGGTLFLDSELNGDDSASDQLVLNGNTAGNTTVVINPITGIGEPTSTGIKVVDFAADPTQFQNNAQFSLAGSGYVNMGAYDYTLVEDNNDWYLRSQEVTPPSPPDPDPTPDPDPTPDPDPTPDPAPAPTPAYQPVLNAKVGGYLNNLRAANQAFVMERRDHAGGDGQTLNLRVIGGDYHYTAAGQLAQHEDTSTVQLSGDLFSGRWGMDGEWMLGAVGGYSDNQGDSRSNMTGTRADNQNHGYAVGLTSSWFQHGNQKQGAWLDSWLQYAWFNNDVSEHEDGADHYHSSGIIASLEAGYQWLPGHGVVIEPQAQVIYQGVQQDDFTAANHARVSQSQGDDIQTRLGLHSEWRTAVGVIPTLDLNYYHDPHATEIEEDGSTISDDAVKQRGEIKVGITGNISQRVSLRGSVAWQKGSDDFAQTAGFLSMTVKW

SEQ ID NO: 745 - protein, 185 aa, Aquifex aeolicus
MKKEALVLILSAGIFAINTAQADTNSLTAGYSQGKMKDGGNIRGVNVKYHYQGDFPVGIITSLTYMYDNDRSSGTDEDTGETYHDKSNVKYGSLMVGPTYQVNDSFSLYALVGAAILKARDKENGTWEDGSPYTNSASINEKALAWGAGVQMNPTKNFVIDVGYEGSRELLTQINGFNIGVGYRF

SEQ ID NO: 746 - protein, 257 aa, Pseudomonas putida
MTKSLLLSFAALAALSAPAAAQQYVSGSVGLNMQTDSDNEGAFSRDFVTGDGVAVPPGAVLPAGTGVGWTTEFDSGLFVSAAYGYRLNEMFRVEAELSYQGADVDTHTDVQAGGSALGAADAAVLITGSSPLGVTVSDLVADGQGDLTSTGLAINGYYDLPIENSPFALYAGAGVGIAEVKVDYSPSGVAIVDDKEMSAFFQAMAGGSYAISDTTAFYAGYRYRAYKDAETDSVLIPASLDVENSSHILELGVRYSF

SEQ ID NO: 747 - protein, 1034 aa, Yersinia enterocolitica
MKVKYALVLLSLLISSMELFAQEVIDLKGCVYDEQKTPVPGAAVYLKDRPGVGVSTDIDGEFSIKATIGDILVVSFIGYKTQEKLITKQEKIIITLSPETEELEEVVITGLGTSQRKVSLVGAITNVDMNQIKAPSASINNMLGGRVAGIISQQYSGEPGKNVSEFWVRGIGTFGANSGALVLIDGLEGDLSMVDPADVESFSILKDASATAVYGVRGANGVVLITTKRGTTEKLQVTARANFTISKLTRMPEYLQAYEYAQLANEAKIVRGDLPLYDDIALYAIKHQLDPDLYPDVNWRDETLNKTSFKHTYYASARGGGSVAKYFLSLGMSKEDAAYKIDKNSKYNKGLGYNKFTYRSNIDMNLTKTTNLYFGMEGWFTVNKEPGNSEQNATDAVWNAQALLTPLTIPTKYSTGQLPSYGTLNAYSPYVMINHTGKKQTENSNNQITLALNQDLSFITKGLKIRAQGAITRNTNYSERRYVLPEMYYATGRYANGQLQLVKKQDEVKAQFSNYQNQYSKYHFESTLNYERLFGTDHRFSALVYYYMSSEKNLQDIANADSNFETMAAIPKRYQGVSSRVTYGFRDTYLMDLNFGYTGSENFQPGKQFGFFPSFAFGWIPTQYDIVKEKFPWLDHLKLRGSYGLVGNDRITDKRFPYLTIVNSGAPLGWGGNVGGGISESVIGADNLEWEKSKKLDIGIEGKLFNNKIDFVMDYFWDKREGIFQQRAQIPNFVGLVSLPYGNVGQMKSWGADGNISYTQQINKDMSFVIRGNFTYSKNKIDNWEQIEQKYAYQNFSGWPYGIQRGYIALGLFRDEADINNSPIQTFGNYEAGDIKYKDVNGDGRIDIDDQVPLSYDNYPRLMYGFGGEFRYKNLTFNILFKGIGKKDFFYTSEDSGFGYYPFLYGETGNVLSIVANSSNRWIPASYSGDPSTENPNARFPRLSYGKNSNNTQKSTFWKANGQYLRLQEISVGYNLKLKAFSKIGVSSIDLQLVGQDLYVWDKIGGLWDPEQTTKNGRAYPIPATYSLQMYINF

SEQ ID NO: 748 - protein, 780 aa, Pseudomonas brassicacearum
MSGFSARAFGRYLVSVGMVALAAQAQAQTPPQPEAASDEIIVTAQRRVERLQDVPISASVISGADIQKKNMTSLEQLTAETPAVVVTKGGAANRLSIRGVGSGDNNPLFEQSVATFIDNVYQGRSRSNGASFLDIARVEILKGPQSVYFGNNSIAGVLNIVTRDPGDRLEGYARGSYNFDFNAATLEGAVGGPISDTLGIRVAGVATRGNGYIRDEGLGGLRIPRVRSYAGRATLRWQPIEELTWTVKASAEHSRQTGAIADEIAYCPPDPLFTAGATGSCLVALNRGEDVKLNQVRSHSPGQGIDLDTQSYVSTLAYDAGPLELSAITAYSHTKYNQRLDTDGTSATLTHFTTPERFSQFSQEFRISTPRDSWVALDAGAYFNREYIHGGVNYNFTSLNSRLTGAFAALAPLGSFGQYDDYRQRSKTYATYAHLTFRPTEQLTLSVGGRQSWVDKSIVLNQGFGIAANSFGDITPYPDATLQALGDRFGTAAGLGVAAVRNARRLDAHFSPSAVLSYQPTPALNLYAKYTNGFKAGGFNGLEHTGAAAALSFGPEYVDGYEAGIKSQWFNRRLTLNVAVFRNDFSDLQVSASQNFGVGVVNVIGNAGGARAQGIEVEGRWRITSELTTGLSLTLLDSKYTDYRNAAGNALDVQQGRPFVDLTGTRTRYAPKYSGNYTLDYLAPITSGLKLHLNGNAFFTGKYNFSNNNDPFLAQDAYVRLGAIIGLADADDRWEVSLVGKNLTDKLVRIFGTNLAQSRGSYLIGTDEPRSIAIQANLRF

SEQ ID NO: 749 - protein, 383 aa, Plasmid ColIb-P9
MKKSHLLVGMLAGMTLTPAWAQSTVTLFGLIDQGIDYTSNVRGHGVTEMLSGAAQGSRWGVRGSEALGGKLSVVFQLENGFDASSGRLMEGGRMFGRQAWVGIAHDDIGRLTFGRQYDSLVEYLAPLTANGNWGGFLFQHPYDNDNTDNSFRLDNAVQFNSSNMGGLQFGATYALSNTPGQISTNNAQSLGVSYSVNGLSLGAAWLNVTNPGATALGAVTTDDAGFVASRHRVYGAGVNYQLKQVTLGFVYTHTSLNDPTAYSYISGAIVPAGQHASTLKFDNFEVNANWAITTALMLGAMYNYTQATLDTSAGTYRPKYHTFGAMLDYALTKRTDVYAMASYQRTVSANSGTALDQAYAGGADDISSTQRQLVGRAGLRHKF

SEQ ID NO: 750 - protein, 362 aa, Pantoea stewartii
MVNEEKHMKKVLFGTTMLVAAGAFAGAAVAADPITLKLGGKQEQYFGGVASTKDGGREDGFGIDTDTEVYFSGSTTLDNGITVAARIELEAEADNANNADKQWVTVSGAFGKIEAGQRSGVFDEFMVVAPTVGSVSLDDSKSWLGAGNGINGSVTQLYLDQSLDDDDAKVTYVTPQFYGFSAGVSYTPNVGGPRANNSSIVAPTKKNRDLVQMAVGYDAEFGDVGLKASAAAATQSNLWIYQGGVNVSYAGFTLGGAYTEYDDQSAAAVASWDADASEGRVWTAGLSYAVGPYSVGFTYGQTDNDSKSGVDAAIYKIGGDYKMGPGIDLVGNVFYGETGIGSSNVDASREGFGAVTGIVLAF

SEQ ID NO: 751 - protein, 682 aa, Agrobacterium tumefaciens
MLSIMTSAAIAWSTGAFADALPPVTVVSDPPSEPSVRAGDRVTAPGDRKGPRRHGLEAGALERLNADRLEELAGAVPGAHAGREEGGLGTAWTLRGFEVTTPQWNGLTDIDRLFVRDPYTVEQVEVVPGPDAILQGVTSPGGSIRYQGKRPEYTPAHEVGVEAGYPDHRRVVADTTGPVGDHLAYRLTLAGQDGESRPAEQQTERLHALAGLAWRYHADGELRLEHGFQRNRQPYDMGTVWLEDGPVYDTPLHSPDQESDRRYQRTALYWDHALTEGLAVSLRAAHSEVEREEAIVGFYSFGLLPAPEPVAGYAARIDDQYTQDDLRLQLEYEHDTARTRWHWVVGGDMHRQEIDFRRDQLRYWDDDDDWWQQFSVDPRDPDFAGIELSNLALTRQERPEETDRYGAYLANRLEVGARWAFTAGVRHTEYEVRKANEDDPELAIAAEDRALTWQAGLQLDVTRRAQLFAHAGTGIRPNEGIDRHGDFLPSRESAVTELGWRYAPDRRQQLVVAAYHLREENLPQEDEAYSEEDYFRAVGEVEVEGVEARYVLDTGAWRIAPNATLQRSRNYDEDEPAERGNHFEGVPRHLAGLEVDHDLGAYTPLALRLWYCAEYVGGWYLDDANDYRTDGYTLHSLGAIYQWPEGTRLDLRVRNATDERYLAAPRVQGERREVRLGLSRRF

SEQ ID NO: 752 - protein, 250 aa, Escherichia coli
MNKKLLCLALLVSPTAMADNMVNWWDVSVTGLYGENYDLAPSDKQTAVTFETAGDWKYGDWFAFQDVTYFNGSNGGKDNSTYGEISTRFSAGKILGKTVGFGPVTDLSLALALEEGEGPVESFLYGVGMDIKIPYFSYFQLNTYRRHAMGSDNISDGWQLTPSFRMDFPVGNSNIVFDGYIDWVFATDEASYETNFHFNPQLKYDLGAVVLGDQQKNKLFVGIEYDYWKNKYGVDGMDQNTYSVIAKYHF

SEQ ID NO: 753 - protein, 1256 aa, Chlorobium limicola
MDTLAGNRLNTKLRDVGNAISVVTTQFLEDTGATDNKTLLQYTTGTEVGGTQGTFAGTGDGALLDESSNFINPNQNTRVRGLTAADNTRDFFTSDIPWDGYNVERVELQRGPNSILFGQGSPAGLVNVGLKGAAYENEGQVEVRFDQNNSIRLALDLNKVLIEDELAVRFSVLNNDEKYQQKPAYSLDKRIYTALRWDPAFLNGEGVRTTFKANFEDGKIESNNPRTLPPIDRITPWFDTGTYNGSYISDGNIIGPDGELIAVSKGDTRVYQGLNKQTFNAHQLQQDNVQFPNHGQGRPGVNGGPYSGAFNPDYNPRLGNFADAFGGPINYYATVGGAPVIWQQEIQGSRGIGPDGAIDGGIGGFDFNRSMGVATESDFAKNAGLPFGEFGVYKNNSITDPSIFNFYDTLIDGQNKEEWQNFNSLTASFSQTYVNDMVGFDVSYNKQNYDNGQLSLLTGSQQAIYIDMMEVFPDGNTDGWEPGQIPFSNGTPNPNLGRPFISDKGQFGNNSYASKRESLRVTPFVKYDLSEGDGNWFRNIIGSGTFTGLYSEDTLDRENRNWQQYAIEDQGYIDFMNFANINSFNNGDLAPSTVVYLGDSLINASSAVGANIPGISQKIDLPRNSIARVFDSTWANHPGVDPAADWINNAYLPPELEYPDYAPVDPNNLTEAEMELWPDRRLSTQAENPLNYVGWRDYPYALTASEDSAANRERLTTRASLDSREVESQALIWQGHLLSDSIVGTYGWRKDTVTSRSFSQDTNNHLDGGGFGYLNFDPSYHTLAGARENQLEVQSHSYSIVAHLDQLPMVSDLMDNLPFSVSFFYNNSSNFQPEAARVDAYGDSISAPAGETWDKGILVQSKDGRYSFKLNKFTTNVTNGSSTALSNIGFLGQSQDWGGNWTNQFEYDMSVDNQSHVISHIARNRPAGSPVPPNFSEDLLLDTVDVWNDGQGNDINGNEVDGGRGSLYNYGLAPGETAADAAAREASAIAAWRAWQNSIDPRFYEAWQIDLNSPFRTTDATRISATTPQNLAVTEDSTSQGYEMEFTMRPTENWNIMINAAKTTAVRNNIGGTALNEFIEGYENALNNTAAGDIRVWWGGAGNETTLFQWNREIGSEWTSRKLQEGTNVPELREWRVNMITNYDFTEGKFSGLSVGGGLRYQDSVIVGYTPVIDSEGGLSYDLANPYMGPSEMNLDLWAGYTMELNDNLDWRIQLNVRNAFEGDGLIPITVQPDGSPAGYRIAPSETWSIRNTFSF

SEQ ID NO: 754 - protein, 1012 aa, Stenotrophomonas maltophilia
MEVIMKNKWLLCILLMLFLPFGLFAQVAPPLEKQKTETQEAPENNNEVTTNSDTNTDGDAGKTIKGVINDEQGETIIGASVIIKGEDTGTTSDMDGRFTLEAPEGAILVISYIGYHTQEVKVRKRSLLRVVLKEDNQLLDEVVVVGYGTVKKSDLTGAVSGVSNRQYKNQPVQRVENILQGRTPGVEVTATSGMPGASMKVRVRGTTSINKSSDPLYVIDGIISSSGLDGINPSDIQSMEILKDASSTAIYGSRGSNGVILITTKQGSEGKAQVTFDASVGLSTVRKQYDLLNAYEYATALNDIRGSSTISAEDLEAYKNGTKGINWTDLLTRTGITQDYRLAISGGNEKVKYLISGNVLDQEAITIMSDYKRYGIRANIDSEVKPWLTISAKLNASSLHKHNEGGANWLHVTNFSPTMELKDPETGVYNTDPYNMIGSSPYGEMIVNNSDSYSYNLNANLTLLFKIMKGLTLSVQGGYDYDNSPSYSFRSKLDSPGAINSASNTNALHNYWQNTNNLTWQKQFGDHSFTAMGVWEISRSWDSQLKGTGSNLNNESVGYWNLGNAAIRDASNSYTEFSLASGIVRANYDYKKRYFITAALRADGSSKFQGDNKWGYFPSAAVAWDIAQESFMSNQHVLDQLKLRASFGVTGNQDIAAYSTLGMLSGASYGWGTSTSSTGYWGYQFATPGITWEKTYQYDLGLDMSIGGFNITVDWFKKQTKDLLFQKQVPKYNGGGTYWVNQGKLNNTGVELSLTTFPVKEAVTWETSLNASYVKNEVADLAGDDFVLTANYSDLGGPMQIMKPGYPMGSFYVYQWKGFDDKGANLYQKADGSLTTNPTSDDLVVKGQASPKWTVGWNNTVTWKNWTLNVFFNAATGYDRLNISRFMAASMTGVSRFVTLRDAYFKGWDHVANKADALYPSLTNTDNKSYANSDFWLEDASFIKLKNISLSYRIPRRVLKFASVQLSVSAQDLFTITRYKGMDPEVYTSYDGLDYGAYPIPRTITFGAKFRF

SEQ ID NO: 755 - protein, 944 aa, Xylella fastidiosa
MKKQDVARTVLASALAVALTACGGGGGGIARQSTPAAPPVTSPPPPPPPTSPPPPVTTPTTPEPAIDAHLALTNARAAQALGFTGAGYRIGVIDTGINANHPALQGRVSDSFIYVDPRTNNTAVGDVVGHGTVVAELAAGRAVGQWPGGIAPGAGLVSARIISDRAPDDDGSGDGNEVDGPLGLGPVHADLISAGVRIMNNSWGGLYWNDPTVTNQIAQEYRPFILSNDGLVVFASGNESRSQPSDTAALPSQPGPNGTLPAADLERGWLVVGALDTANPTQLASYSNACGVAMRYCLVAPGTSLFIDPDATAGNVRYFYGSGTSFAAPLVSGAAALVWQAFPYFNNDLVRQTLLGTATDLGAAGVDPVFGYGLLNVGKAVLGPARFDWGTVDVNVTTLRSTWANDISGTGGLTKRGTGTLVLSSTANTFSGDTQVLGGTLQTASLQSARVSVANGARLVGAGNIGGRVDNAGTLQVNGATASIAGNYTQASNGRLALNVGDRLNVAGTATIAGDLQLLGRRDYVANNTTYAVLQATNGLQGTFDTLSSGPAVTFLSATRSYDANTAYVSLQRMDVTAVAASLGAIGTASMDSAIRVEQAFQQVDAQQFQGNGALSGGFIRAAAALQQSPTAKAAADSLRSLSGRAHADSAAMTFHTIDLGRRALAAHFDGLSQQPRLLGNWQRALGGPGEGGATTSGFATSGWMMGNDVRLASGAVTGFAFGETRSSSLGDLDGARGRDRQVQAQLYWGTTLGAAYTLGQVGFGNVNRQIERTLQLGEDRSSAFSDYSGSYLSSNLETGYRLGGAHASLTPYMGLDYVRLRSDGFRESGGDGFGLRADANTSSRTQALAGVRSAYRWRGIQLGGYAEWQQALSSDGLTLDASFVGVDAWAPLRGMQPARSGGLFGITAAAPLGQQSQLRFGYDQRVGERGDDRALSLKYSADF

SEQ ID NO: 756 - protein, 447 aa, Xylella fastidiosa
MIRRAFTLVNVTALTLSITGVLYIGNAHAAAFQLKENSAKALGRSFAGAASAQDDAAIIVNNPAGMRQLDGRQFQADLSTVRFSAEYRGSPGIYRNGNPIGGGNGGDAGMVALLPDSYFHMPFGDNNNVHLGATLNAPFGFSTKYDRNWTGRYHGIYSKLQAIDLGIAVSYDVNPYVSFGGAVFAERLNVDLSNAIDFGSILNARRIPSFSPGSADGYSHIEGHDTSMGFTLGGLFSPDEKTHIGFSYRSEVEHNANNGNAHFTVPENAAAVLAVAAPGTFINTKIKSTIRLPASATTSFTHAIDDRWSIMAEVTRTAWSKLDKITIHFASSQPNNVLNFSYQDTTFVALGTEYRFNDMLTLRGGLAYDQTPTTAEYRSVRVPDNSRTWISFGMTWKPSKQTDYNIGYAHLFIGHPTITQISATGSTLAGAYNINADLLATSINYKF

SEQ ID NO: 757 - protein, 491 aa, validated - Serratia marcescens
MQMKKLLPILIGLSLSGFSTLSQAENLMQVYQQARLSNPELRKSAADRDAAFEKINEARSPLLPQLGLGADYTYSNGYRDANGINSNETSASLQLTQTLFDMSKWRGLTLQEKAAGIQDVTYQTDQQTLILNTANAYFKVLNAIDVLSYTQAQKEAIYRQLDQTTQRFNVGLVAITDVQNARAQYDTVLANEVTVRNNLDNAVEELRQVTGNYYPELASLNVEHFKTDKPKAVNALLKEAENRNLSLLQARLSQDLAREQIRQAQDGHLPTLNLTPSTGISDTSYSGSKTNAAQYDDSNMGQNKIGLNFSLPLYQGGMVNSQVKQAQYNFVGASEQLESAHRSVVQTVRSSFNNINASISSINAYKQAVVSAQSSLDAMEAGYSVGTRTIVDVLDATTTLYDAKQQLANARYTYLINQLNIKYALGTLNEQDLLALNSTLGKPIPTSPESVAPETPDQDCAADGYNAHSAAPAVQPTAARANSNNGNPFRH

SEQ ID NO: 758 - protein, 394 aa, Xylella fastidiosa
MTRFTTTTTAIVALLATTTLATAGGVERQAQSPAILFEDGTYVELGFTTVNPDVSGVQQRTAGATSLAGSTSGDIAPSYNYATLSYRQDITEELSFALIYDQPIGADVNYMPNGGSGYLYGSGAGSQAEIRSQALTLAARYEFTDRISAYAGLRVVTAEGTVSLFNGSGAPAGSPNRYTMEAESDAELGFMIGAAYEIPDIALRVALTYYSETNHTFTGTEGIITPTGAVVTGPMEFETTIPQQVLLEAQTGVAEGTLVFGSIRWTEWTEFDIAPPAFNAATGGSLVDYDDDVWTYTIGGARVLNEQWTALASLTYEASQGGFSGNLGPTDGRTSVGLGARYTQGSMTVTGGINYTMVGDATTEAPGPFPAGLDFGEFADNSSLAFGLRVGFSF

SEQ ID NO: 759 - protein, 888 aa, Vibrio cholerae
MAMKNDTMKPVTRLLQLMIGVSPFMASGMMTAQSATQEPTQLGPLKVSAKSQKELDAEYPYLQLGSSSYIDGKTVERFRGNSAADFLRGVSGVHLGDIRNGGALDVNIRGLQGQSRVPVIVDGTQQSIDVYRGYAGVQQRSYLDPDLISHVTIDKGPTLATDAAGAIGGAVRVTTLQPADVIPKGETFGVRLRGGLANNTVSERSGFYTKTKESNDANPWPNMNSRFGSVAIATDQDRYQLLAAYAYRNQGNYFAGKNGAKRYRDAHYSSTGGTGMTTAAVIDAYPAGKEVLDTHSRSESWLVKGAGELTDTQKLELIYRRYDAKWGEIMPSMITTPNSKGESNQFIPSKITIDSLSAKHNFDPDNDWVNLTSELWYTHSVSRMYNANIGNVPVFDQSTEQRPDPQSEEYKQGLLSDIKADRYGVNLTNRSTFENRLGEFNLTIGGAFQYEDTGPNSPVLKENLQKNYFLRSGVRKEYSLSSSLEYKPVNWLTVQVGGRYTEYHVRDRNSTAYAAKSRTQEYTFARLKKNGEYFTKWPESWYMEWWPDEQGNYTLDSLKKTPYANTTLGEKYDFDGYDPDPRGEKGYLKKEVTTEYAYTKPIERKGSDFSPQVGLAFHLDDNSQIYVKYSEAVKNPTIFESTLGNWTSMPSADLKPEKNKVLEIGASTVQNSLFTEEDKLAAKVSWFKSDLHDMITRGYHPNNASWFIENVDLYKTSGIEYSLAYDQGRFYADVSGNYYLEATTCDTKTAERFRQYAYGDPNTPNCVNGGFGTSLVNITNPPKYSINTTLGVRLLDERNLDIGVRRIYNSGPTHKLNRSWNTVGMTGTQLIYLSTVTYDAYANYQFNPNADINLTVTNLTNEYYVDPMALSLMPAPGRTVSVDFTYRF

SEQ ID NO: 760 - protein, 792 aa, Neisseria meningitidis
MKLKQIASALMMLGISPLAFADFTIQDIRVEGLQRTEPSTVFNYLPVKVGDTYNDTHGSAIIKSLYATGFFDDVRVETADGLLLLTVIVCPTIGSLNITGAKMLQNDAIKKNLESFGLAQSQYFNQATLNQAVAGLKEEYLGRGKLNIQITPKVTKLARNRVDIDITIDEGKSAKITDIEFEGNQVYSDRKLMRQMSLTEGGIWTWLTRSDRFDRQKFAQDMEKVTDFYQNNGYFDFRILDTDIQTNEDKTRQTIKITVHEGGRFRWGKVSIEGDTNEVPKAELEKLLTMKPGKWYERQQMTAVLGEIQNRMGSAGYAYSEISVQPLPNAGTKTVDFVLHIEPGRKIYVNEIHITGNNKTRDEVVRRELRQMESAPYDTSKLQRSKERVELLGYFDNVQFDAVPLAGTPDKVDLNMSLTERSTGSLDLSAGWVQDTGLVMSAGVSQDNLFGTGKSAALRASRSKTTLNGSLSFTDPYFTADGVSLGYDIYGKAFDPRKASTSVKQYKTTTAGGGVRMGIPVTEYDRVNFGLAAEHLTVNTYNKAPKRYADFIKQYGKTDGADGSFKGLLYKGTVGWGRNKTDSALWPTRGYLTGVNAEIALPGSKLQYYSATHNQTWFFPLSKTFTLMLGGEVGIAGGYGRTKEIPFFENFYGGGLGSVRGYESGTLGPKVYDEYGEKISYGGNKKANVSAELLFPMPGAKDARTVRLSLFADAGSVWDGRTYTAAENGNNKSVYSENAHKSTFTNELRYSAGGAVTWLSPLGPMKFIYAYPLKKKPEDEIQRFQFQLGTTF

SEQ ID NO: 761 - protein, 899 aa, Campylobacter jejuni
MKKHLIHFLLVAVLSVFSAAAFAQTTVRGQLVDSETGEPLVGAAVMVEGTSQGTVTDIDGYFKQSVAQGGTLVFKYVGFKDLKKKITQKGASVDLGTIKMEPDAVMLADVTITSSIAVARKTPVAVSTIDPVFIEEKLGTQEFPEILKSTPGIYATKDGGGFGDSKINIRGFKSENSAMMVNGVPMNGMENNKVYWSNWSGLSDVTRSIQVQRGLGAAKVASPAVGGSINIITKTTEAKKGGSVSYAMGNDGYNKILFNLSSGLSKDGWAFSLLGAKTWGDGYIQGTEFEGYTWFVSIAKRFNDNHQLSLTAFGAPQWHNQRSNQNGLSIKEWQRVKQYMGEDSPYKYNSTFGYRHGQSYNSSRNSYHKPQISLNHLWQIDQKSSLSTALYVSIGRGDGYRGTGDSTYANSWYGSTNGLVNTQFRRPDGTFDYDAVETMNAESTNGSKMVMSKMMNNHLWYGLLSTYTTKFGENFDFYGGIDFRYYKGLHQDILTDLFGGTYFIDSYNRKNVTAENNPAVGGNSAYINQKLNVGDVLRRDYDGFVMYEGVFAQLEYNQDKLSAFISGGASNTGYWRYDRMYYSKDKAKSSTKNYLGGNIKGGANYNLTENHNVFVNAGYINRAPMFDTSFINSQTSHDRNPDAKNEKIMSFELGYGYRSRFFTANLNGYYTRWMDKALYDSGTTADGLRWAMNMTGANADHWGVEFDFVAKPLNWLDITGMFSWGDWRWGGVASGYLFDSQGQMLQNTRGDVVTDMANAEQYQYKIDMDNVSVGGSAQTTAALGLGVRPMKGLRLGVDWNFFSRNFADYDINANVATQNEPYVIGSPWKIPSYSTFDLSAGYTFDFGKIRATLSGNVNNVLDQEYIADARDGSTHDWESATRVLYGFGRTYSVRLKFNF

SEQ ID NO: 762 - protein, 752 aa, Pseudomonas aeruginosa
MIGVTIAIPELSTGVTTNEYGFYSITLPEGEYEVQVTYLGFQDQVQNIELRENRKLNFLMFEQAEQLDEVVVTDNGEKLDIRKPQMSVNTMAVSTIKNIPVILGEADIIKSILLLPGVTNAGEGASGYNVRGGAVDQNLILLDEATIFNSSHLFGFFSVFNPDAIKDIKLYKGGIPARYGGRVSSVLDIFQKEGNSKKFKANGGIGLVASRLLLEGPIKKDKAAFLIGGRGSYAHLFLPLFDVDNTAYFYDLNTKINYRLNERNNIFLSGYFGRDVFSISDSFVNTYGNAVGNFRWNHLFSDKLFSNLSLIYSDYYYGLKLDFVGFNWNSGIQNFNIKYDLKHYLSDKLRVNYGVNNIYYQFNPGKIEPSNSNSGILEERLTQKYANEFAAYVDVEHSITQNLSLGYGLRFSHFNRLGQEQLNVYENDNPIVFNETLQIYQEGEPVDVIDPGRKKSLATFDNFEPRISLSYSISDKNSIKASYTRLAQYLHLISNTSSPTPLDVWTPSGPFSKPQLLDQYALGYFQNINNGEYALETEVFYKDVQNRMDYIDGANLIANDAIEQVILNGEARAYGLEFLLRKNEGIFKGWLAYTLSKSEQRTPGRNEIETGINNGEWYNTPYDKTHDFSVYGNYDLNKKWSFNTNFVFQTGQPTNYPIGQFQFQGLTVPYYGLRNQERLPNYHRMDVSATLTPKKNMDRNWQGEWVFSIYNAYNRRNAASISFNRNQDTNMNEAVRTSIFGVVPAVTYNFKF

SEQ ID NO: 763 - protein, 233 aa, Pseudomonas aeruginosa
MPRAVEIGASTIRHGLFIDGERAAFKLAYFDTRIDDLITRDYRTLSAGLIRNVDRFKVSGVEFQSSYDSGLVFADLSAHYYFQAKTCAPDIAAERREYGRQRKIAELIGTPDCVDGGFEGSYTNTQNPPRYNVNLTVGLRPFDERLTFGLRAVHNAGPISKLDKEWNVGLSAIQQLYRAATIVDVFASWQVSEQIALDFNLDNAGDRYYLDPLALGVLPAPGHTARLAFTYRY

SEQ ID NO: 764 - protein, 982 aa, Neisseria meningitidis
MKLPCPSPRPLAIALCMALATPCLLPASVHAQETAAAVRWQIAPGPLDQALTAFGQQSGLSIAADARLTRGRHSKGVQATLGTDAALAQLLAGTGLAFQRDASGVVLQAAPNAEAGVRQIGTLRVAGQASEGASPWGLADADAVYRDSGSRVHLDHQQLERFRGQSIGDVLAGAVGVHTADVRNGGALDVNIRGLQGQNRVPVIIDGGQQAIDVYRGYAGVQQRSYLDPDLISAISIEKGPSLAANAASAIGGVVYMETLKVDDILDDGQHWGLRVRGGVADNSIDRTRTFKQIARGSDNRNSLRDPRDWNGSVAFAQRGEDWQLVAAYARRRQGNFFAGSNGAHRYDKQYLSSGGTGMSSQAVSKLFHPGDEVLNTHTNNESALLKFTWTPNPDQRLELSHRYFNSSFGEIMPSAIGRVGESNEWVTYVDKANTMFQFEPGKMRVNATSLRHRYRPEAHPWLDLSSTLWFTTATSRMFNSNIANTPLFKDVPNDQMPDTLGETYGPGLQSDVKTQRWGVDSSNTTRFSNDLGDWTLRYGASFQHEDTAPNSPVLPVDFNNNRYLRSGTRREASVVASLQWQPWDWLSLTAGGRFTDYRTRDRNRVAFVSESRDLRYTFARLSKGGQLLPGWYKEWYPDAQGNYTYDSLRATPYGDSTLGQAYDFDGFIPDPRGANGFYTKQIPTAWGYKPAIRRSGHGFAPYAEARFNLDQDMFFYVKYAQGWKMPSLFESTLGNSTSAPVADLKPEKNRSWDIGFSLLKQDLWRDGDRLAFKVAWFKNDIDNAITRRFDSSNWAFYVDNVDNYTVSGYELQSGYDAGIAYLDLSASYYQRARTCDAATAKRLREDPYAKWSKLDTTPDCVDGGFGTSFVNAQNPPKYSIHSTLGFRLFDKRLDTGIRRTYNSGPTHELDKPWNTTGSTGLQNIYLPTAIYDFYARWQFTPRSEVELVVSNLRNTYYMDTLAMSLMPGPGRTTRLNFTARF

SEQ ID NO: 765 - protein, 434 aa, Neisseria meningitidis
MKFFKIIIFFCFVFTLPNTHAQNIKMEAYKFGEGLKFKTDDGKELEISGYIQPYLESKHYTNAQDLEAANRFRMRRTRLRFDGKSSDKKFSYRLQVDLSGSSEVDEETANYLLDAYINYDITKRINITFGQRATYTDNRELFMNSNSLQFVERSRLTSAFSSIREFGLFIDGRYKTGKYSYLRPYFVLTNGDGLNVLGRDHGGLKIGGRIDFLPFGLFNNGGQFKQTDIVRERTPKFVIGVNYSLNNGMSSRRGRTSGTILYYNDNNEESLPDYTKYGVDFLFKYKGFTALGEFVKSQASVPNDITQRVRVDGTISSTFDVNGVQNVDAYVRGRMMLGEAYNIQAGYLFKNGISVDGRYTYLKADENSFLNNQTVYNRPNYYSVGLSKYLDRNFGAKIQAAFTYVDGSKGINDNDGNPIDSNEWIGRLMLTFTF

SEQ ID NO: 766 - protein, 859 aa, Neisseria meningitidis
MDTSKTFRMNVVTKLIRNIFPLIVLSSPVMANAETIISKDTSSSYIVSGDTDYIVNPDVTMSSSKTKPAVSVQGEDIVTFTNNGTIKNDYGNAMQVEIDGQSSDMFTLQNKGTISSVNTGISVTDAQNVTLVNTGTISGNDYAISFENDGNNALVLKAGSSLGGDVITTGSANTTITLNDSGNEDSNFTGANEGDGFKSLTMDGSDWTLTGNVDLTGEGDSLIVKTGNLTLGGDVKNSGATLINDAASLQIGTGTGDNASLEGNVTNNGTLIFNQAADYIFAGDISGTGNLVKEDANTLTLTGNNSFSGDTTLKGGTTLVAENATMGPDGGTGIINIDSGATLASAGTVNSSVAIAAGGVLASWNAVSGNENASTPAAGNTINGDVTNQGTLQIAGNNSVGNTFTINGNYTGDENSRIVMNTEAGADNSPTDHLAITGNSAGSSSLEVANIGGQGAQTINGIELISVGGASDASFTLGKPVVAGMWEYDLYKHNDGNWYLESKASDTPDPTPDPTPDPDDNGGDNGGNDDGGDNGGNDNGGGDTPPAPEVYRPEAGVYMANYLAAQQMFIHKRDDRDQLMLRDADDLNTWMYVKGEYNDGNFADSNLKYKIRSAVVQLGSDFLSKDLSTGTLHSGFMLGAGYSDTTADARHNSRSADGRVNGYNVGVYATWQEDQKLRLGSYIDSWASYSWYNSQVNGDDMPGEKYDSQGYAASLEVGHAWLVPSEKARTMKFEPQGQVVYSNLDQDDHVEYNGTRINTPDNDAVLGRIGVKASYVDQKAVETWQPYGAVNWLIGNGMSDLNFNDETLDSNVPSNRFQLETGVSGKVNDATTVSFRVSSEWGDNSYNAYSGHMLVNYRW

SEQ ID NO: 767 - protein, 766 aa, Neisseria meningitidis
MNTKLTKIISGLFVATAAFQTASAGNITDIKVSSLPNKQKIVKVSFDKEIVNPTGFVTSSPARIALDFEQTGISMDQQVLEYADPLLSKISAAQNSSRARLVLNLNKPGQYNTEVRGNKVWIFINESDDTVSAPARPAVKAAPAAPAKQQAAAPSTKSAVSVSEPFTPAKQQAAAPFTESVVSVSAPFSPAKQQAAASAKQQAAAPAKQQAAASAKQQAAAPAKQQAAAPAKQTNIDFRKDGKNAGIIELAALGFAGQPDISQQHDHIIVTLKNHTLPTALQRSLDVADFKTPVQKVTLKRLNNDTQLIITTAGNWELVNKSAAPGYFTFQVLPKKQNLESGGVNNAPKTFTGRKISLDFQDVEIRTILQILAKESGMNIVASDSVSGKMTLSLKDVPWDQALDLVMQARNLDMRQQGNIVNMAPRRAACQRQSLLTTGKRHCRSGRAVFPKLPIEIQKCGRIPQHPALDNADTTGNRNTLVSGRGSVLIDPATNTLIVTDTRSVIEKFRKLIDELDVPAQQVMIEARIVEAADGFSRDLGVKFGATGRKKLKNETSAFGWGVNSGFGGGDKWEAKPKSTCRLPCRKQHFAGARDFSGALNLELSASESLSKPKTLANPRVLTQNRKEAKIESGYEIPFTVTSRSGGGSSTNTELKKAVLGLTVTPNITPDGQIIMTVKINKDSPRQCASGNQTILCISTKNLNTQAMVENGGTLIVGGIYEEDNGNTLTKVPLLATSPLSATSLKHGEKNRPPRTADFQLPPREL

SEQ ID NO: 768 - protein, 182 aa, Vibrio cholerae
MAHSHYWLLVCCWLALPVYAGSSPYSFSLNTGFSRVDNSASTNEAWVTQFGYNYQFSPFIGLDLGYSGMIGNGAEMLNTQKQKIDVKVEGFYFGAFFEQPINNLTILYARGGLSQFKVKERYELGAIGDNRQFSGTNPYIGIGTKVQSSIDKSLALTMELSYYPLEQDYSSLSFTVGGQYRF

SEQ ID NO: 769 - protein, 786 aa, Vibrio cholerae
MKYQYLALSLASVLNTPLLAQAAQSSTVTTNNTIEHIEVAGQVIKSQGLSVKDANIDGPFGDNLALKDIARSVTPISSELIEQLNITTLQDVLAVSPNTYSASGFGAPSLPTIRGQLGELFQDGTRRQAGNNGFGVPLSFNAIEQIDVVKGAPPVLFGSSQRNGGFVNLHSKKAATDESKGKASLSAGRWDQYRVLVDYSAPIVKDKVGFRVSAEHIDNDSYYDYSGTKSDSLFAALRVFPDDKSSWDLNFELYQVEFTDNAGINRPTQALIDDGLYITGQGVQANGSTVPLAGSIISPTGQVKIDRSTVLTDPDNLNEATTYLLHSIYKRELSSNASIKNISYFQHLQRDEIAQNSFVEIIEGADTAQNRTELTYLWNSNQQTIFAFDVRYNRVLGYSQFTTEADLPIDLTGPLSNRRIPLTDAQQARFVELRPGVFVSPGGQYDINNDGSGDFNLSDTTDSRSWQTGVAIQQDSDWTNKFHTSVGYRVDFYDVQANDPIAPVGQIAASDSINDTLHSGQVSFNYRLNDDYTTYGAASYNEATSNSMAGGTTLGGDNTISAQNFATENTLVEFGLKYAPTNSDWYADGAIFSQRRSLRNRDGSNTGIRTTGFESQVFYDAYPYWLSAGYSYIDARYDNSASSQDSAQVADAFDNSRPDIIAGTSVGAPSFTAFAPSSSQVQGIPEQSFSFNGNYSINSKWQTGFSGLYTKSYPLDFLATVHIRDQYTLNVNTSYAFTPSTKLRLDVNNVTNQKNWRPVFEGGYFGATLAFPELPINAKLTLTHNF

SEQ ID NO: 770 - protein, 825 aa, Edwardsiella tarda
MKLKMKHRSALPLCIFLFLLFSWEVPAQSEETNKPILSETSSNGEETEKEKWNQGTISVIGKRKTDLKRIPGSATVIEKEFLEQTKPVDSMEVLRRIPGASIRYQDTGLILNLGFRGVNNDLGRKVLILEDGVFTSLNPYSAPEQYYTPNIDRMERIEVVKGSGAILFGPSTIGGVVNFITKRPPKDPMLSVSVQGGSYGFFSSQVSYGGTFGNTGIDISILRKQGDGFREHQSFRIHEFSFKSVTDLNDKHTLTSKFLATAQDANMTYLGLTTAQFWNHSSSNFAEQDNRKLERYSGDIGHEWKLTDHSKLVTKVYSAYTERNWARQNYLRNTGSNFNTIPSNVIKSYDTEPFVNRPGDTVYMLDSVGHRNRSYRFVGAESRYQQDYQFLGIKNQLDAGLRYHYETADIKYLDGPPTPDYAIFGNGFNNPPTGVASSEYSLAKSGNVRDHEVNNTKSLAGFAQNSFQFQNRFSVIPGIRYEMFTQNRTILRQQTIDPVTNQPDPNSPSQEVDKGSKHTYHVVIPGLGLTYDIRKNANWFKDLTWFAGAHKGFSPPRYQDALNNSGIVNRIDPEYSYNYETGFRGDITKYLNAQITYFNLNYINQIIITSSTSGNDSASSAKNGGRTYSRGVETNVTFDPAQLFDSSFKLPIDLIYTRADARMNQYSIDTSKITADQSLLDFVVTQKDKNGNYVPYVSKDTATLAIGFIHPKGFYARVEYQYFSSQYHDDSNTRTVYWADSITDPLGKKVLQYLNITSNSSGETGVIPAYELINCSLGYKDPIKRWSLFITGKNLADVRYISGRLPEGIQVGPFRQINVGATFEL

SEQ ID NO: 771 - protein, 3185 aa, Xylella fastidiosa
MIDKNNKIDLKNKRFKNRSFKGIKKKIAKKYTIKNSPLTIYSLKTHSNSSLSFNKKIFLGLGFVSALSAEDYNSSVYWLNSVNENNSNKSYYISPLRTWAGGSRSFTQNYNNSKLYIGTKNASATPNNNSIWFGKEGYIGFITGVFKARDIFITGAVGSGNEWKTGGGAILVFESSNELSTNGAYFQNNKAGTQTSWINLISNHSVNLTNTDFGNQTPNGGFNAMGRKITYNGGIVNGGNFGFDNVDSNGTTTISGVTFNNNGALTYKGGNGIGGSITFTNSNINHYKLNLNANSVTFNNSTLGSMPNGNINTIGNAYILNASNITFNNLTFNGGWFVFNRPDAHVNFQGTTTINNPTSPFLNMTGNVNINANAIFNIQNYTPSIGSAYTLFSMKNGNITYNDVGNLWNIIRLKNTQATKDNSKNATSNNNTHTYHVTYNLGGTLYHFRQIFSPDSIVLQSVYYGANNIYYTNSVNIHDNVFNLKNINDDRADTIFYLNGLNTWNYTNARFAQTYGGKNSALVFNATTPWANGAIPKSNSTVRFGGYEGVNWGKTGYITGTFTADRVYITGNMMTGNGAQTGGGATLNFVGATEINIAGATFKNLKTTSQNSYMTFIALGDSSGSGKINVSQSDFYDWTGGGYDFTGNGVFDSVNFNKAYYKFQGPKNTYTFKNTNFLAGNFKFQGKTTIEKSVLDDASYTFDGINNTFTENKFNGGSFSFNHAEQTNAFNNNSFNGGSFSFNAKQVDFNHNSFNGGVFNFNNTPKASFTDDTFNVNNQFKINGAQTAFTFNKGVVFNMQGLLSSLSVGTTYQLLSARSVDYKDNNALYQMLRWISGENPSGTLVNKDQSTPDSTKIYNVQFTDNGLTYYIKENFNNGITLTRLCTLGYTHCVNIDNDAFNLKNINNNASNTVFYLNGMTTWKTAGTGVFTQDYSGANSVLVFNQTTPFLAGANPTSNSVVSFGKTSGAEWGLVGYIQGVFKANQIDITGTIRSGNGAKTGGGATLVFNAQERLNIANANLNNDKAGLQNSWMNFIVNNGNLNVTNANFSNQTPNGGFNLKANNITWDKGSVSGGGNFGVDSASANGNAVIKNINFSDNGTLIYKGGENSTGNSLTLENNTFNSYNINAKVQNLIFNNNSFNGGSYSFNNTKNTTFKGTNTLINSDPFSRLQGSIAIDNNSIFNIERDLTDKTTYTLLSGNSIKYNNQALADNAFSKNLWNLIHYGGEQGTLLRADNNTFFVQFTQSNGQKFVFEETFNSSSITYKYFTIHSSSFHTEADSKDIWSQVRKQFDFIPGKTPVCVGVCYIAPYKNQDLIGSSAFAWSLNFGATVVGTLLLGSAQEKANNNGGSIWFGKNNLLYLHGNFNATNIFLTNNFNVGNPNAGGGATINFNADETLNADGLDYTNFQTVALGLQTSASQHSWANFNSRLSMEIKNSNFRDFTWGGFNFNSGRIAFENTTFSGWTNINGATESGSSYVNMVANTDLIFSNSILGGGIRYDLKANNIIFNNSQIVIDVSKNVNQSSLNGNVTFNHSRLSVKPNAAINIGDSQTQTTLENASSLSFYNNSVANFNGTTAFNGVSYLNLNPNAQLSFNQANFNNANVTFYGIPLFGKTPDFGNSARLINFKGNTNFNQATLNLRAKNIHINFQGASIFENNSTMNLAESSQASFNALSIEGETNFNLNGSSLLNFNGNSVFNAPVSFYANNSQISFTHLATFNADASFDLSNNSTLNFQSVLLNGALNLLGNGANALSINASGNFSFGTQGILNLSNVNLFDAENKPLVYNILQAQNIQGLMGNNGYEKIRFYGIQIDKADYSFNNGVHSWRFTNPLNTTETITETLHNNRLKVQISQNGVSNNEMFNLAPSLYDYQKNPYNETENSYNHTSDKAGTYYLSSNIKGFNQNNETPGTYNAQNQPLQALHIYNQAITKQDLSVIASLGKEFLPKMANLIASGALDHLNLNSPNSFETLFGIFEKYGITLNQANWKSLLKIINNFSNTANYDFSQGNLVIGAIKEGQTNTNSVVWFGGEGYKEPCAVGDNTCQMFRQTNLGQLLHSSAPYLGYINANFKAKNIYITGTIGSGNAWGSGGSANVSFESATNLVLNQANIDAQGTDKIFSYLGQGGIEKLFGEKGLANALSNIVYEESLNDNAIPKDLANMIPKDFGSKTLSSLLSPTEVNNLLGVSAFKNAIMEILNSKTVGDVFGENGLLNALDPTERKKIDQMLLEQIQAHSSGFEKFIVKTLGIENVENFINNWYGKQSLSSFANNFVPGGLNQALDKIGSSSDAKDLQSFLDKTTFGDILNQMINQAPLINKLISWLGPQDLSVLVNIALNSITNPSKELTSTISSIGEKALNDLLGKGVVNKIMSNQVLGQMINKIVADKGLGGVYHQGLGTILPKSLQDELKQLGMGSLLKPKGLHNLWQKGNFNFVAKDYVFINNSSFSNATGGELNFVAGKSIIFNGKNTINFTQYQGRLSFVSKDFSNISLDTLNATNGLTLNAPKNDISVQKGQICVNVLNCMSEKKADSSSSAPTNETLEVNANNFAFLGAIKANGLVDFSKVLQNTTIGTLDLEPNATFKANNLIVNNAFNNNSNYRANISGNLNVVKGAALSTNENGLNVGGNFKSEGPLTFNLKRPTDKTILSVTGASTIMSYNNQALIHFNTQLKQGTYTLIDAKRMVYGYDNQIIRQGSLSDYLKLYTLIDFNGKRMQLKGDSLSYDNQPVNIKDGGLVVSFKDNQGQMVYSSILYDKVQVSVSDKPMDIHAPSLEYYIKYIQGSAGLNAIKSAGNNSILWLNELFVAKGGNPLFAPYYLQDNPTEHIVTLMKDITSALGMLSKPNLKNNSTDVLQLNTYTQQMGRLAKLSNFASFDSTDFSERLSSLKNQRFADAIPNAMDVILKYSQRDKLKNNLWATGVGGVSFVENGTGTLYGVNVGYDRFIKGVIVGGYAAYGYSGFYERITNSKSDNVDVGLYARAFIKKSELTFSVNETWGANKTQISSADTLLSMINQSYNYNTWTTNARVNYGYDFMFKNKSVIIKPQIGLRYYYIGMTGLEGVMHNALYNQFKANADPSKKSVLTIDFAFENRHYFNKNSYFYAIGGVGRDLLVRSMGDKLVRFIGNNTLSYRKGELYNTFASITTGGEVRLFKSFYANAGVGARFGLDYKMINITGNIGMRLAF

SEQ ID NO: 772 - protein, 793 aa, Chlamydia muridarum
MKNVLFFVGLLVLSIQAYAQEFKLSGTVTENGVPLNEASVYIKSTGTGTLTDEDGNYSLSLEDGTYTVVFVFGNQKSKRVVIDSDKTLNIDLSGAEESLDEVFLSAVRVTEKSPITYSNLSNEEIEDRNLGQDIPVLMSYMPNVVTTTDAGAGVGYTGIRVRGSDATRVNVTINGIPYNDAESQGSFWVNLGDFASSVENLQLQRGVGTSTNGAGAFGASLNILTDSYKEEAQGEIANSIGSYNTFKHTVKFSTGLINDHFSFSGRASKIKSDGYIDRASSDLKSYFLQGTFVDDNTLIKALTFGGSERTYQAWYGIDKETLENDRTFNPAGIYTDENGNTKFYDNQTDNYKQDHYQLLWNQDYNSNWSSNIAFHYTYGRGYYEEYNEDADLAEFGLPTFVAEGEEVTTSDIVGTKWLDNHFYGTVFSLNYENTNWDVTLGGGLNRYEGDHFGEVLYTRFARNNDPYEPYYFNQADKTDFNIYGKANFAITEKLAGYADLQLRTVSYETHGMLDDQSSFLNDDSFSFFNPKAGITYEINPFNQLYLSYAKAHREPSRNDYENGDPEPEELNDFELGWRHNSQNFQVNTNLYYMDYQNQLVLTGGIDDVGAFIRQNSGNSYRLGLEIDATVRLSDKFSVRPNISLSQNKNVDFVSTFNGELQEYGNTDISYSPEIVAGNIFNYEPINGLELNLLSKYIGEQFMSNVEAENSKLDSYFVNDFNVQYSWEQPWVFKEIVITGLVNNIFNEKYVSNGYYFTFNVPNEDIPSGVQTLDGAGYYPQATTNFLLGLTLKF

SEQ ID NO: 773 - protein, 837 aa, Xylella fastidiosa
MISRKTLMLSCALMALGGGAAQAQTVIEELVVTAEKREQSLQDVPVAVSAFTDERREMVGINSVQDLTNFTPGLAYSTNNDRINMRGIGRFTNNRSSEGGVAMYNDGVYTSSVTAFARSTLFIDRTEALRGPQGTLYGRNSIGGALNIISKRPTDDFYAEVRAGMGNYDTWMTEAAISGPLVGNIRGRLAGSYNSQGEGYFTNLNPNGKSEGGRGDQWQVEGQLDGELGDGKLEWWLKVDSAEWHNLGRGPGGRTTITYGLRDVTSPLQAALTPNSAALGLPLGLPGNQCQFCFDTDDGNYISLENNGYAFNATLHLDSFDVKYIAGYTYYDYRLQTDLDATSRQAPFQLPVSTQPYYPRRNNQYQEEVWWFSNEINIASTYDSPLQWLIGAYQFREGSNYTLSDARHPDDARFENPTLFSLNPATQLIPAAPNPERRYAYGSSENRSESYAVFGQADWQFTDELKFTAGLRYTYDRKRSFESARLFCLYTATCPISRVTGRPVDVTAVAAPGTSTDPAVYLPAFTDPTTGLRHRGLKYDWSGITGTLGVDWQPDPDTLAYAKYTRGYKAGGFNSGTTTLTPNVTTQEETIDAYEVGLKKTFGGTFQANASAFLYDYQDIQVPITGRDPVTDLNVTRFFNMPKARIVGFELETIWQPIDNLQILANYSYLNAELKEACCFQDPEDPRGLQPGVVLAGNTAAALASPTAGLNQDLDGAKLPSSTPHRVTFNVNYTWEFDVGELSASLTHVWKDKTYYSIFNRYYNEGKAWHQTDARLLWNDIDDRYTLIAYVKNIFEQEGVAGADGSRINTGPNTGFINRTISYVPPRTYGVELQYRF

SEQ ID NO: 774 - protein, 835 aa, Xylella fastidiosa
MHKYQILMISFFVLCAETFAEDYFNPSLLATDIIGEGNIDLSAFSRHGGGMEGEREVAIYVNNNFYSRRTLVFKNTSDKGLLPEFTPGFFDNLVSGDILVSEKNKIISSSDFLKKVPYSDINFDQGMSRVNVSIPQAYLGDGAKLISSPDTWEYGVPAFLLDYNISGNRNASGNNDSRSLYISSQMGVNLMKWHLRTSSSYSNYKTNSVWGGARSERNSFYNTYAERDISSLRAVLRLGEISTRGLILDSVPFRGVKLSSSDDMLDARLRNYTPTVRGMARSQAVVTITQNGRQVYQTNVPAGPFELNDFYLSGYSGDMQVTVREADGSEHSFLQPYSTLPEMKREGISGFEISVGRYDNNGAEHYYDAESFVYGNWSRGFARGVTFFGETLQAEKYQSLGVGSTLSLGRLGASSADISLSRVDKYGAIRGGQSYGFKYSKSQIETGTTLTLATYRYSTEHFYTFRDFVSKTDTARYVWENKLKNRMTLSLSQSLGEYGYLSASASKQDYWTSREVSRNYALTHSFNWNDIYLSTTLSMDDQRGREAGDLSNKQAGLYVTVPLNKFLLGIDSTGSSLTWSTSHADHNVRNSVTLNGKMPESDVRYRVGGSWGNGNTEGSRTVSVSWSGDYVSTSLGYARTGKYRTLDYNMSGAAVMYPWGIAMGNNSVTGDGAIVVETPGAKGVRTSTGYRTSWLGTSLVSSPRKYTENRIDLYPDGLPDDTVLGETSRTTVPVKGAVVVLDYTVFRGKQVVFTLRQSNGKPLPFGTVVTLDGVSRGKENSGIVGEEGRVYMAGMPEKGTLTATWGQDKSCSVPFRINQHKTEAVISEIHGVCRV

SEQ ID NO: 775 - protein, 1137 aa, Chlamydia muridarum
MNKNRSIRVAAFCLGLMLAGSLQVHAQKVTFRDGTVSLKQAFEKIEASSKYKIAYNDSHLNVSRKVSLNQKETEVLEILATILKDTGYTYKKNGNYIVIVPVEQKPASKVKKVKGVVKDASGEAIIGANVLVKGTATGVITDMNGSFELEVPGNAVLQITYIGYVQQDVAVKNRDQLAVLLKEDTKTLDEVVVVGYGTMKKKDLTGAVASVKMDDTPLSTISTVSHALAGKAAGLQVNTISAQPGGGTTFRIRGAASTGAGNDPLIIVDGFPVSNAGNVSVGYNSDNGTTDNILASINPNDIESIEVLKDASSTAIYGARAGSGVIIITTKRGKEGKPKVTYSGSATVQTMATKYEMLDAQDFMIQSNRWFKEKWMYDNKVGIYGGKNESEAGSAYHPKYSDADIANPVNDTDWYDRITRTGFQTQHNISINGGTEYTKYLISGNFFNQKGIVKNNGMSRYTGRVNLDQKLSKYAKVGINLTVSRNTLDNVPLGAGQNEYASILVSAAQFSPLLSVKDENGDYSLNQQAAYIPNPVSLLEISDQTTKERFLATPFVEIKPINELTLKASFGIDRNYQRREVYMPKTTLYGEKADGRADIGQYDRSDYLLELTANYAKRLGDHNLNALVGYSFQRFTSKYLNAGNQGFLTDAFLFNNLGAGTYEKPWVGSSASKSEMASFFGRVNYTYKDRYLVTATLRADGASNFAKNNRWGYFPSVALGWRFTEENFARSLNLDKVLSNGKLRLSYGQTGNSNIGDKSVTYYGTGYNKVFGNKEYTGVYVSQIGNPDLKWETTTEWNVGLDLGFLNNRFNVTAEYFHKVVSDLLSSRSVLSYNEVGSIAANIGKTQSQGFELTINTKNFDTKDFSWNTDFTFSFYRDKWKERDENWSPNPYDMYNAPLRGYYMYLSDGLIQPGEEVSWMPGALPGQVKLKDIDGYAYNEDGTYKTDKHGIPLRTGKPDGKIDYADAVFKGCSDPGYLLGLNNTFRYKNFDLNVYFYGQLDLLKSGSYKDYWIVGSGTMTGVNNLYRGYNMPTSAKEVWSHDNTSGKMPGYFQYMSNYGYGDYFLEKSWFIRCRNITLGYTLPVKSAKKLVSNVRIYADVNNLFTITPYDGLDVETDDSYWAYPNVRSFSIGLDITF

SEQ ID NO: 776 - protein, 748 aa, Burkholderia cepacia
MTRNFARSALLLSAASLAFPAAADDSEASAKAESYDGLITVTATRTPVQEEEAPATITIITDEQIADELATDVRDLVRYEPGVTVRRAPARFGAALGSTGRARNEDFVIRGIGGNRVLIQVDGIRSPQGFSFGAQEAGRGGFSDVSLVKQVEILRGPASALYGSDGLAGAVSFTTADPVDVLRADKVGGFVRSHYSSEDEEFAQTATLAAQSGNFSGMVAHTRRDFSELENQGEIGGVGQARTLPNPQDGESNAVLGKLVWDNGDHRLRLTGEWLETEVFTNALTGLGPAFLFGPAPVWTVDRLEAEDTTSRARVSADWTYEGEADDLIEYAFLAAYYQDAEDRQFTEEDRTALGFIPAPDRTRLNTFENEVYGINAETRSSFATGPLSHTIAFGGDVNWTRQEGVRDGTFPGRGESFPTRAFPVTDFTLGGVFIADEITFGDGAFTLYPALRFDFYDLNPTDDPLLTVFNPQGQSDSRLSPKVGATYKFADDFLIFANYAQGFLAPTPSQVNNFFEFIAGGYTSLPNPDLGPETSESWEIGARYIGDVFGLEVVGFKGTYDDFISQQVVGGSFTPQDPAIFQFVNFTEVEIDGFEVKGSMELDSGVNARLAIAYANGDIINADGSRTPLDTVDPFNLIAGLGYRDRQGRFGAELILTHNARKDANELERAADGADLFIRPEASTVFDLTAFVEVTEALKLRAGIFNLFDERYAVWSDVRGLRVEDRGIAGAFTRPGRNVSVSASFQF

SEQ ID NO: 777 - protein, 979 aa, Pseudomonas fluorescens
MAISIHSNALRLALIGASCLTGLAAAPAFAQQTPAPAASADAVEEVVVTGFRKSLADATNAKRDSIAFTDSVFAEDIGKFPDLNIAESLNRIPGIQLTREINGDGLNIAIRGLGTDFTKIVLNGAQIGVASSGRTDAQNQNRQVDLDLFPTELFTRLDVSKTPMPSQLEGGVAGIVNMRSSRPLDRPGQHLTYSLQGAYQDSAGKWSPRGALIGSKSWDVGDGEFGLLVGYAGARSKSRTDGFETIGWTNASTGGSSNFACGGCNSTFGGNGFTWAPTVPANAGNGLTTGATVNDAFLQANNPGTTLQQLSDGLLPRLGRQSYSAGHRDRDSLLVSLQYQPNDHADFYIDTLLGKTNREFSRIDMDWVVRNSNFMVPTNVKVGANNVITSGTFANSQFFLEARPYHETNKFVNVNPGGSWRFSDTLKLDGQFNYSRSVFFREAPTILINTPLNSGLTVTYDNTGGDFPSIKTSANLNDPSLGWTFVGGRVNIQNEKRVTSTKGTHWDLTWGDERNYIKGGVAYDEASRSIMALDNSDRWQQITCGGGGTYLPRPNTQPACTGGAGSAITNAQLASYLKPGPLGFITVDYDKFKAATNYQALNDTAPFSSSAATAANSGEIEEKNTGAYIEFAGVATIMDRELRIAGGSRYVSTDQDVTGPVSIPFPNVANCTPNCVPNTLTFKTTSQRYDAFLPSFNAVYAVRDNINLRMSASRTLTRPDPSAMLPGTTFSDPSAQNANQGNPALRPYTSNNFDVGGEWYTGGAGYVGVALFQKVVTGFTAVGATTQPFTALGIPFDSLTDLQKTAINNRGGPSAATVTVSQQVNTGSDLTIRGYELNWVQPLDFVLQGAGFTANYTRVNQTGTGGVVALGVSPYTYNLTGYYENHGVTLRVSYNYNDAQISSGLNQNSVPTARIKTDAYKQMDLSASYTLPILGGAQITFNAINITSETQRQTFQYPNAAYTFYDPGPTYLIGIRGQF

SEQ ID NO: 778 - protein, 947 aa, Bradyrhizobium japonicum
MLARSSLALLIFGAMPGVPEAEAAECSPWQGGKAVANACELTLAGGTIDTGRGDYQAAVTAQDGGIVTATGPLKLFTAGNDATGIFAQSQGKITLTVPGNSVMTSGKNSYGVQSFGSQYITAQATIVTSGEQSHAAFEDFGGAIRLTDSDLTTSGARAAGAAIQGGGVIDLEGTTTITTRGDSAPGLFATDAGSRGILGVNGAGNFTIRTNGADAPAAIARNGGVLNLRGNSAITTAGRGSHGLYVYADGSSLTAQNAQVRTEGPSALGALATQHGAITLADSTITTTGPGSHGLAVHEGASIVARNVTVNTSGQQAHGAELANGARLDLYNVTLRSTGSGAGLYSHAADANAPVTVLIDGGLVDTAQSAAQVAGSDMDLTVRNGAILRAGTGRVAEVMSMNGQAARLTLAADRATLNGDIVADAAGGNIADVTLTNRTVLTGAVTGARTLGVQQSQWTVTADSTVSTLTNSGAIVFGDGFHLLATRSYTGQSGNLTLNTRLGIDESPSDRLQVADMASGTTALRIRNAGGPGATTTGNGILVIDAHASEPHAFALAGPVVAGPYEYTLQRGSTDASAPQSWYLRSTLDCPGAGAPSPPCPAPKPSPAPPGPVPPIPNYRPEVSLYTAIAPLALQYGRSLMDTLHERMGEQAVLRNRSDLSGEPVPSAGWGRVIGMQGNRDGGQRGIYGKTPSYDYRFAGMQIGADLLRHTHDDGRRDHAGVYGAIGYAGMDVDHFTGVRAGTNRFDGYTVGSYWTHYGLQDWYLDGVIQGTWYNVRASSNRGLPELTTHGVGLASSIEAGYPFALGQGWVLEPQSQLLYQWVKLDDSSDAGATVHFDNVRSLAGRVGARIARTWQDDEAVQPRQFTVWARVSAWYEFLGDPRTAFSTASGFIPFQADLSGGWSELKAGFSAEFRRNLFAYASAGYQRGFDGTRQAWDGKLGVRFNW

SEQ ID NO: 779 - protein, 925 aa, Bradyrhizobium japonicum
MKVLIYIRKVLFLFLCGALSFSYGYGQELPLLPDTIKPLLSDSNLIDELITVGYATGNRSTLSGSVNRVNEGGMNEGLISTPLDALRGRVSGVSIPVGGNSAAALAAVRVRGTTSLTGGNDPLVIIDGVFADLNLLSSIYPADIENFTILKDASETAQYGSRGASGVIEVTTKKGRQGAFSISYDGSFGVEAAYKSLDMLSANGFRKLAEERNIGILDLGNNTDFQDEITRLGLVQNHHIAFGGGSETSSYRASLGFVEREGVIRNTNSRNFTTKLNITQHAFNDLLVFDLGIFGSLLKNAYLNDVQKMFYSAATFNPTFPNHKNMETGSWDQITNASQITNPLAWLEVKDDDSNAHINTHLKLVFNLSKHLMFTAFGSYTYNVIDNAQYLPTSVWAHGQAYRGERKTESLLGDFMLAYKKDFGLHQLNVLGLAEAQKMITRGFYTTATNFSTDRFGYDNLQAGAVRLWEGTGSYYEAPHLASFLGRVNYIYDGKYIATVNARADASSKVGANNKWGFFPSASVAWVLTEEEFMEGISWVRNLKIRSGYGLSGNQDAIDSYNSLRLMKPNGVVSVNGAPTVTLGTIRNANPDLKWEVKRTFNAGIDAGFFDNRFILAVDYYNSKTDDMLYLYDVSVPPFAYNKMLANLGSMRNSGVELGIGVTPLRTKDMELNINVNVTFQRNKLLSLSGYYKGEYMSAPEYTSISDLNGAGFHGGYNHIVYQMVGQPLGVFYLPKCTGLVSDGNGGYKYEIEDLNGNGVSLEDGEDRYIAGQAMPKTLLGSNISFRYKQFDLSVQINGAFGHKIYNGTSLTYMNMDIFPDYNVLREAPSRNIQDQTATDYWLEKGDYINFDYLTLGWNVSLGNLRKYVRNVRLSVSVNNLATITGYSGLTPMINSSIVNNTLGIDDKRSYPVVRSYTMGLSFNF

SEQ ID NO: 780 - protein, 440 aa, Pasteurella multocida
MNNKALFGLSLIALSVSTGQAMAAGEKGEGFIEGSSLTILNRNLYFNRDFRKGQSSSSGNGYSEEWAHGVIGRFESGYTEGTVGFGVDAFAMLGLKLDTGDGRSGAGGSVDVMPYNSLGQAEDNYSKLGGAVKTRFMDTEIKAGDVFPVSPVVQYGDARLLPESFRGITVANTSVEGLSLQGGRLHSMSQPNSSSMRDGFATFYAGEVDSPWIAYFGGDYTLNDNLGFSLYTSRLKDAWNQYYAGTTLSYPLADDVALIGGLNYYKAVDEGKQLLGSFDNNIWSGRVGIQFGAHTVLVGLQRNNGDDDFDYLRQSDSIYLDNSIQYSDFNSPKEKSWQVRYDLDMEPFGVPGLSFMTRYAQGWDADYSNANEVYMRRDDNGDPLTNQKRWERDIEAKYVVQSGSLKNMSFRIRQATTRATDFESDLDEFRLIVEYPLEVL

SEQ ID NO: 781 - protein, 594 aa, Pasteurella multocida
MWQQKKRVWRKFTFPAALLLSSLSTPAFAANCKNDGGLLFLGTNKSDGRSIWISGTVAGDYRLDAAQGNQTVDTWSRAGKGLHLSTSPVVSSGNGGTHKLYSVDGGSDCLIDTQNQKRDFQLPDNIKPPNLVTPPIGRLFPNFGRPVPPIAILPPSGVMPGLPGPISPPGSGVTPPIGTLPSPGVTPPIGTRPPGGFSPGRPGAPAPPIAVVPPSGVLPGAPGGVTPPIGTLPPSGGGTGAPGTVTPPIGTLPPGSRNPAQPSLPAGFVPVRRADGQVISYCIDPRSVEETQSANQQAFCTREQLLEAERLQAQDEVPITPGRDLIEPTLWNAWSTVTGVYSDDRRFGRDFQTLSGTAALGADRKLTENIVGGLSVTFETIDTDGFNSNLKIDTQGFEIGPYVAVRLSQHWAVDGSLSYGFSTSQSDISVLSGDYNTHELGATFSVHGQYALSDIQVRPKATVTFNRVFSDGYDLNGTILNRAVSVPISGNAASLGTIELSTEFSRQFTLQDGLLIQPYVEAGAVYEYLRPNDGKILDDELNFVTASAWSFTLRGGATALLAENVTLDAKGGYLSLGQNGLDVWEGQLRVAIGF

SEQ ID NO: 782 - protein, 215 aa, Pasteurella multocida
MQKTLSAIFLFTTLSANAAPYIGLELGIGTANHSFETNYQSDAVSLNPNMEDMFLGGLIGYKFNDNFSFEINYSSYKLEDQYSKFIGIESLNNQQYRKEHEWSSEIEAKQLALISVYSYPIHQQLKTNIKVGVTHTQYEAYSGKYEELELLLNDDIEIRKALLETGLKKNRFGALFSLGLDYNLIPELSVGTELRYQFDKYNDVLSISLNSKYYF

SEQ ID NO: 783 - protein, 430 aa, Escherichia coli
MHKVVRQSTVLFAVAAGLGVAGVANATNGYFSHGYGTTSKGLAGAGVALSQDSLAAATNPAGMVTLGDRIDLGAALFSPRRSYSVSGMGAPDFFPDPDDLAASGFPLATGSVDSRSDYFLVPHFGWNRMLDDQSSIGISVYGNGGMNTDYPNDMFGGTFYGGAAGVDLMQLFIAPTYSRKINDTASWGVTPIIAYQRFKATGLGGFGVVEDGYDSSWGYGVRLGVQGEVAPGVRLGASYQSKIFAEEFSKYDNLFAEQGDFDIPANVTVGLAWDVSPSSTLFFDIQHIWYSDVKSIGNPMLPALGICLNTGNQCLGDDNGPGFGWKDMTIYKLGYQWQTSPDMTWRVGYSYGKQPIRDSEVLLNILAPGIIEHHLTAGFTRQMGPRNELNFAAMYAPTKKVSGENPLFPMQDIELKMYQFDLELSYAWKF

SEQ ID NO: 784 - protein, 826 aa, Caulobacter crescentus CB15
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 785 - protein, 733 aa, Caulobacter crescentus CB15
MRTSDCRSRPFVSGPQSCLYSVFAAALVTPAYAQDVSSEDRQVQLAPVTVSGPRTTGSRTEASDSVKYAKPLLDVPQTITVVPGQVLQEQNALSLQQALSNVSGITFNAGEGGAGSGDSINIRGFSANANLQIDGLRDSGQNNRSDLFNTESVEVIKGPNSVFGGAGTSGGSINMISKQPKAHDFTEADAGLGTASYRRLTLDTNRVLAGGKAAMRLNLMGHDSDVAGRDTIFKRRWGVAPSLALGLNSPTRVTLSFFHQNDDNLPDFGVPAFRGKMLDGVSRNAYFGWRNLDREKISKDALTAKIEHDFASGAKLQNLSRYSRLSRDTVISASHVDLRGMQPGYYRPAGPQAYGRDAATTLWINQTNLTQRFDTGVLGHTLITGFEIARETYDRTTSSYNINRQFPAGGYPLARPPGYWTGTTDLQNSGRNETSLDTRALYATDSIALGPRWDLNLGLRYDWIDGRSNATTAAGVRTAVDSSDGRLSGRTALSFKPADNGRIYLAYGTAFNPSAEFLVSTGSGLDAATASLAPEKNTSLELGAKWDVLDRQLALTGALFQVDKTNAREQMADGSYLLAGEQRVRGLELGAAGKVTPQWDVFANYTFMASKTLKSLNEPARVGQALGNTPRHSLNLWTTYALPQGWTVGYGVRFVGTRNVTSAGDGKLSAYWVHSAMVGYELNRQWKLRLNLENIGNKAYVAGVRQRLGEQSRSSAVEYGEGRTARVTATYQF

SEQ ID NO: 786 - protein, 768 aa, Caulobacter crescentus CB15
MPSSSPLKKPKSLRMAAALLPLSAIAQVQPTPAPVTTLPTVTVQEQAIDPNPNAEVGAPYKAKTSADTRHTRPLAETPQTIQVVTGEAIRDSGATDLKQILAAQPGITLGTGENGNAFGDRYIIRGQEARSDVFVDGLRDPGMTTRESFAIEQVEVTKGPNSSFAGRGSAGGAVNAVTKQATLDYDFTRVSAGVGTDSHHRVTLDMNKGFTDKFALRANALTSGEDVPGRSPSQRRRDGLALSGLWELNQDLSVTLDYYGLRAKDKHPDLGGYLVGTVPNRRPATGVPVYAQNSDFLNSDVDTVTARIAYRFAPDLKLTSLTRYGQSDNRYATTGASNGTVLDAANNPIGTAGVLDGGHTGWQDVKYFAHQSNLRWDKQIGSLKHEFIFGFEYTDHKVKSGNYGVTNTGATNCRVSGRNGPQAGWCITDLNGNPVSNLGDLAGRSYERRSWTRDWRVKTFALSAMDTVDLTDQWTVFGGLRADHYDLSLDTRNNQTGAITGNYGFNDTLLNGHLGVSYKINPMGMVYASYGTAQDINGGEPDTGTSSGYGGLVIHNGSAAGAKPETSQNIELGTKWNLLDDKLLATAAVFQTTKDDVMEGANYDTEGTFNTGKNRVRGIELGLAGNLTKNFQLQAGAAIMKSKVLRSAVASNVGNPLSNFADRSFTVQGKYQLTRDFSFGAVARYESSRCGGQPDTGAGYTNGMCSQPVPSFSVYDLFASYRINKHADLRLNVLNVTDKDYYTAVYRSGAFLYKGDGRAVRLTLNLDL

SEQ ID NO: 787 - protein, 586 aa, Caulobacter crescentus CB15
MRLATSALLGMTVTLSGLSALAQPGPQGPAQPAPPPPPAAAPAAPAGAVPPAAAAAPTPAPPPDAAPPAEELPPPPPPGAAPTAAPPPPPPAQVFAPTAGVAIVKEERQPLAGWHGGFFLRDANDTFRLYPKGRLNFDFASSFGAGVSDVSAAGGGSALKPRLFIRRARLEVAGEFLKRFSFDLDVDFGGQGLANANGRTENAAAAAGQTPTAESARFAPVESTTANAVLADAWINYSVMPALNFLFGQHQAFFSMDNQTSDNSTTFMERNIATRSFAYPEGKDIGLTIWGDVADRMVVYGVSVVGGDGQNRPGVDSQFDFIGRVVARPFASDKKGLLAKAQIGVSARYGDRDQEYVGYDHAPIRTAQGYTLWGAGYTDSLKRPIHVIPSASQAAIGGELRLPIKMVELRAEAYYVANETREAVEGFQLTNTERLGQVKGLGWYVQLSAWPVGDAFVSGDPGFSPRPTKVDLSKEIEKPKSGLEVAALLAGINATYDGASRGGAYDENTPGAEGGPGTDLDVMQIGLAANYWYTKNIRLGVNYSAYLTPGSGSSENLLRVPGNTVTPADPDAHALHELGARLSMSF

SEQ ID NO: 788 - protein, 205 aa, Mesorhizobium loti MAFF303099
MKAARWSFALGAGLLLAAAPVISSAQGWRGTEAREQTPYGVYVLLGGGVTDFADEDVKDRFDVGGTWDARVGIGNRFYVGGELAYVGSALKAVGAGPDLVTNGAEAVLRLQYPIANGSWLVEPFAFGGIGWNHLSVQDAAPGVDDTDDAGVVPFGGGITVGYDRLLLDARFTYRTAFDEDLALAAGDGPASLERWAVSGSVGYAF

SEQ ID NO: 789 - protein, 906 aa, Mesorhizobium loti MAFF303099
MTATRMRWGGWLVQLMAGCGLLLGPAAIASESVLKENASAMDMTVSDAKPDEASTPTVTTDRWLRERWLTQSDLAEPAAEVVEITDIQLEETAAGIALQLETTGELITPELSVAGNAAILDIPNAILNLPEAERFAISAPNADIAFIDINNRPDNQVRIAITGTEAPPTLSVTTVATMLTVRAIARASTAQDSMPDPMPEPMPDPSEDAIAGDPVPGSSGSDDAIQIIVTGGQVQDNYFVPNASSATRTDTPILETPASVQVIPRQVLEDQQVRDLGDALRNLSGASVNSTEGRGFQISLRGFNGVSVYRDGFRLYSPNDNGDAAGQGFPEIANIERIEVLRGPASVLFGQSEPGGILNIVSKAPLEQPFYEIGLQTDSRGSVRPQIDISGPLTEDNRLLYRLNAVYQNENEFQDFDERSERFFVAPDLAWRINDRTDLNLQLEYLNDDRPFNPGLVALGDEVADIPRDRILGEPDDSISSEFSNVGYDLEHRFSDTWKIRNAFRYLNQSDDISATLSFPFIGGLDEATGDLNRVFAEQDVNNKTLALQTNVVGEFSTGPVDHTLLVGVDLARYSLDSDSFTDFSPGPSRTPINIFDPVYGTPPRPERGDVPTRSDRIDTNSLQIYAQDQIDLLDNLILVAGFSYETVEQTTVTTSRGVTTEVDLTEDAFSPRIGLVYQPIENLSLYANYSRSFFPSAAVTVDGEPLAAEEGEGFEVGLKTELFEGNLLATLAYFNLTKQNVATTDLNDPRFSVATGEQQSQGIELDVIGEISPAWNVVASYAYIDSALTEDSSIETGNPLPGVPEHSASLWTNYEIQSGDLTGLGFGLGLNWVGERQGDLSNSFDLDSYFLTNAAVSYERNRWKFGLNFQNLFDVSFIEGTPRTRTRGIEPGDPFTVLGSVSYEF

SEQ ID NO: 790 - protein, 684 aa, Mesorhizobium loti MAFF303099
MQDPYTSRYPRTRGLASHAGPLVLLGLLALDARAEWGDPDPFFSEIPMVLTASRLAQSPLDAPAPVTVIDREMIVASGFNEIHDLLRLAPGFLVADHPDGPPTVATHGLGDAHARRIKVMVDGRTVNSPLWGNVIWDNLPLRVDDVERIEVVRGPNGAAYGVNAFQGVVNIITRAPSTESGRAFVVRTGKNGFRDYGVRLNGAGGSAFDWRLSASRRELTTFEPHFRERLGDWHSSESLTRNTAHFSAVLQLSAAEELGLQVGVSEGDSKRGAQAYLDYPPHTEEDRALHLQFGWRRHIDAESVLSVQYFHQGERAGGSWPVIQAQGTTTASFPTSRASEARRHDLELQYDTRLGRRLTGMLGIGLRSEHARSLHLFGTTRWLDSTHGQVFGSLTWNPLDPLKIDLGGTLEHHDYSGRLFSPRLAFNYALDEDSALRLSTGTAYRAPSLMESRAFQTDREGDTIRRIGFRVFDPLQSERMRFVDLGYVAQLRSFGLGFDARVFREYYRRFIDDKSCVFGECPRPEPADYVPIDPGKKSFYFLNVDDFRMTGAEFTLDWRKPGWGRAVLSQAFIRIDHGEPYSDRDIPNSAPHATTSLLLIKDFPGRWQASLGYYHNGLYYWMNGGDIVPRTDRFDLRVARRFGPPGSDNEVSLTALSLKGRYADFHEDKFRHEPDLYLGVRIGW

SEQ ID NO: 791 - protein, 912 aa, Mesorhizobium loti MAFF303099
MRLLATLVFLPCAAFAQASIQGLVLDPSGAAVPDASIAATLDSTGATRNARTGVDGRYRLPALSIGTYTIRCDKSGFQRAEVPQVYLALNQTLEQTIQLKLATAGSSIDVREQPEALNTTAPTAGTGISGEVLEETPSQNRSYLGVVLLAPGVAPAAGSNTLRTKAGVRSAAPDSGFSFAGMRARNNSLSIDGLDNRDETSGSSRVAVGQEAVAEFRVTASNVAPEFGGAAGGNLNVVTLSGSNKFHGDVNLFAADSFIEARNPEAETSARPDRRQYQPEAALNGPLRRDRTFFAGTIEGERESGQEFSEIPGAGVASRINAALALPIYSRAAVGSVAEGLFPTESVSTEASFKLTHRLTDSHELMARYAFSSAHIDREVLGADNFSEQSARGSSRNRDQSFAAGWQAVNGPFFVNELRFQFARRSLELTPNSRGALLEIPGMASFGQSPVLNSSRTEDHVQLVESATFVHGAHQFGFGASLQHVTLDARLADRFAGVFLFPTLDAFTSGRPDVFLQAFGDPHTRYATDPAAFWAQDQWRPGAGLTVIAGLRYEFQRLPAPFTAPTHNLAPRLGIAWQPRGHGAWVFRAGAGIFYDRYPLAYLNDAIQKDGVHGFEQYAVGAGALRIFTLARGGTLPEPVDVLAHSVYRPDPSFDATPTYARKFTAGMERSLDPDTTVTVEYMNVAGFHLPRLRNAALTLPPRFALEQSAGSRYYGVSVTLHRRLSKELTYLVGYTAGSARDDASDFDEQPLNPSNARLDWSRSRQYQAHRAVASGIFELPFDDIGAPQWLQNLGRNFDLAPVVSVGSPRPINALSTTDLNRTGAYPLTARPAGLDRNPFYERGVFSLDLRVTKGFVWWKDHGIFLFGLGFYNLTNHTNALRVSPYVGLQTYRGLIETLNARQAQFSFQWEF

SEQ ID NO: 792 - protein, 430 aa, Mesorhizobium loti MAFF303099
MQGFTAPRFSSSARLAGGCIAAALCAEATAEEAGFIEGARATLQARNYFFSRDYADIKGASTQSRTQEWAQGFTLNASSGYTQGTVGVGVDVTGLLGFKLDSSPEHARSGLLPSLDSGKSADEYSRLGAAIKFKVSQTELKVGELMPNLPVLLFSDLRLLPPTYQGAMLESREFAGLTLSAGQFRSTSLRDSSNSQKMYALVNDPINPARLARFTSDRFNYVGADYAFNDNRTSVGVWQAQLEDIYQQRFYSFKHAEPIGGWTLEVNAGYFDAREDGSKVAGDYDNHALFSLFSAKTGGHTFYVGYQQIGGDDGFIQVGANTNPMGNTLPTYEFSAPGERSWQVRHDYNFVALGLPGLTSTLRYVKGRDVDTGLGFEGRDRERDLDLAYVVQSGPLAGLGIRVRNVMARSNYRTDIDENRLILSYTIKVF

SEQ ID NO: 793 - protein, 340 aa, Mesorhizobium loti MAFF303099
MSSKLVNYLRLTFLSFLGIASTSLDAMPAGNPAFPVIPGINIEQKNACSFDLCNSYDVLSALSGNLKLCFCGDYIFSEEAQVKDVPVVTSVTTAGVGPSPDITSTTKTRNFDLVNCNLNTNCVAVAFSLPDRSLSAIPLFDVSFEVKVGGLKQYYRLPMNAYRDFTSEPLNSESEVTDGMIEVQSNYGFVWDVSLKKVIWKDGVSFVGVGADYRHASCPIDYIIANSQANPEVFIADSDGKLNFKEWSVCVGLTTYVNDYVLPYLAFSIGSVSRQAPDDSFKKLEDRFTNLKFKVRKITSSHRGNICIGATNYVADNFFYNVEGRWGSQRAVNVSGGFQF

SEQ ID NO: 794 - protein, 1158 aa, Enterobacter aerogenes
MQMIWMRNTNVINPLKGHHQSQVKLLKIKLFMKVVKKVIYVAMASFCLNLTVSSQNITLKMSNITVKQAMDELKSRSGYSFVFSSADVDTGKKISVSSENQSINAVIEQILRGQGLTYEIQGKNIILKKDILTSVDKKTKITGIVKDQYGEPIIGANVVVKGTTLGTITDIDGNYTLDIPLGASLQVSYIGYLTQEVATVGKNNINVSLIEDTQKLEEVVVVAYGVQKKATKTGAIEDIKGEDLKKNIAPNVSGSLAGKLSGVSMRPSNGKPGEDNPKIYIRGISSTGKQEPLIVVDGVIRDNMNQIDPNDIESISVLKDAAAIAPYGLGGANGVVLITTKKGETGKPTLSLNAYYGWQSPTVYPDMVNAKDYMTLRNEAYLNDNNGQIPQGGSLPFSPDLIADYDRLHALDPDKYPNSNFYDEMANFNTPIQSYNLSLSGGSEKVRYYLGLGYFDQQGMFDPVYYKRYSMNAKVDMDATKTTKLAFAMNGTVERNNLGPAPFAPGYMPIKNLYFSNGLPGESNGSSPGGELNSGSYDRRDNNTLLTTISIEQQLPFIKGLSVKGVFSYDPDFRYEKTWTKPNYYYIMDETTSPYTYKKAVNGEEITSLNQKSIKNERLTYQAYANYAQTFGKHEVTGLLVFEARDTKSNWFSAYRKNFQVDMDEMDMGNSDKMDFNNGGSSSQTTQAGIVYRATYGYDGKYLVEASGRYDGHSYFAPGKRWAFFPSFSAGWRISEEKFFKENISWVDNLKIRASWGQSGNLAGDPFQYLSAYELFNNAYAFGNTLVQGSKMPREANPNITWEKAESMNIGIDASFFNGLLTFAGDYFYQRREGMLLSPNINVPVEYGLGLAEENAGVMNNRGFEFQIGVNKMLPNGLMLHFDGNFSYAKNEMEKIYESLDTYNSPNRRRTGRSWKTPFGYKALGLFSTADDKNSDGVINVDDGYMIDQFGAVLHPGDVKYADISGPEGTPDGVIDAWDETVVGYAPYPRITYGFTLTAEWKGFDVSLFFQGAAQASINTQGYVTVPFRLNNTNVSYEFFNNYWTPERQDARYPRITQSPYKNNTTNSEYDNGFGPYSSSFWMRNSNFLRLKNIVIGYTLPSAWTKKAGLNSVRIYWTGQNLLTFSNLGFIDPEIDYEKRDEGYPLQKANTIGLNVTF

SEQ ID NO: 795 - protein, 725 aa, Legionella pneumophila
MVSKGKDNFKNFLQFSMVTNNNVNISQKGKYGSFRASITEVYNKGQYPNQNLNKITFSVGGEMTWKNFKMDASAAYNKRVSTNDHGSGYSGSYIYDMVIWGGSEYDVRDYRNYWVKGKEGMQQNWYDDSWYDNPWFKAYEITDAYDIDVVNAALNASYEITPWLKAMVRSGVDVYTKRNEWKNPISANQAWDKKGFFGVSRGTDMSINTDAMLMADKTWGKFNMNLLGGGNIYYTRYDFMSSKTKGGLSIPEFYSLNASIDPIEATSELQQKRVNSVYGKASLSWASTYFLDVTGRNDWSSTLSSDQRSYFYPSVSGSIVLSEIVKLPTWWDFLKVRASWTTAKEDAKIYANNNVYSVSTNVWDGLSTASYPSSKIGGQVRPKKSEVWEVGTATNMFKNRLFLDFSYYRKMESDFIIEGGVSSATGFNSIQTNFKETRLRSGFEITIGGTPIQTKDFSWDILTNWSHDQYTYKTIDPDYSTKKPWVKEGASWDWLAVYDWERDPEGNIIHNGGMPVKQNFQTKIGNTTPDLVWGITNTFKYKNFTLSFTLDGRVGGLSYSKTHQMLWNTGAGIDTDTQWRYEEVVNGNKTYIGQGVKVVSGSVTRDPDGNIIEDTRVFAPNDVVVSYESYISKYHDSHHNACRQNILKETFFKLRNLSLTYDLPSTLCQKMKMKSASIGFTGQNLFLWAKEYKYADPDKGGDSSGTESLNSPSQRYMGFNLKVNF

SEQ ID NO: 796 - protein, 1829 aa, Vibrio parahaemolyticus
MYVKRLFSTTALSGLLYFMAQSVYAEPIENNTTLQRPEGDYAGFDGSASDKKALFYRETLGSTDALTGSVDAGATSDPAEVQSWNGVDAYDAFTEEVYLAALSSPTPFTSDVDITLYLTRQTSTDAESLSIDAVGLWSETDDEITNSGSILIDATAGDTTSGGDAYSKAEAVGIRGGNIANTGDVTLWAHSGEATAHNNAFVNSEATGLVGTNIENSGKISVTALAGNGEASTGFVSADAYAYGIRGDLITNHGELSVTASTETGTIQARGLYAYEETVTLNTGDITISGTAGDNAQLFGIYAYDGTVGTSTGNINVIGVTVDGRVQAAAIDVHSGSLSNNEGTLFVDASSTHGRIETYGIRATSGQVGTNTGNISVLSETEDEKVEAYGISSGTLDLNSGDIHISAVSRDDIVRAYAIEVETTKNTGSLEVSARSSKKDVSAYGIKGQTETNEGSISVSATSDESYVYSYGIQGVVDTNTGLIEVESITTEGFAYAHGIQGNTQKNEGDIRAEATAVEDYAYAFGIQNGVTENTGDIQVTARSTEQQAYAYSIQGGAGTNTGDLTTTSMSENSYAYAYGIQGEVTTNSGNIQVTARGAQQAFAYGVQGNTTANLGALTVSAHSTNEYAQAFGISGTVNTNDADISVEAFAGTDNYSTFARAYGLHSYQSGDTPDNISRNSGDISIVAAAGDTDDTNGNIHASAKAYGIFLEAYNADDPIYGTISENHGNIEIIANGAELTGSSDINEENGRVDAIGVLANVDTNTGDIKVAATGSSIVGASKADLVVEAYGIRGNVATNSGTVWVKAVAGTNDGGTVSSYVQTSGLRGAVGTNNGDITVHGESAADYVHAYGIDTYKGDLTANSGSINVTGISGTDHVQASGIDIYEGDIGTNSGAIEVYGQSEQRYVQATGIDIFQGSIDTNSGKISARGFSKESYVQSTGIDLTDGNLTTNTGDIYVKAVSEQDYTRAKGIDGPLDNNHGAITSISIAQADYSRAYGIYDFDAGSTPSDLTENTGIIEVLAQSGDIVESDRDINSTAEAYGIQLTAFNSDDPIHGTIAKNTGDITVFANGGLVTGTSNTHNVDATVQAYGVQANITENTGHIYVEANGTSANNLSNGDLLTRAYGIDGDVEVNSGNITVFARAGTSDTGTVNTGTYAYGINGATGINEGQIHVESHSEDFVYATGLNDVVSLENREKVTALATSKDDFVYATGIAGDAGAEVTKNSHQVHAIAESESRFSYAYGIRADVGENSGDIIAQAISGTSASSTPAEYVYAYSVSGGLESNSAIIKADATSYGDQATAYGVAQASGTLTNTGVISARAQSISHGGDNDTANAYGIYLKNDLTLDSQGLILASASGDADSKAYQVHTDGFDLSIENYGMLLGSDLQLTDYEGTIQSDTGNNVTFDNADLYVYVDPVNLQEGEYSLPSLVENKTLTEGQFEDFANIDVLRSQLGTDWTVGFVEQTGTAGEQKIIFNYAPESSAALVSAAATRQMALNLQNLVDGQLDNLWLNSLSSSINSEQSLNSYAPVAPKSEGLAAINKAAPSGMYGDGFEQTTQVYMQGVLSQQAANYDPVGYNVYSQGLLVGLNSTITENILVGASGYNGQGKLDFTGNGFENGSEDIKIYAVGVQASYQYGSALLGLSSLYTHSENDFANATSTGSRTGSFTTDTLTTRLALKYKSEFAGNRFTPEVALTHVWFKQDDFTTSGTSHLDTRYSDLNENDLYLSANLGWSRDFNLGEWVVKTNAKLGVLHALTSNEVAGEVYQAAAVEELVFGADRTYLNTSAGLTLTSGNLSASLNYTGSFSENTSHRTLQGRVKYQF

SEQ ID NO: 797 - protein, 375 aa, Pseudomonas aeruginosa PAO1
MEMKKTLLAAALMTAGAVAHAQSSVTLYGRLDAGIEYMHGLPNNNGTGSTSRWRQESGDWGTSLWGIKGIEDLGGGNRALFQLEGAFSTANGSLGLSGSLFDRIANVGLANDNFGTVLLGRQLQIANGDWDFDPFGQSNWSSASLVRGRNWEHTSNNISYQSPKLYGFDVYGQYGLSNSTNWNAGAPGAATGRTDGIQLTYSNPLFQIRGIYDEIRDPLNGQLDNPFTASREYFVGANLFLGPFKIQAAYTAERTSGGVITPTGSPTSPTTADMEWGGVTWQATPVAALIAAVYHVNANNGGGNATIYTVGGSYNLSKRTLLDIQIATVRNSKTANFGLDANNEGPGGLSDGTFNENPVPGRSQTGVYAGIQHLF

SEQ ID NO: 798 - protein, 731 aa, Pseudomonas aeruginosa PAO1
MIDSWGEKESLEVHDNLNDFFRTGLTSMTSVSVSHGNENLQTYFSYANTTGRGIIEGNKLKKHNINLRETAAMFNKRLKLDGNVNVMKQTVENKPVSGGFYMNPLVGLYRFPRGEDLSYYKEHFETYNEERNLNVQNWHTFTEDFEQNPYWIVNRIQSRETRTRVILALSVTFKVNGWLTIQARGNMDYWADKLRQKFYASTATALCGVNGRYLEMDYQETQMYGDVMAMFKKTWGDFTLDAAIGGSINDKVVNSTRYDSKNASLKYANVFNIANIVMNSSASIDQKIDAHRQLQSFFGTAQIGYKEKIFLDLTARNDWSSTLSYTKHEKSGFAYPSVGLSILLDKWLKLPEWVSFAKLRGAYSKVGNDIPLYITNSTSHVNAGGEVQANDAAPFKEMEPEMTHAMEFGTEWKFFRHRLGINLTYYRTNTYNQFFKLPALAGDEFAYRYVNAGNIQNKGWEITLNATPVLTSDFTWKTSLNFSSNKNKIVKLHDDLKEFVYGPTSFSSSYAMKLVKGGSIGDIYGKAFVRDDQGRIVYGTEGDHKGLPLVEGDGNTVKVGNANPVFLMGWNHTFSYKGFSFYFLLDWRYGGKVLSQTQAEMDLYGVSEITADARDKGYVMLEGERIDNVKGFYKNVVGGRAGVTEYYMYDATNLRLREVSLSYNFPKEWMQKTKVLKNVQLSFVARNLCFLYKEAPFDPDLVLSTGNDNQGIEVFGMPTTRSLGFTLKCEF

SEQ ID NO: 799 - protein, 352 aa, Pasteurella multocida
MKKTIVALAVAAVAATSANAATVYNQDGTKVDVNGSLRLILKKEKNERGDLVDNGSRVSFKASHDLGEGLSALAYTELRFSKNVPVQVKDQQGEVVREYEVEKLGNNVHVKRLYAGFAYEGLGTLTFGNQLTIGDDVGLSDYTYFNSGINNLLLSSGEKAINFKSAEFNGFTFGGAYVFSADADKQALRDGRGFVVAGLYNRKMGDVGFAFEAGYSQKYVKQEVEQAQAPKVFKDEKEKAFMVGAELSYAGLALGVDYAQSKVTNVDGKKRALEVGLNYDLNDRAKVYTDFIWEKEGPKGDVTRNRTVAVGFGYKLHKQVETFVEAAWGREKDSDGVTTKNNVVGTGLRVHF

SEQ ID NO: 800 - protein, 1099 aa, Burkholderia cenocepacia
MAILTGAVPVSAYAACSATAPGSGTTVTCTGANAPSVVATAGSTNVTINLDSTVTGSYVLTSTPTPFSIDTSSTITNNGNLSMSGNGTGVANRGAVLLGVNNGNTLTNAATGVISTSGTYNDGMAANGNNNTLVNNGTITTTGNNAYGMTAAWGQSNPGASGNQIVNTGTVTTSGNNARAASLLGGNGTITNSGTLTSNGRDAPAVYMQGNNDTLVNSGTIQTTGTATSGGSVDAVVSNTLGSSFTATITNQAGGRIISNNGIGVRSTNGATTITNAGLIQGGGGTAIQGGNGNVTLILQTGSQIVGTANGGAGTNTVTLQGTGTASNAFTNFQSLTMAGADWTWAGTGTFSTALVQSGTLNLTGTLGTTTASVVATVNAGATLQANASNLPLSVTDNGLVRFQQDSAGTYTGTISGSGAVEKTGAGTLTLTPSAAGGNTYSGGTTITQGTLSVAADNALGAASGPLTFNGGTLQLGSAFDLAASRAMSITSNNGTIDTQGFNSTITQNITGTGGLTKLGAGTLTLNGANTYAGGTALNAGTLVVGDAAHASAALGGGGPVTVASGTMLGGYGGVTGNVTNNGTLSVANALASLASGATGNFRINGNLTNAGLVQLGGSGVGNTLTVAGNYVGQNATLALNTTLAGDGAPSDKLVVSGGTASGSSTLKVTNVGGAGAQTTGDGIQVVQATNGATTSANAFSLSGGTVSAGAYTYFLAKGGESNGTGDSWYLRNTVPPKPQPPVVQPGQPTPPAEPPIMAAEGTPESIVEAVDHAGVGGTPEPVYRPEVPLYAEAPAVARQLDLLQIDTFHDRQGEQGLLAENGSVPASWVRVWGGNSNIKQKGDATPSFDGTVWGMQVGQDLYADTTASGHRNHYGFFLGFSRAVGDVKGFALAQPDLGVGSLQVNAYNLGGYWTHIGPGGWYTDAVLMGSALTVRTHSSDIVNGSTNGNAFTGSVEAGLPIALGNGLTLEPQAQLVWQWLSLDRFNDGVSSIAWNNGNTFVGRIGARLQYAFDASGVSWKPYLRVNVLRSFGTDDKTTFGGSTTIGTQVGQTAGQIGVGLVAQLTKRGSAYATVSYLTNLGGEHQRTITGNAGVRWAW

SEQ ID NO: 801 - protein, 155 aa, Burkholderia cenocepacia
MIKRVLVVSMVGLSLVGCVNNDTLSGDVYTASEAKQVQNVSYGTIVNVRPVQIQGGDDSNVIGAIGGAVLGGFLGNTVGGGTGRSLATAAGAVAGGVAGQGVQSAMNKTQGVELEIRKDDGNTIMVVQKQGNTRFSPGQRVVLASNGSQVTVSPR

SEQ ID NO: 802 - protein, 471 aa, Burkholderia cenocepacia
MKKANTKEIENTRMKKGQYQTLKKGLLKTALLFSLPLSVVLAEYDGFYMGIGYQIGAAQQSVNNEGSTLRNNVINDFRQVGVDIAGGNGLLRVASNTMMNALLGLGDQIISDDNAGNTSNTQLTKFKQLLPQIKQRYEADKNAYTIQALQLYLNDLLYNLVTSNTSGNNNSKIGAVYAKTITTLHEAQSNFNLLATASVGLLNALTRVSINSDSAFLNGLLERMQLFNATSAEELGTIATSLNKSGATGVALQTDVQAIMNQIRAYQGNLQQLKDSLNGYNEPYLPQFGSGKSSQHGVSNGIGVQMGYKQFFGGKKNVGLRYYAFFDYGFTQLGNLNSTINANIFTYGAGTDFLWNIFRRVFSDQSLHIGVFGGIQLAGTTWDSSLKNQIQNSFQKKPTPTNFQFLFNLGLRAHFASTMHRRFLSASQSVQHGVEFGVKIPTINQKYLRANGADVDYRRLYAFYINYTIGF

SEQ ID NO: 803 - protein, 433 aa, Burkholderia cenocepacia
MKTKIVITALLPICIFANDISLSTAYELALSNDEEVKASMYENLASSERRKQATSAMLPSIDAQILYNGERYDKSSGRSGKQRMDETFTKYGVNLTQPLFRPELWYQRKQEVLRESGYSIMYDGSKQGLARKVAEAYFKLAYANESLKLAKSYESANKAKYDQMQKSLDMGLANKMDTLEAKVRYDEAILDVNKALRQIEVAKLSLAKYVGEEVGVKNSFENMDLSFFSNLNLSPYENIFANLDYKQSEISTQIATEEKNKRMTGVLPTVDFSVGFSNSDYKDDARFGDEDNKVETMIRFTMPLFKSGLTIERIQEGELLKMSSMSKQLDMQKKVAIEQKQAISDFRNYLQEANIVRNSLEHARVYEQAIERGYEEGLKNIVDLLDARARVYKTKADALNAGYQLILGYLNLEYLIGNISIDTIRNLERAFNY

SEQ ID NO: 804 - protein, 559 aa, Burkholderia cenocepacia
MKLRKLTLALATVLGSSLSSAAFALDLYVDTKTEQIYAKPGPGRVHIGSFVREEDAGTKTAGKTSKTADASVESPDSRIAERATEKTDPAELMAARRDIEMKAKMREARLASDLASLEERVKQTEKTRMKYGPGLHFESADGNFTAEVDGRLQADSQYNITNDVLPPAPNDRPYELNSGANIRRARLGVEGTMFKKWDYKFEFDFSRGNGSVTSGITDAFIRYNFDSPLSVKVGSFKEPFSLEEATSNRFLTFIERNMAVNTFLDNPNVYKTGIGVNYAVPRWQTGISFQTEPVGSWSSASTSVNPNGNNSRNNGSGDTSWEGVGRISGRPWMESETKFWHVGASAAYTRVNTQYEGDGDFANGGMSFASFPGANVDRTNVLNTGNLSFGNKNDLNSRRVESYTRWGAETALVYGPFSAQGEYLQTHVNGHGYSGESLFGFYGYLSYFLTGESRVYHVKNGAWNRIKPFQNFQLTGPGWGAWEIAAGYDYMNMNDGAIRGGKANLIKFGLNWYPHSNIRVMTNYIHVLDINTAGVADRRSAGFNNANLDMWLTRFQVDF

SEQ ID NO: 805 - protein, 705 aa, Burkholderia cenocepacia
MKFRLMLPAALLAAFSPAGQAQESDVKHTGTTLAPIRVNAQKATPLTQPLDTGSRLGLTSLETPASVEQIDRKTLDTRGDSAIVDAVSRAAGISASPHPGNGGSELGARGFVGASSVTQLYDGVRPYGAIGITFPFDTWSVDHIDVLRGPASVIYGEGAIGGVVNIVPKKPTRGAIQNELQVGGGTEGTARVAFGSGGAINDKLSYRFDISGNRSSGWVDRGNSRNLSISGALRYDVTSDLYVTASYAQGFQHPMQYFGVPLVNGARDRALDKKNYNVGDSDIAFRDSWATVSANWQPSDSLNVTSTLYRMKSNRHWKDAEYYTYLPSTAQVRRSSFTEIFHDQEQYGNVTAATVTTALLGMRNTFSTGFEFNHTTFQHDNNSPYSGTSTVDPFNFDPGSFINTAGTYPKYRSQANQYALFAENRLEITPRWSVIGGLRYDHASVNRDDLVNGGAFTKVFANTGWRIGTVYDVQPGLAVYGQYSVAADPISSLLSLNASKANFTLATGRQIEIGVKQSFLGGKAEWTLAAYRIVKSNLLTADPLNPNQSIQIGQQSSRGLEATVGAEIAKDWRVDANVSVLRAKYDDFQQTSGGTTVSRAGNVPVSVPQRLANLWVSWHFAPDWTGIAGVKYVGKRFADTANQLVMPSYTTVDLGLAWKPRKDTTITARAYNVFNRRFVQSAYYNETQYLLGNDRRLEVVANYRF

SEQ ID NO: 806 - protein, 770 aa, Burkholderia cenocepacia
MPAFSSTTSARSSAPRRTRLLTLLIALSTAQQAHALANETPRPFHIGRAPLEHVLLEIARVSGQHVSFASNLVQERWAGPIDGTMSAREAAGRALQGSGLTLASLPDGTLTVVAADVSAPPPNVGTLAATEVHGSTDDGFAVFSTSAITRVETAMSNMPHAIDTVSSGLLASRQPPSLADAVNQVGVVPVVVDQAAPPQYAIRGFMTDTISVDGLPDRIASMRPLEALDEIAVIKGPNADVAGVTMAGGTISASLKTPGIVPERSIAVEAGSHAERKVIADLGGAIGTNGLTYRVIGVQDSSANSDAGYIGHRVSYGHAALGWSDSATEVTVGVESLASRQPVQPATFALNGAPVRLASESPLGNTDDDVRGHAERFYYKLSHNLTDDWAVHSRWSYENVRLQSAQWHLVPTADGSVPMPTVGMGYRSDNRVWALSNDLAGTVRQGPLTHSLVLGWDEIQDRLDFHYPGAVDLGLQNPYAPVPLPATAFVPGLSLSQTVRQSVFRLRDRIAIGERWEISGSIRANDYTAKLPHAKLQGLAWTPALGVVYKLDARTSWFADYSHGFQINTGYFYNGATMQPERSQQLETGLRWEDRQRKLTAQAALYRITANHVGVADTSHPGYYTEIPEQSSDGIELSLQGSLARGWETSLWVTAAHIKRGLPGNPSFTAPGMGGSMWTTYTVQGGTLAGAGAGVGVTAQRWIPCFDGTAFRVPGFVQVDGSLFWHRKQWRIDLLARNLFNVRAYGNTVSSSFIPILPGRTLTLRVTRHF

SEQ ID NO: 807 - protein, 773 aa, Burkholderia cenocepacia
MFRKKLIVTALGGLLTGGAVSLPAWAEEGAVTAAPDAKPAQPGADDAAAAAPAAARASRVSRGTATRETNLGTVTVTARRRKESIQDVPVAVSALSGDTIRNNELRVVNDVTKYVPNFTGQSTEGRERPRWFMRGVGSNDPSDLSLSPIGVYFDDVYINSVFGQGFPLFDLDRIEVLRGPQGTLWGKNTVGGALSITSQKPTFDVSGYGKIGLGQYNSRLAEAAIGGPIGKNDVLAARVSVYHENADSFYTNTVQQGRFGGFHDNAVRFQVLAVPTSDTDFLFNIHGRNYTGGGNAWHAQGAGTGGANQFGFVGSSDPYTVSLNAPSSDHISTWGTSLTAHWRINPAVTLTSITAFEGLHRWYQDDEDYSAFDAARSHDRLSSRQFSQEFRLESPQNDRFSWLVGTHLFTEQLAEQGAGGGLPGSPSPAFYHLTDLTQHTQSAAIFGSVKYRFTDRFNVTGGLRYTIERKNINLTGLQDTGNVTFSNPGSWWDPSSVSSPLAVSARQNQTNTWRAPTWDLTPEYALSSNVRAYFRYARGFRSGGYNGNAYTQSTISTVSPEYLTDYEVGIKSEWFDKRLIVNASVFHYDYRDIQVFALAPNPFGGPPVSTLSNAGQGRADGFELELKAQPVNSLYLFANLGMLNTRYTEFRYVPTAVGNSFARSPHTTINAGFDYRVPVSFGTLTAGGDVNYRSREYFSATRQTMPQLWQGGYTVLNAHVSYTTPNQKYIVTGYVTNLTNKVYKKLELLPSYGAYPVLYGDPRTVGITLTAKI

SEQ ID NO: 808 - protein, 376 aa, Burkholderia cenocepacia
MNHPNGRADRLAVPRATLIAALLTCASLPALAQSSVTLYGRIDTAIEYANAGPNHVTRMGSGNLWASQWGLKGVEDLGGGYAAIFKLEDGFNAASGALSNSSALFGREAWVGITGPFGGVQFGELYTILHTTLVTYSLPGLGAGLAWGNATNNFVGPAFLRVRNSMRYTSPRYAGFLLRAMAARGTNGAAGQPATLGDTYGAGLNYARGGLSVDVDYMQQKFSPVAASALGATSPAANGNYTLGAISYDFNVVKIAALYLRHRGGPDVAAAIDSQSAYPHSDTMELSATVPIGRASLLLSIGHYRKIADSDGNADSYGIRFDYPLSKRTVLYTGAAMVRNGAHARFIVNGAAGGGVAVAKPGATASSIVAGILTSF

SEQ ID NO: 809 - protein, 743 aa, Burkholderia cenocepacia
MTVNRTTAAPARRRRAKVGAGIGLGITLFAAQAAAAQGDAPAPEADVAASATLPAIAISGERGGAFRAREASVAGLDDAPLRDTPASVSVVTRAQLDDQQAKRLSDVVRNDASVVNDYAPVGYFEGFAIRGFPVDLASAIRIDGLTVSGEQNVPLENKERVEILKGLAGIDSGVVAPGGVINFVTKRSANVASVTTGVDSRGSTSAAVDLGRRFGPDHQFGFRINAAKENMHSYIDGTNGRRTFGSIAADWDISPRASLQFNAEFQQWIQRSAPGYQLLGGTVVPSVNTTSKALGTQPWAKPVTTDALNLNARFDYRFNDDWNAYIAAGRSRTMIDDNSAFAYGCYYAPSCTAGATSPFFFGANGDYDVYDFRSPGEYRRNDDLRAVTTGKFATGPLHHELTLGVSVQRRVVHMANAVYDYVGSENIYGPDIAFAPSPNTAGSSYPQLDSWQYGVFGLDRISIGDHWQVLAGGKEVLLRQRSWSSLDGDATHTDRSVFLPQVALVYKPVNVLSLYASYSKALSLGDQAPVRATNAYAFLPPVESHQFELGAKYDWLDRLSLTAAVFSISKPFQFADPDTSGTSYTFVQRGTQRHQGIELGAAGRVTERLSLTASVAAIRARAYDSGSPAYEGHQIINVPALRASLYADYAVPGVAGLNMLGGVEYSGGRNANEEGTARVPSWFVFNLGARYTTKIGGHRTVLRVSVDNLFNKFYWRDAGEQQGDAYLFPGAPRTARVSLTYDF

SEQ ID NO: 810 - protein, 681 aa, Burkholderia cenocepacia
MKTPTLVAALAAAPFAPEAFAQSADAALTLGKVQVHQHGEGQLSARQVLTSVDVLGADQIEDRNVSHSWELLGQMPGIQLTETRQGAESGKVSFRAFNGEGYLNAIKTLIDGIPSNVNSGNQRFIDMLFPLDISYIEVVRGTNDPRYGLHNIGGNVNFGTRQGGSYTDARLAYGSYNTRDAQLAVGREANGFAQNYFVGTQASDGYRDHDTSKKYSLGGKWFFGTLDEGLRVGLTARAYHHEADEPGFMTAEELRTLRRGSELRNGNDGDDRDMRQIAAHVDLKLSDALTFGTRLYYNRYEDDRRVTFSDLPTGNLPRQRRVWDERQTGLLSTLTWQASPALTVEGGLNYEQQDNGYIRERYAYAEPTDYSQPPARVQNDDRHSFDNWGAYVQAVYQPVEAWKIVPAYRVDRFSGRTHLMNGITARLQDYGSIGQPKLSIIHSLGQTTHVYANWGRTFQVLTGSTAPAYLTPGQAPMQPSTNTGMELGLKFQPFQGAQARLAVWQQDAENEVSNMPATGTTVTLGKTRRRGVDAQLSLQLGDDWTVWASHAYQEAKITRDDRDAGISLQGREVAATPRHISNLGVDYRATDALRLGLQARAQGDYYLEERNVAGKFGGFAVLDLSAAYQLTPRFSVDLQLKNVTGRQYAYAWYDSFFWDSARPMFSPAPGRSVFVGLNMKL

SEQ ID NO: 811 - protein, 375 aa, Burkholderia cenocepacia
MKKAVVGTLSLACFGAVAHAQSSVTLYGMLDAGIAYTNNQSGKSAWQQGSGLLSNTVFGLSGNEDLGGGLHALFRLESGFNLNNGTQSYRNTLFGRRAYVGLQSDRYGALTLGRQYDAVVDYLGPLAMANNGDGNNLASHPFDNDNLDDSFYIDNAVKYTSPTLAGWQFGGLYGFGNAAGGFANNRAYSAGVSYANGPVSVGAAYLQLNRGGLTAGGALSTNDAPNFPAVRQRVMGAGGSYAFDRLTIGAVWTHAMFDETAASSLPGALNALRFDNYEINARYALTPAVSFAGAYTFTDGRYDDATGSHRPKWHQVTLMADYALSKRTDVYAETVYQHQFGVPSGATLGFANVTGVAASSTRTQVVATVGIRHRF

SEQ ID NO: 812 - protein, 798 aa, Burkholderia cenocepacia
MTNFKKNRLLKIKTKNISITVMSLLMSLMSFTQNGTLSGKVFDKTTNKALPYANIILNINNQIVTGTITDEDGVFVIKKVKRGDYNLEIQFMGYTTKVIPVSLTRNNTKINLGNLYITEDFVALESVIVLAERSTIEQKIDRKVINVGKDLTTVGATASDIMRNIPSVSINQDGNISLRGNENVRILVDGKPTNISARDLLQQIPSTSIKTIELITNPSAKYNPEGMSGIINITLKKDANLGFNGSVNLGFTYGERARYNNALSLNYRAGKLNFYGSYGNRLGKGITNGTVTRTIENTNQLTRNINDNTSHLLKFGVDYFINDNNTLSIYTNQNLFETIVDGNRVITFFENPSLNFTQRDIADSDNINSTYNLDFKHDFEKEDHSIEFEVDYNVLDSDKAFEFIFSGNSPTSDYMELIDDDRSNTTINLDYTNPLSQNSTLELGFETRLRRTDNVYDTGNPNFNNSTFFYNRDIYSFYTTFSQKINKWQYNLGIRFEDYSVDSQFNEEGEDLFTFKDKLFNIYPSVFLKYSPNEDEKNTYQLSFSRRIDRPSLNQINPIRQINTPQILLTGNPALVPQFTNSVELNYSRKLDKGNFTVGGFYRRINDEINRRGFFDDDNPNLLIIDYDNFDSNNAYGFEFSSSYKLTDWWRLNGSFDVYSRTQKGFIEGESVEVNNTLLNAKLNQSFKATKDLTFQLFTFYSGRQSILQYDLKENFFINAGARYNFAEGKGTISVNFNDIFKTQRFAFETFRTIIQEGEFRTDSRTVYLGLAYRFGSGKNKNVNRKKRDKNEKADKVL

SEQ ID NO: 813 - protein, 385 aa, Burkholderia cenocepacia
MKKLALSTLSLALLGAAGAAQAQSSVTLYGVIDTSITYVHGNDGQGNNSWSMGSGNLQGSRFGLKGSEDLGGGLKAIFQLENGFNSASGALGQGGRMFGRQAFVGLQSDQYGTLTLGRQYDPLVDLVQAVTADNYFGSVFATPGDVDNNDNSLRVSNAIKYTSPVWAGLQVEALYALGGVAGSTGKGQTWAAAAAYNNGPLGLAAGYFHANNSAPLSAVGQRTGWAGTSDAIFDGSGNFINNAYTSASSIGIAQVAGQYAFGPVTFGLGYSNAQYKADANSGFGTNQKYNTGRAFVTYQASAPLLLGVGHIYTKGSGQTDAKYHQVSLGADYSLSKRTDIYLVGAYQHASGKNADGTDAQASVGSYGIAGKSSQEIVALGLRHKF

SEQ ID NO: 814 - protein, 395 aa, Burkholderia cenocepacia
MKAPVNRYAILILSAASLGTTAAHAQSSVTLYGVVDDSLAYVNNQQGHSNIYMRDGNLYASKFGLRGDEDLGGGTHAIFDLQAGFNLNTGAQAAAGTLFNRQAFVGLRNASYGTVTAGRQYTPHFLFVGPYASSSWLTGATGAHPGDIDGLDTTIRVNNSVTYTSPTFAGLTASAMYAFGGIAGATGKGNTFSAALRYANGPIGIAAGYLRINSSGSSAGFLNPATASSGSFAVSVLNQGYLSAKAVEQVAAAGNYTLGDLTMGLNYSNVKYLPGNGSAFTDTAVFNTYGALAAYRFTPTFSVAGAFAYTLASKANGVASAARYQQYSLKESYSLSKRTTLYALQAYTHSSGQTLGAQGAGHIVDAAPIVGDSQQLTPSTTHGQFVGMAGIAVTF

SEQ ID NO: 815 - protein, 746 aa, Burkholderia cenocepacia
MGNNENGGISFCVFVVVIGFGTGAVAQEPANQSEAVTSLEEIVVTGGRSAQQISEIARTIYVVDSDQIQAEARSGKTLQQILGETIPSFDPASDGARTSFGQNLRGRPPLILVDGVSMNSARSLSRQFDAIDPFNIERVEVLSGATAIYGGNATGGIINIITKKGKDAEPGLHAEVTGGMGSGFAGSQDFDRNAAGAVTYNSENWDARLSIAGNRTGAFYDGSGTLLIPDITQTSTAFNERIDLMGSIGYQIDDDRRVEFSGQYFDSKQDSDYGLYYGPFFAALADPSLFETRSGYESDFNPQTRRSMLNVTYTDNDVFGQQLLLQGSYRTERIKFHPFPASGNSETGPYFYGSSQDTDYYGIRAALVAEPTDALKITYGIDADMDSFTARQNIFDMVAAGQSGGLDFNTIGKTGLYPSIDVSTVAGFAEASYEATDRLTLNGGVRYQFVNTEVSDFIGAAQQVAILQGRATSADTIPGGEVNYDAALFSAGATYQLTNTQQVYANFSQGFELPDPAKYYGIGNYSFSGGHYTLVNSVNVGDSALEAIKTNSFEIGYRLDDGTFNLETAAYYSLSDRSINLNRSSLAVEIIDRERRVYGIEGKAGVKLDHGFDVGVLGHWVRTEVKGADGWEKDSVGSASVSKLGGYVGWTNDALSLRFSGQHIFELTDAQNFTIDDYTLFDLTGGYRFENTDTTLNFGIHNVFDTDYTTVWGSRAKALYGGLADESVFDYKGRGRTFAVSLTKVF

SEQ ID NO: 816 - protein, 363 aa, Burkholderia cenocepacia
MKSRAERSIRTVVLTGSAAAACLAAPAAHAQSSVTMYGIMDAGIEFTNHAAPEGGNSVKLKSGNKNTSRWGLRGVEDLGGGLKAVFRLESGIDLANGASDDGPDSIFARRATVGLKGKWGELSLGRNFTVTYDYMLPFDPMGYAQNYSWATSSMATGGRKDGLFTRSSNAVRYDGEFSGFKFGALYGFGNVPGSMKTSSKYDFAVGYETGPFAAVVTFDRQNGAADSVTPADTVNYIQGIHAGLSYDFGNLKTMAGYRNYKRTFHTTAANQLSDMYWLGGSYQFTPTFSLIAAVYHQNIKGGTDADPTLVSVRAQYALSKRTVLYAAGAFAIAKHDQKVGVSRDFAGYGTTQVGVTAGIQQRF

SEQ ID NO: 817 - protein, 405 aa, Burkholderia cenocepacia
MKKRVAFAMTAVGLAAATAAHAQSSVTLYGIVDNAIAYQNNSSATGATTGGHSKVQMATGIWAGSRFGLKGSEDLGGGTKAIFQLEAGFNANNGSSQWTNGIFTRQAWVGLSNQTYGTLTAGRQYTAYYTLLSPYSPTTWLTGYYGAHPGDIDSLDTSYRANNSLVYMSPKFYGFTVGGSYSFGGVAGSVNRGSTWSAAIQYLNGPAGIAVGFQRINNATLGGGVWGANSTAQNGLDTSGNGAEQAVSSINNGYRTAQAQQRLAVTAGYQFTPAWDVSVSYSNVQYIPGTLSGFRNTAIFNTAGAVLHWKAAPQWDFAAGYSYTRATESNGISSSAKYHQVTLSQYYSLSKRTGLYAVEAYQHASGNTLTPTGGVILATTSTGDGVGAGSKQNQIAAGVGLIHRF

SEQ ID NO: 818 - protein, 380 aa, Burkholderia cenocepacia
MKKTLIAGACTAALFAPVAHAQSSVTLYGLIDAGIVYTNNANGASLWRLNSGTVNGSRVGFRGTEDLGGGLKALFVLENGFNVNNGGLGQDGKLFGRHAYVGLSQNGYGTLTLGRQYDTMVDFVAPLSATAGDFGDASFAHPFDNDNLNHSLRINNAVKYTSETYAGFKVGAMYAFSNATNFGANRAYSVAASYTNGPLKLAGAYLQMNGTKGSTSASPGATDAAEAKSLNQGGWSIGSDRMRSYGGGISYGFGPATVGFVYTRSQYDNTGSFGSTGQVAFNNYDVNVRYAVTPAVSLGAAYVYTDASVSNPDSKHGTDPKWHQVDLQAVYKLSRRTDVYAEAMYQHAAGRGYQAFINGSGGASSTANQIVGTIGMRTRF

SEQ ID NO: 819 - protein, 403 aa, Burkholderia cenocepacia
MHSCQMNQHAGARVAGTVIAACLSSFVPDVAHAQSSVTLYGLIDTSITYSTNQRTRGAGSPGGGSVAMTSGALNASRWGLRGREDLGGGMAAVFALENGFSGTTGKLSQKGVDLFGRQAWVGVSSQTAGTLSFGRQYDLILDYVTPLGASGPGWGGNLAVHPYDNDDSNRNLRINNAVKYASPTVRGLRFGAMVGFSNAAGQFSNNAVWSTGVSYENGPVKLGAGYLKISRDRNAPNPDGALSTVDGSATITGGNQQIWAMAGRYAFGPHSVGAAWSHSATDGVTGVLQGGNIAPLKGESLVFDNFSIDGRYFVTRALSVAAAYTYTMGRFDTRTGQTRPKWNQVVAQAGYVLSKRTDAYLEGTYQSVSGGNGNPAFNATVWTLTPSANSKQVVVALGLRHKF

SEQ ID NO: 820 - protein, 551 aa, Burkholderia cenocepacia
MLAWLLIAGVNGVAQKASAQEYINIEATQAQESIDLNSPPLSPINPMAQVTSVSQLKDVQPNDWAFQALQSLVERYGCIAGYPDSSYRGNRALTRYEFAAGVNACLDRVNELITTATSDLVTREDLATLQKLQSEFAPELATLRGRVDSLEARTGEFEANQFSRTTKLSGLLIVGIQGRTSNRGDVNPRDGQKDTDDGGTNINVISLAQLYLTSQITPSSYLFTGLIDGKGKTSPRFTNSVSRNDVLLGYEYPTDSLIVSDLNFHWLVTDKLAIMVGTEGVSMPAAFRGPNRVESAATGPLSYFAQRNPILNMGYGHGGIAIDWQFAKRASLQAIYTSYKPGNPGNSSGLFDGTTTTGVQLLLTPTDTLDLSLYYVNNYSSDGCLLTFVGDECLTTVNTTTGKSAPLQTNAVGATVTWQISPRISAGAWGGYTKSYIPGQSGNVETTNYMVFMNFPDLFAKGNLGGIYVGQPPKITSSDLPVGNNVPDFINTGLGRAGGQPGTTTQIEAFYRFQLTDNISITPGIIHLLQPGNTPDSDSVTIGILRSTFSF

SEQ ID NO: 821 - protein, 184 aa, Burkholderia cenocepacia
MNIRHGIIAMSSTMLVPLAAEAACNTDYSWIDKSCERISDTWKNGDHDLYIPLWTHHLRFAYDNDKIDSFREFTWGLGYGRSRYNAAGNWEGVYLMAFSDSHSNVQPMLGYGHQWMMGPRSGLHAGVGYTAFLTSRADIYKNIPIPGVLPIASLNYRQYSVNTSYVPGGRGNGNILFFWSRVGF

SEQ ID NO: 822 - protein, 369 aa, Burkholderia cenocepacia
MRLKYFAWLIAAATPAAAFAQTSVTLYGRIDGGVEYLNHIAKPNGGSGTRWSAESGDWGTSMFGLKGVEDLGGGLSTVFNLETAFQVMNGQTGGGRMWSRRAYVGLKSNTWGQLQAGRNLFIDSDGVWEFDPFVQQAFSSASLVRGRNWQQTSNNIEYHSPVIGGFDVQAQYAFGNQSRGFNYGAPDDFGRSDGIMISYHSPVLDVRGIYDELRDNNGKFSNVFTASREYFVGANVKVSKFKIQGAYTHYQAPDSPAGVADRADHYWLGATYSATPQWAVTGGGGYYVKVGDGGGDASHDPSGHAMMYVLGTTYNLSKRTFLYGTVAYVRNGGNSNFSLLATPRDATSGTSPMTGESQTGAYVGMMHTF

SEQ ID NO: 823 - protein, 800 aa, Burkholderia cenocepacia
MKHPTQLFRKPFLSLLFILINTTLFAQEKYTIRGSISDVINGETVLGASVYLKGTTIGATTNEYGFYSITAPKGTYTLIVSYLGYKEIKKEISLTEDIKLNFELEEASNTLEEVIITADEGIEKLNVRKPQMGVVALKAETIELAPAVLGEVDLIKTIQLLPGVSNNGEGSAGFNVRGGAVDQNLVLLDEAIIYNTSHFFGLFSVFNNDAIKNVKLYKGDIPARFGGRTSSVLDVRQKEGNNKDLELNGGIGLISSRLAVESPMFNKKGSFLLAGRTTYAQLFSGLLDDLGNSNISFYDLNLKTNYEINENNKVYLSGYFGRDVFNISGLLDSNYGNASANLRWNHIFNDKLFSNLSLIYSKYDYQIILDFDQLDWISDIENFNVKYDLNYYATDKLKIDFGLNGISYNLNPGEIVPSTPSSSVNPLILDQKNAFEAGAYVSAEHTITDKLTARYGLRYSTFNRLGQQTITNYANNQPVVYNQELGIYQSGTAVGSTPYSRGQTIRKFGNLEPRLGLSYKLTDKSSVKGSYTRTAQYLHLLSNTISVTPLDVWTPSGPYIKPQLSNQYALGYYRNSNDNKYSFEVEAYYKTTDNRIDYIDGANLLGNNTIETEILNGEARAYGLEFLLRKNKGRFTGWLAYTLAKSEQRSFGGNAGGPGINNGNWYNTPYDRTHDISLSGVYKLSDKWTFSSNLVYQTGRPVTYPSGQFEYEGSSIVIYDERNANRLPAYHRLDIAATYKPNRRPDKRWKGEWVFSIYNLYNRMNAASITFNQNYNTGVNEALRTSIFGIIPSITYNFKF

SEQ ID NO: 824 - protein, 806 aa, Burkholderia cenocepacia
MLPPNPHLGSLALAIAIALGVQAHSASAREDEQASQARLQNFDIPAGALGDTLGQIARKSGRTLSVDPALLEGLDAPAIRGQLSPEDAARQALAGTGLELLVTGSGTLSVQPVDEKTAQSGGRIDGISLDAMTVEDNALGTITENTKSYTPGTIATATRLVLTPRETPQTVTVVTRQHMDDFNLTNINKVMDHTPGVMRHGTDNYRSYYYARGYQIQNFQYDGIPVLTGTDMGNTSVDMIQYDRIEVIKGASGLTTGAGTPGATINLVRKKPTHEFSGHATAEYGRWDNYRTEWDVGGPLNESGSIRGRFATAFQDQQSFMDHFKEQTRALYGILEVDLSPQTMWTIGANYDKRIPTGNSAGGFPLLDSDNNEINMSRSFNPGASWSRVEQFSHAFFTQLDHEFDNGWSSRVYYTFQRNAYDANLGAIQYTPDADDGNSALATGQYRYKIRTQALEGYARGPFELFGRTHELAVGVSGYHNHLKGSGHNYRMVSIDNFWDWDGNVGRPDWGGILYRAEDRVNQRAYYASGRFSLTDDLAVILGGRVTNYRRGGDSNMRETGEVVPFAGITYDLNDNFSLYASYTKIFQPQSTRDESYSILDPNEGDSYEGGLKGEWFNGRLNASLAYFEIREDNRAEFVGWNSERNYSMYEGKKAKTKGIELEVSGELMPGWNIQAGFTHQVIREDETNEKLTTFEPENQFKLYTTYRLPGRLNKITIGGGGSYQGTTWRDGTDALGNDHQYRQEAFWLVNLMGKYQITDNLSATLNINNLFDKYYYSNYGESWNGIATKTYGEPRNMMLTTRWDF

SEQ ID NO: 825 - protein, 1088 aa, Burkholderia cenocepacia
MKRRLSVVFLLLIGTLTYALAAERQVEGVVISSEDKLPLIGASVYVTAEDLKKNGNNQSTIGVITDIDGKFSISIPDGITRFYCSYVGYDVVEIKLIPGKKQYDITLQPSAHMLDAVVVTGYQTVERRKLTAAVSKIDISDQMVGAAKSIDQALTGQIAGLSVSNISGAPGAPAKIRIRGTSSLNGTQDPLWVLDGIPLEGTNIPSMEVLKDIDNVGQTAIAGLNPADIDNITVLKDAAATAIYGARAANGVIVITTKKGKVGKPVINFSSKLTYSPKLNIDRLNLLNSEEKVGLELDLLESGYPYRETKGEVYRIISGLGELQNFKDGGWNALSSNAQGAINRLKATNTDWSDILFRDAFTQEYNLSLSGGSEKATYYTSFGYMKENGNIPNVSAERLNLVMKTSYKVNSILKVGASMFANRRKNSTYLPDDRGLTNPIYYSRLANPYFTPYDANGNYNYDVDVEDDTDMDFGLNLFEERKNTSNETTINGLSSIFDAELRFDDRFKITTQLGLQLDKTSIEKIAEEESYVMRTEKKNHRNNGVTYLPEGGFHKANENSLSQLTWKAMGEYRDTYNDIHEFEIMVGTEIRKTWEEKLYSAGYGFDRKTLTTKPIIFPEESQAFKLHEKAHVENAYVSAFSTLSYSLLNRYTLGGSIRFDGSDLFGVDKKYRYLPLYSVSGLWRISQEPFMANAKWIDNLVVRASYGLQGNIDKNTSPYLLGNYRIENILPGGSEDMIDVSGAPNKKLRWEKTHSVNAGFDFAVLNQAINLSVDYYYRKGVDLIGTQMLPLETGFEMLTVNWASMQNQGVEVALSTRNIHTKNFMWTTNFNFAYNNNKILKEALREDALEPGREGYPVGALFALKTAGLDEEGYPMFEGKDGKAVSAMEFFKLQEWGFGATDLTARERRELYTYVGTADCPYTGGFNNTFTYKAFELGVNFSFDFGGKVRSQPTYSIVDFDKGRNTNRDILNRWTPENTETIFPVLLSQNERLDEYMWYSNQNEIYRNLDIWIRDLNYVRLQNIRLGYTLPTNFSRKLGMTSATIAIEGRNLLVFGSSYKNYLDPETMSNAYATPAPKSVTLSLNLNF

SEQ ID NO: 826 - protein, 359 aa, Burkholderia cenocepacia
MVKHAVAAAVVGMGAVSGAWAQSSVVLYGSLDAGVAYVNNVGGHAKWAMIQGNTQPDRWGLKGKEDLGGGLSAIFQLENGFYTNNGQFATANTIWNRAAYVGLSSERLGTLTLGRQTPLMFDYLDPLSTAYLAMSWFAFHPGNIDGLAATGNVPYNNAIKYRSPSFAGFSAAATLALGNTTNFSTGKSVGVALNYANGPFKAAAVYSSEHDRSVLISQTGIASFQGQNTANGYLANKVENIGAGASYQFGDFLVHGLYTRTKMQSNGYSDTFQSYDAGVNYRSSPFNTIAGGAATTTLAGRRWTQVELGDIYALSKRTQLYANVLYEHATGGAHAAFFTAGVSSTANQLIVLAGIHHSF

SEQ ID NO: 827 - protein, 362 aa, Burkholderia cenocepacia
MNKTLIVAAAAASFATVAHAQSSVTLYGVLDAGITYQSNVASKSLWSMGSGVDQSRFGLRGSEDLGGGLKAIFTLESGFGIGNGKLSNNGGMFNRQAFVGLSSQYGTVTLGRQYDSVQDYLAPLTATGTWGGTYFAHPGNVDRLSTNGDVALNNSVKFTSANYAGLQFGGTYSFSNNQNFGNNRAYSGGLSYQFQGLKLGGAYSQANLGDGTNGNGATNIASQGRVRTYGAAAGYAFGPAQVGAAWTQSRVDNTAVAGQSVRADNYEVNAKYNLTPALGLGVAYTYTNVRLSNTVDGLNSAHFHQVGVQADYSLSKRTDVYAQAVYQRGSGLNASIYNGDLTTPSSSSMNQTAATVGLRHRF

SEQ ID NO: 828 - protein, 390 aa, Burkholderia cenocepacia
MKKRLTWGAACLALGAGSACAVPYQDVLLAAVPEFNGGLKEGVALYGSVDMGINYQSVDGRSTWQTQSGGEWTSKFGFFGRENLGGGWRAEFNLESGFLANNGAQQDTQSFFNRQSWIGLMSDRYGRLRLGKQIGTGLPLFIDVFGTVGTNSVYTWLGAAAVQTARGVGYNSDLGPGATQLPARVDNAITYRTPIVAGTTTLMLMYAPSNVAGRAPAASAQGALLQWYNGTTYLAASYNQVWGVNGASTVRNDLYGLGAVYDTGRLVLSASFNQYAPKLAGDGIARVYTLGTIVPFGVNAVRASVVYRDTSGVRDAAGRPAKDSALGVMLGYDYLLSKRTGLYARVGFIRNYGMSTVLLNGNPLPTEPGGTTPRTGMTPVTMSLGMYHNF

SEQ ID NO: 829 - protein, 957 aa, Burkholderia cenocepacia
MKNFYVLILSFFLCLVAQSQTRTISGVVLDENSQPLGGVTVAIKDTNKGTSTDFDGIYSLEAEFGQTLVFTFVGFDAREVFIDSEEINVTMVSGMALGEVVLVGSRNPSRTVVESTVPIDVLDVQEMTIAVPQVNLNQMLNYVAPSFTSNTQTISDGTDHIDPASLRGLGPDQVLVLINGKRRHNSSLVNVNGTFGRGSVGTDLNAIPASAIKRIEVLRDGAAAQYGSDAIAGVINIVLIDQTDELSVNITTGANFSKNANEQTGGVDGETVNVAASYGISLGEKGGFVTFAGDFDYREDYNRMREWEGTIFNAYNAIEFRAANFGANIASLTDDQIKDFAQDVSYFSSEFQNDISNAEDRETLQSLLGMDVTENELDARGLDRTDFNMRVGQSGLRGGRFFANMSLPLDEEGTELYSFAGMSSRRGNSAGFYRLPNQSRTYTPIYINGFLPEINSKIKDQSIAVGVRGAVSEWDVDFSNTWGKNEFQYFISNTSNASLQRASPTSFDAGGFSFIQNTTNLDISRLFQEVFLGLNIAFGAEHRFENYEIVAGERGSYEQYTQSGDVVVRADQNPATDFFGSARPGGSQVFPGFSPKNELSRERSSIAGYFDAELDFSEKFLMTFATRFEDYSDFGSTLNFKLSSRYKLTDDINIRGAVNTGFRAPSLHQLYFNSTSTIFDNAGNPQEVGTFSNDSRPAELLGIPQLKEETSRSISLGFTAKIPDANLSLTVDGYFVAIDDRIVYTGQFSGPGTGSELDNLLAQANATAASFFANAIDTESKGLDMVLTHKAVFNDNLRLKSDLAATLSKTKKVGDINASEVLERAGLVDTYFPEDSRIYLEEAVPRTKVNLTNSLTAGDFNFFLRNVYFGEVTEASTVLENQQVFSSKIVTDLSVGYHATETLTLTLGANNIFDIYPDRAEEEFNNRSSGRFDWSRRAQQFGIAGRFLFARLSINLD

SEQ ID NO: 830 - protein, 747 aa, Burkholderia cenocepacia
MKSRPDELKLGKFTTLCSVLAASPAFADGTPPAAPASTEGHLAPIEIQGKTEHSYKADFSASAKFTAPLVDTPKSVTVIPQELIQSSGAATLTEALRTVPGITFGAGEGGNPLGDRPFIRGYDTQGSMFVDGMRDTGATTREIFNTERVEITKGSDGAYGGRGGAGGSINLITKAPHLGTTAAASAGLGTDRYRRFTADGNWQFADHAAFRLNLMSHNNDVAGRDAVNNERWGVAPSIAFGLGTSTRVTASYYHLQTDDMPDGGIPYFYTTSNKPANVDTIYPAPVDRHNFYGLIDRDFRKTTSDISTIKIEHDITPNLTVRNTTRYTESTQDYIWTQPDDSQGNVVNGKVWRRNNNRNSSINSLANLTELFGEFRTGPFKHSFTTGIELSREWGKRDSYTVATDKGTICQKGIGAPSGYNCTSLWSPNPNDPWAGSITRNNDYAHARTTTKSIYGFDTIEITPRWQVNAGVRVDDYSTRFTDTKANGGKTYTRDDTLFNWQAGLVFKPAQNGSIYASYATSSTPAGMLLGEGSETQSLTPGRGGVGPNADQLSPEKNRSIELGTKWNVLNDKLSLTAALFQIDTTNARVTLPNNQYAMVGNKRVQGLELGLAGQVTKQWQVFGGYTYMKSELRDNGKDTANNGNRFPNTPKHSLTMWSNYDVTPKFTVGGGAFYMSEVFGDPANLRAVPSYWRFDAMAQYRINKKLDLQLNVNNLFNRTYFDQAYPAHYASIAPGRSAFVTLNARY

SEQ ID NO: 831 - protein, 514 aa, Burkholderia cenocepacia
MRPASRSRFFSLTNQTANGTRMKQLSSVPRKLRVDALAALLLSLAAASAFAQASAPATEPAAGKNDAAAPAQPAADAAAPAPTGLWERSNLLGNMGGLRDVLDEHGVTLSLQETSEYLYNTSGGTGRGGAYQGLTQFGFDVDTGKAIGLPGGTFNVSGLQIHGTNLTQRYLQTLQTATGIEANSTTRLWELWYQQSLLDGKVDVKVGQQSVDQEFMVSQNATTFMNATFGWPVLPSTDLPSGGPAYPLSSLGVRLRVKPADAWTAMVGVFDGNPAGRSDGDAQVLNAHGTNFNLRSGAFVIGEVQYALNAPPADPKAPQPAGLPGTYKLGFWYHSQHANDPRYGTDRLSLADPASNGTPATHRGNYGFYAVADQMVWRPSADSPRSVGVFARVMGSPGDRNLVDFAANAGVTLKAPFVGRDNDVAGIAVGYAKIGSHARGLDGDTGAYTTPGYPVRRAETVIEATYQYQIAPWWQVQADLQHFFRPGGGIPNPNAAGARIGDETVVGVRTTITF

SEQ ID NO: 832 - protein, 749 aa, Burkholderia cenocepacia
MFKYRMIAALIFVLAAIQSFASVVGSVRGIVHDPQHRPLDSATITLTARGSDYRQTTTTNSAGEFAFAAVPAGEYEITVVATNFRAAVQSVQVTASAAPVLHFQLAVATQSQTVEVTDSGEGLDVQPATGMVSSRDIARTPGATRTNSLAMITNFVPGAYMVHDQLHVRGGHQVSWMIDGIPVPNTNIASNVGPQIDPKDIDYLEVQRGDYSAEFGDRAYGVFNAVTHSGFERNREGELILNYGSYNQTNSQINAGDHTQTFAWYASLSGNRTDVGLETPTPEVLHDMNSGVSGFLSLIWNKGNHDQFRVVSSARNDFYQVPNTPEQQAAGVADTEREHDVFLNGAWVHTTASNTVFTLAPFYHLNHAAYDGSAADDPVIPVQDRTSQYAGVFAAATLVKAKNTLRLGTQMYAQHDNAFFGVTCSESGLTAETCGPDADPPSPTAVNDRVTPWGGVEAVFAEDTYNPLPWLRVNGGLRFTHFDGEISESSVDPRVGAQIRLPHLQWVLHGFYGRYYQPPPLATVGGPILELANQQGFGFLPLKGERDEQWEAGVSVPFRKWRGDVSYFQTKARNFFDHDVLGNSNIFFPLTIARAHIHGTEVTVNSPTVFGRAQWHLVFSRQWAEGSGGITGGLTDFSPPEEGSFFLDHDQRTTIATGMTVNLPWRTWVSANFAFGSGFLYEDGPQHLGSNNTVDLAVTKSIGERWSIGASFINVADHRFLIDAANTFGGTHWSEPLQVTGEVKYRFKF

SEQ ID NO: 833 - protein, 738 aa, Burkholderia cenocepacia
MRYEVREPERSMMQGARIARFGRWRPSLYLGLLIAAHPAAAFADAAPAAGAEVRQDETAAAQPAGGELKAIAVNASRGVADDPSVATVGKMPLALREIPQSVSVTTRERIDQQNLFSLDEVMQQSAGVTVQPYVLLTTAYFVRGFKVDSFEFDGVPVVIGDMASAPQDISVYERVEILRGANGLLHGSGNPAATVNLVRKRPQYQFSAHATASVGSWDRYRAEADIGGPLNAAGTVRSRLVAAYEDRHFFYDHAKQDTRSIYSVTEVDVTRDTLLTFGAQYQTTTSVPDMSGVPMARDGSSLGLSRSTFLDTAWGRFNWDTTRAFASVEQKLGAGWKAKVSGEYQSVRSDLKYAGSFGAIDPATGAGGRLTGAAYQFSSYSRSIDANVQGPVHAFGLTHDLLFGVTYANSSSGQMTAPLLGDVAGTPVNVYRWNPSSVPEPGIGPYQQSQQNDVSQKGVYGLGRIKLAEPLTLVLGGRMSWWNQDSLGAHYNTGHQFTPYGGLIWDFARDWSWYASYAEVFQPQTKSMWGGGILTPVKGRTYETGVKGELAGGKLDVSLAAFRIDLDNNPQVDLAHPCAGPSCYYVNGGSVRSQGFEFEANGRITPWWSVWASYTYDTMRYADNLANAGTFAPLLNPRHLFRLWTNYDLPWQERRWSIGGGVQVQSSYSAQANGVTMSQGGYALASVRLGYRYDKHWSAALNVNNLFDRNYYLSLSQPGWNNRYGEPRNVMLTVRGQF

SEQ ID NO: 834 - protein, 379 aa, Burkholderia cenocepacia
MKHTKVAVAAALACAACIPAIGHAQSSVTLYGILDAGITYVNNTGGSHVVKFDDGVAYGNRFGLKGTEDLGGGLKAVFALESGFRLGNGQLGFGGAEFGRQAYVGLQNDWGTLSFGNQLDITNELVSIYNISAWGSGYAIHQGDFDRFNGDRLPNSVKFLSNDMSGFKVGAMYSFGNVAGNFHRNSAWSAGASFTKGDFSIGAAYTRLNNPNGIYAFDPYAMIGTHTFLGQQTVTVDPATGARTDLFANTPMDVDSQGTFGIGTSYTIGKLTLDANYSYTTIKGFGQSSHMQVYEGGGLYQFTPALSFIAGYQHTRFEGHHWNQGTAGLHYLLSKRTDVYISGDYLRASQGVDAVIGYSFTPSTTQTQADVRIGMRHSF

SEQ ID NO: 835 - protein, 274 aa, Burkholderia cenocepacia
MKKLIVAGVVAGVSTLASAQQAGDNVATLGWLHIMPQDSTNGLTTNLANMPINGPLRLPGSFTSPGTSLTVNNADTVGLTLTHFFTDHIAVTSVLGVPPEFTLTGHGVIRPPGPAGSLGSVDMDKTSNQPAVKNARQWSPTIILQYYFNAPTAKFRPFVGIGVAYSWFSNIELNGNFAKDINENLGSVLAAGAGKPGPTSVEGKASSSFTPVYNVGASYAIDKHWGLTATLTYMPLKTYSSLVIKAADGSTLATTRTRLKADPLITFVGISYKF

SEQ ID NO: 836 - protein, 777 aa, Burkholderia cenocepacia
MIRRPKAAGWYGAMRHGRRARCVGVTVGTLALFGLPPGSVRAQQPADGGTIAPAEPPAVVLPAVVVVGTTPLPGIGTPLSKVPANVQTVRAAELDAQHRATLADFFAANLPSVTISDAQGNPYQADVNYRGFAASPLLGTPQGLSVFVDGVRVNEPFGDVVNWDILPMQAIDRVQLIPGSNPVYGLNTLGGALAITTKNGRSNPGGEAEVSGGSWGRKTASVEQGGTIGSNLDYYATANVANDGGWADHNASRVRQAFGKLRYTDADTTLSIAAGGADNTLSGTQTIPRSFLDNRKQAYTYPDRNRNSAGYLTLSGERFFGEHVELSGNAYYRHLRNTNTSSNNNTDYGSVDEDGAIDTVQGSNAQSTIVTDSYGGSVQLTRLGKLGGMANRLVAGVSADVANSSYVASSQDASFTDARAAIGIGDFVPQTSAKTRNANVGVYLSDALSLTPHWTLTLSGRYDWSKARIGDESGVQPLLDGSHVFSRFNPAVGLNWNPVPGLTAYATYNEGMRSPTAIELACADPAAPCSLPNDFIADPPLEPVISKTFEAGMRGRIGAATTWSAAAYRTTLTDDIQFISSPASAQGYFRNVGDTRRQGIELAGRTRVGPLGVGLSYSYVDATYRSSWTEHSPANSTAGANGNVTVKPGDRIPGIPAHTVKLRLDYAATPAWDIGANVTWRGGVYARGDENNGDVNGRLAGYVLVDLDMRYRITKRFEVFASVTNLLDKRYASFGALGQNFFNGPNHTFDGARPVNEQFVGPGAPRGAWVGVRYAWD

SEQ ID NO: 837 - protein, 356 aa, Burkholderia cenocepacia
MKSRTWTICAALLGAAASTSSFAQSSVTLYGDLDAALLYTSRSLDSATGGNAGRQFALTDTGMTPTNFGITGTEDLGGGLHARFKLESGFNITDGAFGHSNGNFFGRQAWVGIDGGFGETKVGLQFSPFVLAILGSDPRNVSHFGAALVPYVDNVLVTGLFNPNAISYTSPTIAGLTASAMFGFGGKAGDFQAGRQYSGSLTYTNGGFMLNAALYDGNGGTSPTPVPSTVAFVGRTIGAAYTFGPVTGKASFTSYKVAGSFSNNVYSAGLDYRVTPALDLNTGAWYTTDRNDSHNHSLLAAIGADYSLSKRTGLYAQVGVVNNHGAMNTGLGITGGALYGLPGTTVGVNAGIHHVF

SEQ ID NO: 838 - protein, 722 aa, Burkholderia cenocepacia
MPSRRTPCRARTLHPWRIPLPALLTLCVASGAHAAGTEPVAPAPAAASTTEHELPAISINASAAVDPTIGYQPRTTSIAGGDARALKEIPQSVAVVSSSVMQDQQARSLDDVLGNISGVTQTNTLGGTRDAFIKRGFGSNNDGSVLVDGVRTPVLHSYLATIDRVEVLKGPASLLYGMQDPGGVINLVTRKPEDTFGGSISASRTNHGGSNAQFDLTGPLGKPGQIAGGTLAFRLTGEYDTSRYWRSFGRERNALIAPALSWHDANTSIDVSYQYVDYTMPFDRGTVLVNGQLDDALRYRRYEEAWSQSSGIQETLRTRIEHRFSDAWRVRATYGWGRDRYDQFITRATAFNSRTGALTRSSDANLGRNDSDQIATLGLLGNVTLAGMQHAIYVGGEYERQRSFRGDTIRGKATTGFNLYDPVYGLLAPGGLPNAKQSDSRSVVHAYSTIVQDSVKITDRLTAVGGLRWENWQQESGMGRPFVFADRSRGSVWLPQFGLAYALTPALTAYANVSRSFKPNVASNVAAPLAPEYGRVLEAGLKFSLKPAITGTLAVYQIDKRNVAVTVGDLTSTIGTARSRGIELDVAGQITRHLSVIGSYAYTNANDRDSNTPLVNVARHTGSLFAVYDTAIANLPGRWRFGGGARLVGARSGDTANSFTLPGYVSVDAFAAYETTIGKFPTRFQLNVKNLLDKTYYPSSNSNLIVAVGEPRLVTLTTTVSF

SEQ ID NO: 839 - protein, 713 aa, Burkholderia cenocepacia
MEDYKMAANSAYLSHPFKTSVISSSLAIAMGLSLAPQAMADDSELANIERLEVHGQQTENRNTLGSAENLLKGQGVDFSEAGGVSALPILNGMMGDRIKVLVDGADITASCANQMNPPLSYISANQVTTAEVIAGVSPVSAGGDNIAGVIKVSSLNPKFGESDSIKWNNGDISTGYRSVSDTLLLGTNATVASKNISLSYQGAYEDANSYKDGNGDKVIDTLYRAQNHALTAAWRDETQQVAIKLTHQNIPFQGFANQYMDMTDNKSYGALARYQLKLDDDGEFSAQFNWHGVKHEMGFFTPEKTGKMPMNTEGDDYSYQLHWRLPMGDDSTLLVGQEFYSYHLDDVWPAVPGTMMAPNDYININDGERRRAAVYGEWQQDLSPSWWLSAGVRFEYVTTNTGEVQAYSDMPMMGMPNMDAAAAQAFNEMDRERNDDLIDATLLARYQLSANQQLEFGLARKNRAPNLYERYSWGRGTMATTMIGWYGDGNGYVGNPDLKPETAHTLSAAYKYNGDSWQVSTTAWYTAVTDYIDAEVIGSFNRTSSADGKRNILQFTNLDANLYGARFNALYQFAETNTGKWQVLGKVNVTRGERDEGNEPLYQIKPLQTELALQHQLGNWENSLSWQWVATKDRVDDRRLENETDSYSLLNLNSSMKWQDLTVTFAVNNLFDSYYELPLGGVSVAEFKADNTNGFKQIAGAGRSFELSASYAF

SEQ ID NO: 840 - protein, 370 aa, Burkholderia cenocepacia
MKTLYKLAPLAMLGAFATHAGAQSSITLYGLISAGVGFATNQGGKNAWQALSGTNQNPRWGLKGKEDLGQGLSAVFQLENGFNVMTGTAAQNGREFGRMAYVGLADRTYGALTFGRQYDAIHDYIGPVIIASNGVNIGDNDNGYNDIRVQNSVKYVSPVHYGLKFTALYGFSNTTGFANNSAYSFGLGYERGPLRWSVVYAQYNHPYSATNQDGAIANDYASPLLIFSKSAMSPAAYASRQRIAGTGGFYTIGRAQFAAMFTDVRYDYLDNSHLHLQNLGVNVVYTMTPQLFLGAAYAFTNGKYDVIDKRPKWHQVNLQADYFLSKRTDVALTVIAQQAAGDADHAQIFAYARSTGTRQMMATLGVRHVF

SEQ ID NO: 841 - protein, 383 aa, Burkholderia cenocepacia
MLSNQASQHSRPKPRFMLGAVTVASAASWCVAAHAQSSVTLYGIADVGVEHINNTNTGGAQTREASGNLSGSRWGLKGVEDLGGGMKAIFQLENGFNINDGTTAQSTKGLGSNAATTSRIFGRQAWVGLAYRGQQLTFGRQNALFYEQAVAFDPMGASSRYSVLSVDYAAAARIDNSVKYTGVFGPLTAQAMYSTRYDTGYGAEVPGAQLTGRFFSGALTFSQGPLAASVSYEQRNSNTVATNTGTERRATAAASYAIGPVKGFAGYRYLRASNAFLPANPIRVANGAEASAANLYWAGAQYAVSPAFVVTATAYYQDVHSTSADPWLAVLCADYLLSKRTDIYATAGFARNKGGSALGVNGYGTVAPDHNQTGVVIGMRQKF

SEQ ID NO: 842 - protein, 387 aa, Burkholderia cenocepacia
MNKKLLTAATLAVFASAAHAQSSVTLYGVIDAGISYVNNSKTATGHDNLFKYDDGVAQGSRWGLRGTEDLGNGLKAIFVLENGFNSGNGTLGQGGAMFGRQAYVGLSQNNVGSLTFGRQYSFSTDYLGGNYSTGGQTVAGNYAYHINDVDQLTSSRINNAVKFSSANFAGLTFGAMYGFSNQAGAFAGAPATGTAAAPVAGSSRAYSFGVNYANGPFGIGAAYTDIRYPGQSTPSFSTTIANVATGNVRDLRTFGVGGRYSIGAATLWALYTNTRFEPISGGTTTFAAYEAGAKYAFTPALTAGAGYTYMHLSNANRGHWNQVDLSVDYALSKRTDVYALGIYQIAAGRNGTQDLQAQIGSSTSYFNTSGTGADNQLAFRVGVRHKF

SEQ ID NO: 843 - protein, 769 aa, Burkholderia cenocepacia
MHCYSLARRPICAALFGVFGLSAAPAYADSTANAADATYVDSSSKGANPPSAVLVAASTRGDAALLDPVTVTATRTATAASRTAASVSVITDDDLEEQQATNIKDALRYEPGVTVRRTAYRPGSAALGGGRDGDSSINIRGLEGNRVLLMEDGIRLPNAFSFGPLEAGRGDYSDVDTLKRIEILRGPASALYGSDGLTGAVNFITKDPRDLLSIYGKPIYFSFRPSYDSADRSVGATVSAAGGNDRVQGMIIADGRRGHEVDTRGSNNSASTLRTTSNPQDVYSESLLGKFVLTPTARDTIKFTAETVQRRVSTDVLSAINPPTTLGLTTNDRLERNRFSVDYDFRDDALRWFQTAHVQFYYQDAKQDQYAFETRGRQPSRSRDNQYQERTFGGSAFAESGFSTGPLAHKLLYGVDGSLSRVTNLRDGTVPGVGEAFPNKAFPDTDYTLFGAFVQDQIGYGRLLVTPGLRFDTYRLSASQNDPLFTGTAVSTSANEVSPRVAVLYEITPALIPYAQYAHGFRAPTPDQVNSSFSNPVYGYTSIGNPNLKPETSDTFEAGLRGKAGTGYGVVRYSAAAFTGRYRNFISRTTISGSGRPVDPFVFQYVNFADARIHGFEGRAEWVMPNGITLKTAMAFTKGSTQNNGAASQPLDTVTPFSAVFGVRYEPGERWFVQTDLLFQAAKRDKDIPADACPGARTSCFAPPSSFVVDLRGGYRFNKHVSATIGIRNLFDRKYWNWSDVRGIAADSQVLDAYTSSGRTVAVSMKVDF

SEQ ID NO: 844 - protein, 350 aa, Burkholderia cenocepacia
MQRKAFLVGACVLCASPAHASSVTLYGIVDSYVEFDRIGSLSSVRQSGGGSSTSRIGLTGVEDLGGGTSTKFLLESGFSPADGSFQGGTLFYRQAYVSLQNTRYGDLRLGRQYTPSFYVVYEGDPFGLNERMSPLALLATSTDTITSNTTPPIPRFNQAASYLSPDWNGLRVMATYGFPTPNALSMQAGRNYGTGLQYRIGGLYLGAGFQGDVSAGNLSPVVYPSTTRHYVFAANYAFARVKLYAAFLHGASTAPNLPAFSTASVGASINVGALDRVLVSVVRRDVKGSANDATAFGVGYDHPLSKRTSVYARYLCLKNGGDARNTVVAGVQPQPGGTEQVLALGIVHRF

SEQ ID NO: 845 - protein, 474 aa, Burkholderia cenocepacia
MLLAWGLPALAGVSLTGVAHADDAAPAPLTVAQAAPGTTVAQATTPNAIVNAEATQAVTPPDEPSAQSQSKGFIADSHLNFLFRNYADVLDAKGGPHRHAWVQGAMANFESGYTTGLIGIGFDASLYAALKLDGGQGAGSMVHIAKGGGGGNQLAWAYPGIYDVKVRISNTVVKYGLQAVDNPFMEQHDNRALPPTFLGTTIVSNEFKNVMLEGGSFTKTDARGHTTLTNLTTQYGGTRINRLSYVGGTWDYSPNGEVALYANQADDVWHQYYASLKHSIGSPQTIKWTGFGNVYSTHDTGDALQGKINNNAYSLSLAAQHGPHELLLGFQQVLGDQFFDYLNETNGIFLTNSMDVDYNAPHEKSLQLRYTFYGKEAGLPGFKAMVWGVTGWGADGSAGAANDPSKSSIYWSNGAPVQGRHHEFGFIPSYTFQSGKLKDTKVTFIAMWHAGSAHYSDATNTEYRLVVNLPLHAF

SEQ ID NO: 846 - protein, 382 aa, Burkholderia cenocepacia
MKTKTRIGLVAAGACCALAAPLAHAQSSVTLYGIIDTGVEFVSHANAAGDHVVRMPGVTGELPSRWGLRGAEDLGGGYQAVFMLESGFNVRGGDLGQGGRLFGRQAFVGLKGGFGTLAFGRQYTMTYLALQGADIIGPDIYGLGSLDAYVPNGRADNAVTYIGTYRGVTLGAAYSFGRDGAGTGNSPGQGTCAGQVPGHAVECRNWSVMLKYDSAYFGAAASYEEQRGGTGAAANFFDGVAPVAFTSSAGKDARVHVSAYAQAAGARIGAGWIGRRVSTGSPAAAGAHSDLFFVGASYAVKPDFVVDGEGYRIVNSAHDTRATMATLRATYLLTKRTSVYAQSSYLWNSAHARYAVSGGGAGTTPGEGMGQLGAMVGIKHMF

SEQ ID NO: 847 - protein, 709 aa, Burkholderia cenocepacia
MKRIITLLTVFPLILNAQTPATEEASAQEASTLEAVQVQGSKENKSYQESTESISVVPSRELDSPIQSDSIQALNAVPNVSINKNDDSFSIRGVNNTGVTGFQKDNLSSILVDDVFQTDLAIKAGSFELWDSQQVEVYRGPQSTTQGVNSLAGSILLFHNKPGDQTEGAAKLGYGSFNRIEAGVMTNNVWLEGKLLSRVSVNHEQDDGFIKNIKTDNNKWGGKSKDHLGLDLTYKINETDYVRWNTKIMQNETGGNYVQSANPFDYEVNEDVDFESKTGNQQTSLRYFVKLNDQWTNEVIGAYSQAKNDETSDADGTANPTAGVRTEEHNDRFVSVENLLKFQNEKLKNVLGFHAHDYYLKDDARFDILYPLSVSVFTPVASSQVTDKYRTVFALFDSYLWKFTENQSINLGLRYEFVKNKYGADVTATRKQNLGAGTNAAVDAYLDSVTGSYEDEDNNSILLPKVAYMLTQDQHSYGISYTEGYRTGGLSINRKRVRVDTYDPEKTGNYELSYKYAASNWNFSSAAFYTDWKDQQVMVQLSNDPFDTQVVNAASSELYGAEAEINWKPASRHEFNLGAGYVKTRFKDFVNGTKDYTDNEFPFAPNWTGRLSYGYQISQDWNAAGIFRYLSKSYGNAENTMDSPEQFYLDLLGQYSLAAWSMNVDLYVRNVLDTRYVIYDRTSSIGGQSVSYNQVNSPRELGLRLNYFW

SEQ ID NO: 848 - protein, 1089 aa, Burkholderia cenocepacia
MTKKSNLSLRFTRVWEKHCLKTAAATLLLCCVLPVQAKADTYKTQETASIQQQTVKTTGVIIDNTGEPLIGVSVKVQGTNTGTITDLDGKFSIDTPPKALLEFSFIGYKTITMEVTGKELHITMQEDSKQLDEVVVVGYGSQKKVNVTGSVSMVNADVLESRPVQNVSQALQGVIPGLNMSVGSSGGTLDGKLNVNIRGAGTISDGSSSSPLVLIDGIEGDMNTVNPKDIESVSVLKDAASSSIYGARAAFGVILITTKSGKSGKTRVNYSGNVRFSDAIQLPDMVDSYTFAQYFNRASTNGGESPTFDEKALQNILDFQNGKFTDPSTPEYYGVEAGPDGKWKSYAGSFANTDWFKEFYKSWTPSTEHNLSISGGTEKLTYMISGSFLNQNGLIRHGEDNFNRYTMNAKISAKPAEWVTLNYTSKWTREDYDRPTYMTGAFFHNIARRWPTCAPMDPNGHYMPNMEIIQLEEGGVQTSQRNWYTNQLQAIFEPVKDWRIVVEGSMRTYTRKQHWAVLPIYGYDVNNKPYLLSWNGGAAGYSEVQDEREDEDYFSGNIYSDYAKTIGNHYFKVMGGFNAELFRPSGMTGFGTDLISSNVPSLGLTQDNQKANAWARERAIAGFFGRVNYNYKERYMLEANLRYDGSSRFVGDKRWGLFPSFSAGWNIAREDFFRPLAGVIGTLKLRGSWGQLGNNNTDKANAWYPFYQNMITGSANSGWLIDSKKQNTAQLPGIVNSLMTWETIESWDIGLDFGLLDNRLTGSVGYYNRYTYDMIGPAPILPPVLGALPPQVNNCDMKSYGWELELSWRDRISEFDYSARFVLSDGKRKILRYPNPTNSLSSDVYYNGQILGDIWGYKTIGIAQTQEEMNAHLANGGTPNWGTNWGAGDVMYANLDGKEGVNNGSNTLEDHGDLTIIGNNTPRYNFGLTLTGAWKGFDFSVFLQGVMKRDYWLDGPYFWGANGGLWQSTAFKEHMDYWRPEGDPLGANTNAYYPKPYFNTDKNQKVQSGYLQNAAYCRLKNAQIGYTLPKIWTRKAAMESVRVYVSGDNLVTFSGISGVFDPELLGSDWGDGKLYPLQRTISIGLNVNF

SEQ ID NO: 849 - protein, 241 aa, Burkholderia cenocepacia
MKRISAGAVVLVAAISGAHAQSAGQWVVSAGWSHFAPQGAADPLTLNALGQSQVMTGSGGDIASGDTFGLTATYFLTDHIAATTVMGFPPTWHLNGAGTLSGFGELGTARAWSPAIIFNYYFGQPNARFRPYLGAGVTYTWFSNIKLSNPVSTGQIYFSPTVGTALEGPTSVSLSHSFAPVVNGGLTYNIDSHWSINASVAYSWVSTRATLTTRSSVGTVTSTSKFRVNPIVTFLSVGYRF

SEQ ID NO: 850 - protein, 1238 aa, Burkholderia cenocepacia
MTYRSSKTDLKNERFSKNRSFKGIKKKIAKKYTIKNSPLTIYSLKTHSNPSLSINKKIFLGLGFVSALSAEDYNSSVYWLNSVNENNNNKSYYISPLRTWAGGNRNFTQNYNNSQLYIGTKNASSTPNHSSVWFGEKGYVGFITGVFKAKDIFITGAVGSGNEWKTGGGAILVFESSNELSANGAYFQNNRAGTQTSWINLISNNSVNLTNTDFGNQTPNGGFNAMGRKITYNGGIVNGGNFGFDNVDSNGATTISGVTFNNNGALTYKGGNGIGGSITFTNSNINHYKLNLNANSVTFNNSALGSMPNGNANTIGNAYILNASNITFNNLTFNGGWFVFNIPDAHVNFQGTTTINNPTSPFVNMTGKVTINPNAIFNIQNYTPSIGSAYTLFSMKNGSITYNDVNNLWNIIRLKNTQATKDADKNHTSSNNNTHTYYVTYNLGGTLYNFRQIFSPDSIVLQSVYYGANNLYYTNSVNIHDNVFNLKNINDDKADTIFYLNGLNTWNYTNARFTQTYGGKNSALVFNATTPWANGSIPKSNSTVRFGGYEGVNWGKTGYITGTFTADRVYITGNMMTGNGAQTGGGATLNFVGATEINIAGATFKNLKTTSQNSYMTFMALGDSSGSAKINVSQSDFYDWTGGGYDFTGNGVFDSVNFNKAYYKFQGTENSYNFKNTNFLAGNFKFQGKTTIEKSVLSDASYTFDGTNNTFTEDKFNNGSFNFSHAEQTDAFNNNSFNGGSFSFNAKQVNFSGNSFNGGVFNFNNTPKVSFTDDTFNVNNQFKINGTQTTFTFNKGVVFNMQGLLSSLSVGTTYQLLNAKSVDYKDNNALYQMLRWISGENPSGTLVNKDQSAPNSAKIYNVHFTDNGLTYYIKENFNNGITLTRLCTLGYTHCVNIDNDAFNLKNVNNNASNTVFYLNGMTTWKIAGTGVFTQDYSGANSVLVFNQTTPFLAGANPTSNSVVSFGKTSGAEWGLVGYIQGVFKANQIDITGTIRSGNGAKTGGGATLVFNAQKRLNIANAHLNNDKAGLQNSWMNFIVNNGNLNVTNAKFSNQTPHGGFNLKANNITWDKGSVNGGGNFGVDNADSNGATTISGVTFNNNGTLIYKGGENSAGNSLTLENNTFNSYNINAKAQNLIFNNNSFNGGSYSFNDTKNTTFKGTNTLINSDPFSRLKGSVSIENNSVFNIERDLTDKTTYTLLSGNSIKYNNQALAGQCFFKKFMEFNPLWWRTRDSIKSG

SEQ ID NO: 851 - protein, 547 aa, Uncultured bacterium pES01019D12
MRVNLLITMIIFALIWPVTALRAAVSKTTWADAPAREFVFVENNSDDNFFVTPGGALDPRLTGANRWTGLKYTGSGTIYQQSLGYIDNGYNTGLYTNWKFDMWLENSPVSSPLTGLRCINWYAGCNMTTSLILPQTTDASGFYGATVTSGGAKWMHGMLSDAFYQYMQQMPVGSSFTMTINACQTSVNYDASSGARCKDQASGNWYVRNVTHTKAANLRLINTHSLAEVFINSDGVPTLGEGNADCRTQTIGSRSGLSCKMVNYTLQTNGLSNTSIHIFPAIANSSLASAVGAYDMQFSLNGSSWKPVSNTAYYYTFNEMKSADSIYVFFSSNFFKQMVNLGISDINTKDLFNFRFQNTTSPESGWYEFSTSNTLIIKPRDFSISIISDEYTQTPSREGYVGSGESALDFGYIVTTSGKTAADEVLIKVTGPAQVIGGRSYCVFSSDDGKAKVPFPATLSFITRNGATKTYDAGCDDSWRDMTDALWLTTPWTDISGEVGQMDKTTVKFSIPMDNAISLRTVDDNGWFGEVSASGEIHVQATWRNIN

SEQ ID NO: 852 - protein, 196 aa, Wolbachia pipientis
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKGSTRQVTDAGAYKVLYSTVGAEA

SEQ ID NO: 853 - protein, 190 aa, Wolbachia pipientis
SYYVRLQYNGEILPLFTKVDGATGAKKKNADAGTTTDLYKASFMAGGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFDKAAKDDAEIKKVLYSTVGAEA

SEQ ID NO: 854 - protein, 194 aa, Wolbachia pipientis
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLKTAVNDQKSKFGFAGQVKAGVSYDVTPEVKLYAGARYFGSYGANFDEKKTNNLIGQVADAGAYKVLYSTVGAEA

SEQ ID NO: 855 - protein, 188 aa, Wolbachia pipientis
SYYVRLQYNGEILPLFTKIDGITNVAGKEKDSPLKASFIAGGGAFGYKMDDIRVDVEGLYSQLNKDAGVAGTTVADNLTAISGLVNVYYDIAIEDMPITPYVGVGVGAAYISTPLATVVSSQNGKFAFAGQVRAGVSYDVTPEVKLYAGARYFGSYGANFDKTDKDGKGELKVLYSTVGAEAGVAFNF

SEQ ID NO: 856 - protein, 196 aa, Wolbachia pipientis
SYYVRLQYNGEFLPLFTKVDGITYKKDKSDYSPLKPSFIAGGGAFGYKMDDIRVDVEGVYSYLNKNDVKDVAFDPANTIADSVTAISGLVNVYHDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 857 - protein, 186 aa, Wolbachia pipientis
SYYVRLQYNGEVLPFKTRIDGIEYKKGTEVHDPLKASFMAGGAAFGYKMDDIRVDVEGLYSQLNKNDVSGATFTPTTVANSMAAFSGLVNVYYDIAIEDMPITPYVGVGVGAAYISNPSEASAVKDQKGFGFAYQAKAGVSYDVIPEIKLFAGARYFGSYGASFNKEAVSATKEINVLYSAVGAEA

SEQ ID NO: 858 - protein, 159 aa, Wolbachia endosymbiont of Cuerna gladiola
PFKTRIDGIEYKKGTEVHDPLKASFMAGGAAFGYKMDDIRVDVEGLYSQLNKNDVSGAIFTPTTVANSVAAFSGLVNVYYDIAIEDMPITPYVGVGVGAAYISNPLEASAVKDQKGFGFAYQAKAGVSYDVTPEIKLYAGARYFGSYGASFNKENSISY

SEQ ID NO: 859 - protein, 171 aa, Wolbachia endosymbiont of Cuerna gladiola
PFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKKAKDDGGIKVLYSTVGAEA

SEQ ID NO: 860 - protein, 272 aa, Wolbachia endosymbiont of Clydacha catapulta
PFSRDWATAEAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAG

SEQ ID NO: 861 - protein, 670 aa, Wolbachia endosymbiont of Clydacha catapulta
VLDTVTVKGDRQGSKIRTNIVTLQQKDESTATDMRELLKEEPSIDFGGGNGTSQHMTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYSRNDEKDYEAGKGYKSPNGGKTVPYSALDKRSYLAKIGTSFGDGDHRIVLSHMKDQHRGIRTVREEFTIFDPNPIKDRQKPSYRETTQSNTNLEYTGKNLGFVEKLNANAYVLENERYSADDSGSGYAGNVKGPNHTRIATRGANFNFDSRLAEQTLLKYGINYRHQEIKPQAFLNGEFKISDKKPDPSNPKKEIDKTDEEKAKDKKDMDFVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKATGSILAAGQKNRDKQLENVVRKGFGVNDVFANWKPLGKDTLNVNLSVNNVFNTFYYPHS

SEQ ID NO: 862 - protein, 1027 aa, Wolbachia endosymbiont of Paraulacizes irrorata
PLSYTLYEKTVVIKRKPPLINKDFADVVVTGVIRDDQGGTLPQITIRIKGTALGTNSDSNGKFTIKLPDGSQTLVFSAIGYETLEVAVNNRTQIDVTLKEKVSTMNDVVVVGYGSQKKADVTGSIASVNEEALKSVPVANLVSALQSQAPGLDIQKSGGNSHPGSTPSISVRGQRSLGATNDVLYVVDGIPFNGTYINDLNQDDVVSVQILKDASATAIYGSRGANGVILISTRRGKTGAPVITYSNYAGVMKPLGYYDVMEPDAYQVYKKWGSYHANNPNVINAPNPYNGIDDPRFYTDGITFLPAELAGLQNGTNTNWQKQIFKNGFRTNHQLGLSGGSEQTKYAISAGYFGETGVFPGLSFQRFSFKVSVDQQLGKIFKVGISSINSVSRTNGEGINPVAQALQSSPLTVPYDAAGNLIPFPGGGSLIYNPLANLVPGAVVQNRTRYNTFTTVYGEAQFSPHLKYRFNGGVELTPETYGDFFGSTTFQNLSGPSTARNSNYDYRNFTLENLLVYENTFARNHHFTGTGLFSYQQDNKYSTTLTYNNILADDVQYYNPELGSNFKGTGGYSKFSIVSFMGRINYDFKSKYLLTLTMRSDGSSTLAPGNKYHLFPSAAVGWNITEEGFMKSINAVSSLKLRVGYGTVGNAAVSPYQTLGGLGIINYNYGTTNVTGTYPNNVPNPKLGWEYTASLNIGMDFGLFKERITGTVDVYQQKTSDLILPQNLPITTGYTSQFLANVGKTENRGLEITINSVNIKAGSRKDFAWTTNFNMTFNRNKITALQNGVTEDVGNNRFVGSPISSLYNYQRVGIWQNTPIDSAEAKRLNLTLTGAASVIGTIRVADLNGDGVINSKDRTILGTRQPDFFGGFTNRFSYRGVDLAVVGSYRVGGTQIATWLQPGSNVNALNGKANNLNVDYWTPTNRANKYPKPNFNVGSPAYGDLLGYYNASYLKIRTISLGYTFPALIASKIKLKNLRVHASLNDAIILFSPLHKQFSGADPESAGTLGVDTPPVKSLLFGLNVSF

SEQ ID NO: 863 - protein, 198 aa, Wolbachia endosymbiont of Paraulacizes irrorata
LPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSEFGFAGQVKAGVSYDVTPEVKLYAGARYFGSYGANFDGKKTDPKDSTRQVTDAGAYKVLYSTVGAEAGVAFNFYQAKAGNH

SEQ ID NO: 864 - protein, 183 aa, Wolbachia endosymbiont of Homalodisca elongata
EILPLFTRVDGITYKKDNSDYSPLKASFLAGGGAFGYKMDDIRVDVEGVYSYLNKNNVTDAKFTPVTIADSVTAISGLVNVYYDIAIEDMPITPYVGVGAGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 865 - protein, 194 aa, Wolbachia endosymbiont of Acrogonia virescens
GPISDEETSYYVRLQYNGEILPLYTKVDGITHTSGKSPLKASFLAGGGAFGYKMDDIRVDVEGLYSQLAKDATVVSDDKAADSVTAFSGLVNVYYDIAIEDMPITPYVGVGVGAAYISNPSKANEVKDQKGFGFAYQAKAGVSYDVTPEIKLFAGARYFGSYGASFDKANKDDTGIKNVLYSTVGAEAGVAFNF

SEQ ID NO: 866 - protein, 178 aa, Wolbachia endosymbiont of Acrogonia virescens
EILPLYTKVDGIKYEKESEAQNPLKASFIAGGGAFGYKMDDIRVDIEGLYSQLNKNDVTDAKFTPDTVADNVTAFSGLVNVYYDIAIEDMPITPYIGVGVGAAYLSNPSKADGVKDQRGLGFAGQVKAGVSYDVTPEIKLYAGARYFGSYGASFKKATESTNKDINVLYSTVGAEAGV

SEQ ID NO: 867 - protein, 1058 aa, Wolbachia endosymbiont of Pamplona spatulata
ILPANNIDFGARSTLEFNGPLDGGGNTIPYYFKGAIANGNNAILNVNTKSLTAYHSAIGTVAEINIGAGNLFAIDASAGDVTILNAQNINFGALDSALVLSNLTGVGAKNILLAADLVAPGADEGNVVFDGGVNGLNIGSNVAGAARNIGDGGGNKFNTLFIYNAVTITDDVNLEGIQNVRIENNADFTSSTAFNAGIIQINDATYTIDANNGNLNIPAGNIQFAHADAQLILQNSSGNDRTITLGANIDPENDNEGVVILNSVTAGKKLTIAGGKTFGGAHKLQTIVFKGAGDCSAAGTTFNTTNIELDITGKLKLGATKANVVLFNDAVQLTQTGHIGGFLDFNAKNGTVTLNNNVSVAGAVQNTGGTNNGTLIVLGASNLNRVNGIAMLKVGAGNVTIAKGGNVKIGEIQGTGTNTLTLPANFNLTGSKNKTGGQALKLNFTNGGSVKGVVGTAVNSVGDITTAGATSFASSVNAKGTATLGGTTSFANTFTNTGAVTLAKGSITSFAKNVTATSFVANSATINFGNSLAFNSNITGSGTTITLGANHVTYTGTGSFTDTLTLNTTFDGAAKSGGNILIKSGSTLDLSGVSTLALVVTATNFDMNNISPDTKYTVISAETAGDLKPTPKENVKITINNDNRFVDFTFDASTLTLFAEDIAADVIDEDFAPGGPLANIPNAANIKKSLELMEDAPNGSDARQAFNNFGLMTPLQEADATTHLIQDVVKPSDTIAAVNNQVVASNISSNITALNARMDKVQVVNKGPVPSGDEYMDAKFGAWITPFVGNAKHKMCNNISGYKSDTTGGTIGFDGFVSDDLPLGLAYTRSDTDIKLQNNKTGDKNKVESNIYSLYRLNNVPYENLFVEAIASYSDNKIRSKSRRVIATALETVGYQTANGKYKSESYTGQLMAGYTYMMPENINLTPLGGVRYSTIKDKGIKETGTTYQNLTVKGKNYNTFDGLLGGKVSSNINVNEIVLTPELYAMVDYAFKNKVSAIDARLQGMTAPLPTNSFKQSKTSFDVGVGVTAKHKMMEYGINYDTNIGSKYFAQQLATYS

SEQ ID NO: 868 - protein, 319 aa, Wolbachia endosymbiont of Pamplona spatulata
VTWRLGLTKDLSENEILFASLSTGYKAGGFGDKDDKCGGKVCIDGPPGPQYTFFSYKPETVTNFEIGYKGLLLDQRLSLSVTAFYSRYKDMQVTGDFYAAKVHVEEPCPDFDPTCDVIKKWQTVNVGTVNIPGLEVEVDYLPTPNTRIGGFFSYIDSKIKDYPSFSDEWNCGVREEFGAPPCPAPYTGPDPTLAGRQVYDITGNHLPMTPKFTAGINASHTFKFGNGYELVPWVSVKWQDTMYFTLRNLDNPHISDAQEAYTKVDASLSLKSPSFWRAELYVLNATDKMTKNWADDAGGFIRGYWNDPRTVGLRVRFDY

SEQ ID NO: 869 - protein, 171 aa, Wolbachia endosymbiont of Proconosama columbica
PLYTKVDGIKYEKESKPQNPLKASFIAGGGAFGYKMDDIRVDIEGLYSQLNKNDVTSAEFTPDTVADNVTAFSGLVNVYYDIAIEDMPITPYIGVGVGAAYLSNPSKADGVKDQRGLGFAGQVKAGVSYDVTPEIKLYAGARYFGSYGASFKKATASTNKDINVLYSTVGA

SEQ ID NO: 870 - protein, 180 aa, Wolbachia endosymbiont of Proconosama columbica
LPLYTKVDGIKYEKESKPQNPLKASFIAGGGAFGYKMDDIRVDIEGLYSQLNKNDVTSAEFTPDTVADNVTAFSGLVNVYYDIAIEDMPITPYIGVGVGAAYLSNPSKADGVKDQRGLGFAGQVKAGVSYDVTPEIKLYAGARYFGSYGASFKKATASTNKDINVLYSTVGAEAGVPFNF

SEQ ID NO: 871 - protein, 196 aa, Wolbachia endosymbiont of Proconosama columbica
GPISDEETSYYVRLQYNGEILPLYTKVDGIAHAAGQSPLKASFMAGGGAFGYKMDDIRVDVEGLYSQLAKDTAVVNDSETNVADSLTAFSGLVNVYYDIAIEDMPITPYVGVGVGAAYISNPSKASAVKDQKGFGFAYQAKAGVSYDVTPEIKLYAGARYFGSYGASFNKETVSAIKEINVLYSAVGAEAGVAFNF

SEQ ID NO: 872 - protein, 185 aa, Wolbachia endosymbiont of Graphocephala coccinea
SYYVRLQYNGEILPLYTKVDGIKNATGKEKDSPLTRSFIAGGGAFGYKMDDIRVDVEGLYSQLAKDTAVVNTSETDVADSLTAFSGLVNVYYDIAIEDMPITPYVGVGVGAAYISNPSNAADVKDQKGFGFAYQAKAGVSYDVTPEIKLFAGARYFGSYGASFDKAAKDDTGIKNVLYSTVGAEA

SEQ ID NO: 873 - protein, 145 aa, Wolbachia endosymbiont of Homalodisca coagulata
EHENFAVYPLLARIGFNINSLAGIDGSRNTLQLGVEPFVNIVAASDHGVETGLGVGLRYYHNCFVPFDLFIEASAAPIFLSIASIEQGNPGFNFLLQSGVGFQYKLSARNAFFAGYRFRHISNGGLVAASNSGINSDAIIAGLSW

SEQ ID NO: 874 - protein, 169 aa, Wolbachia endosymbiont of Aedes albopictus
FTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLKTAVNDQKSKFGFAGQVKAGVSYDVTPEVKLYAGARYFGSYGANFDEKKTNNLIGQVADAGAYK

SEQ ID NO: 875 - protein, 161 aa, Wolbachia endosymbiont of Acraea encedon
YTKVDGIKYEKESKAQDPLKASFIAGGGAFGYKMDDIRVDIEGLYSQLNKNDVTGAAFTPDTVADNVTAFSGLVNVYYDIAIEDMPITPYIGVGVGAAYLSNPSKADGVKDQRGLGFAGQVKAGVSYDVTPEIKLYAGARYFGSYGASFKKATASTNKDIN

SEQ ID NO: 876 - protein, 173 aa, Wolbachia endosymbiont of Acraea eponina
KTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDDSGFGFAYQAKAGVSYDVTPEIKLYAGARYFGSYGANFDGTKQDPAHPDDLEKKVTDKGAHK

SEQ ID NO: 877 - protein, 161 aa, Wolbachia endosymbiont of Acromis sparsa
FTKVDGITYKKGNSDYSPLKASFIAGGGAFGYKMDDIRVDVEGVYSYLNKNDVTDAKFTPDAIADSLTAISGLVNVYYDIAIEDMPITPYVGVGVGTAYISTPLATAVSSQNGKFAFAGQARAGVSYDVTPEVKLYAGARYFGSYGANFDKTDKDGKGELK

SEQ ID NO: 878 - protein, 165 aa, Wolbachia endosymbiont of Armadillidium vulgare
KTEVSGIPNPDKVDPFKASFMAGGGAFGYKMDDIRVDVEALYSQLNNNKDTVNPFADNLSVMSGLVNVYYDVAIEDMPITPYVGIGVGAAYLSNPLKSPVGDKKHGFGFAYQAKAGVSYDVTPEIKLYAGARYFGSYGASFDGQKQDPAHPGDTTKKVTDEGVYK

SEQ ID NO: 879 - protein, 159 aa, Wolbachia endosymbiont of Chelymorpha alternans
YTKVDGIKNATGKEKDSPLTRSFIAGGGAFGYKMDDIRVDVEGLYSQLAKDTAVVNTSETNVADSLTAFSGLVNVYYDIAIEDMPITPYVGVGFGAAYISNPSNAADVKNQKGLGFAYQAKAGVSYDVTPEIKLFAGARYFGSYGASFDKAAKDDTGIK

SEQ ID NO: 880 - protein, 185 aa, Wolbachia endosymbiont of Cimex lectularius
KTAGSGAANAGEAFEPQKTKQTEAGLKLNMNDFAHTFSLFEIKKPNGYQDPDTNIYSFGGEQRNRGIEWGFYGTLLEDYTLTGGIAYTDAEITKATDVTTEGKKAIKLPDLQAKLALEWNLPTMRELTLIGQANYMSEQYIDAQNTQSLSAQTIFDLGARYNSTIANQSVIWRLAVNNVTDEAYW

SEQ ID NO: 881 - protein, 191 aa, Wolbachia endosymbiont of Camponotus pennsylvanicus
  misc_feature (184)..(184): Xaa can be any naturally occurring amino acid
FSYFVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAXAGVAVYF

SEQ ID NO: 882 - protein, 149 aa, Wolbachia endosymbiont of Culex pipiens pipiens
KTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASF

SEQ ID NO: 883 - protein, 162 aa, Wolbachia endosymbiont of Drosophila bifasciata
FTKVDGITYKKDKSDYSPLKPSFIAGGGAFGYKMDDIRVDVEGVYSYLNKNDVTDAEFKPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHT

SEQ ID NO: 884 - protein, 173 aa, Wolbachia endosymbiont of Drosophila innubila
FTKVDGITYKKDKSDYSPLKPSFIAGGGAFGYKMDDIRVDVEGVYSYLNKNDVKDVIFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYK

SEQ ID NO: 885 - protein, 162 aa, Wolbachia endosymbiont of Drosophila neotestacea
FTKVDGIPYKKDSSDYSPLKASFIAGGGAFGYKMDDIRVDVEGVYSYLNKNNVTDAKFTPDNIIADSLTAISGLVNVYYDVAIEDMPITPYVGVGVGAAYISTPLATAVSSQNGKFAFAGQARAGVSYDITPEIKLYAGARYFGSYGANFDKTDQDGKGELK

SEQ ID NO: 886 - protein, 171 aa, Wolbachia endosymbiont of Drosophila recens
FTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYK

SEQ ID NO: 887 - protein, 159 aa, Wolbachia endosymbiont of Drosophila simulans
FTKIDGIKNAAGKEKDSPLKASFIAGGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFDKAAKDDAEIK

SEQ ID NO: 888 - protein, 202 aa, Wolbachia endosymbiont of Drosophila simulans
KTPSWSPNLGGETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGTL

SEQ ID NO: 889 - protein, 159 aa, Wolbachia endosymbiont of Encarsia formosa
KTKIDGVTYKSGKDNNSPLKPSFLAGGGAFGYKMDDIRVDVEGLYSQLSKDADVVDTSPAVVESLTAFSGLVNVYYDIAIEDMPITPYVGVGVGAAYVSNPLVTEITGDKKSGFGFAYQAKAGVSYDVTPEIKLYAGARYFGSYGANFGKTAKDDGGIK

SEQ ID NO: 890 - protein, 164 aa, Wolbachia endosymbiont of Ephestia kuehniella
FTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELK

SEQ ID NO: 891 - protein, 159 aa, Wolbachia endosymbiont of Ephestia kuehniella
KTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIK

SEQ ID NO: 892 - protein, 159 aa, Wolbachia endosymbiont of Gryllus firmus
YTKVDGIKNAKDKEKDSPLTRSFIAGGGAFGYKMDDIRVDVEGLYSQLAKDTAVVDTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIK

SEQ ID NO: 893 - protein, 167 aa, Wolbachia endosymbiont of Incisitermes snyderii
FTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELK

SEQ ID NO: 894 - protein, 161 aa, Wolbachia endosymbiont of Muscidifurax uniraptor
FTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELK

SEQ ID NO: 895 - protein, 169 aa, Wolbachia endosymbiont of Nasonia giraulti
FTKVDGITYKKDKSDYSPLKPSFIAGGGAFGYKMDDIRVDVEGVYSYLNKNDVKDVVFTPADTIANSLTAISGLVNVYYDIAIEDMPITPYVGVGVGAAYVSTPLKTAINNQNSKFGFAGQVKAGVSYDVTPEVKLYAGARYFGSFGAHFDSETTGADNKKVVTKDAYK

SEQ ID NO: 896 - protein, 171 aa, Wolbachia endosymbiont of Nasonia longicornis
FTKVDGITYKKDKSDYSPLKPSFIAGGGAFGYKMDDIRVDVEGVYSYLNKNDVKDVTFDPANIIADSVTAISGLVNVYYDIAIEDMPITPYIGVGVGAAYISTPLELAVNDQKSKFGFAGQVKAGVSYDVTPEVKLYAGARYFGSYGANFDGRKTDPRDATKQVIDAGAYK

SEQ ID NO: 897 - protein, 163 aa, Wolbachia endosymbiont of Nasonia vitripennis
FTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELK

SEQ ID NO: 898 - protein, 157 aa, Wolbachia endosymbiont of Nasonia vitripennis
KTKIDGVAHKSGKENNSPLKASFLAGGGAFGYKMDDIRVDVEGLYSQLSKDEDVVSNDNAADSVTAFSGLVNVYYDIAIEDMPITPYVGVGVGAAYISNPSKADAVKDQKGFGFAYQAKAGVSYDVTPEIKLFAGARYFGSYGASFDKAAKGDTGIK

SEQ ID NO: 899 - protein, 159 aa, Wolbachia endosymbiont of Ostrinia scapulalis
YTKVDGITNATGKEKDSPLTRSFIAGGGAFGYKMDDIRVDVEGLYSQLAKDTDVVNTSEINVADSLTAISGLVNVYYDIAIEDMPITPYVGVGVGAAYISNPSKANEVKDQKGFGFAYQAKAGVSYDVTPEIKLFAGARYFGSYGASFDKATKDDTGIK

SEQ ID NO: 900 - protein, 154 aa, Wolbachia endosymbiont of Protocalliphora sialia
YTKIDGITYASGKSPLKASFLAGGGAFGYKMDDIRVDVEGLYSQLAKDAAVVSDGEAADSVTAFSGLVNVYYDIAIEDMPITPYVGVGVGAAYISNPSKVHAVKEQKGFGFAYQAKAGVSYDVTPEIKLFAGARYFGSYGASFDKAAKDDTGIK

SEQ ID NO: 901 - protein, 163 aa, Wolbachia endosymbiont of Solenopsis invicta
FTKIDGIDYKKGTDIYSPLKASFIAGGGAFGYKMDDIRVDVEGVYSYLNKNDVKDVVFTPADTIANSLTAISGLVNVYYDIAIEDMPITPYIGGGVGAAYISTPLKTAVNGQNSKFGFAGQVKAGVSYDVTPEVKLYAGARYFGSYGANFDKSGGEKDKGGHT

SEQ ID NO: 902 - protein, 159 aa, Wolbachia endosymbiont of Tribolium confusum
YTKVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGASFDKTNKDNNDIK

SEQ ID NO: 903 - protein, 174 aa, Wolbachia endosymbiont of Teleogryllus taiwanemma
YTAERITHDYPKPTGANNTSTVSDYFRNIRAHSIHPRVSVGYDFGGWRIAADYASYRKWNNNKYSVNTKVLKENLGNRIELKTENQGNGSFHAASSLGLSAIYDFKLNDKFDKFKPYIGARIAYGHVKHQVHSVETETKIIFTTPTKGAKVGGTIPNKSMSKPPYHESNSISSL

SEQ ID NO: 904 - protein, 171 aa, Wolbachia pipientis wMel
FTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYK

SEQ ID NO: 905 - protein, 1028 aa, Pasteurella haemolytica
MKFNIIRILLITCLLSSQVGIWAQTKSITGTVCDTNGEMIIGANVTVKGTTKGTITNVYGIYTVSATPKDIIEISFIGYKSVQKKVGNRGIINVVLEEDSKMLDDVVVVGYGTTKRANLAGAVATADQKAFQSKPSATPINALQGLIPGLVVNRSNGQGSRPGDEATFSVRDVSSVNGGSPLVLIDGAEGNINFLNPNDIESVSVLKDAQASIYGNRAANGVVLVTTKSAAKGKVKVDFNAYYAFKTPGRVKEKVNLLQFAEMDREACSDGSDNPVYSEDELDLIRENNDKVVMGGYLGFAKHYQYHDWTKSLLGKSSGLQNYSLNVSGGTDRYNFYVSGFYQSEDSPLKFGHDDSKRYSLRVKNEVKVLENLLFHSNISYTAHDHDFSSAIGTALAWGYRQPPWAPLYTPSGKFYSWQGYGNPAQELEEGGNTLYANAITTFNFALDWNILPELKISGQAILRRQVNDDTTNGGKYAQWNWDDSLNRYNTTENWASRAFSKQWYRNYNVYAEYHKLFAEKHDLKVMAGAQHEEFSYDTFSATRKNFTSDNFNLALGSSKDQETGAATWAETLRSVYGRLSYVYNDRYIVEINGRYDGTSRFAPGHRWGLFTGYSAAWRLSEEDFIKDLNIFDQLKIRGSWGQMGNCQGGIGRYDYIPIINISSDWPYPFNKEEKSQQASSNMVSLARTWEKLEVTNIGLDIAILNNRLSASVDWFYKKNKNMLIAVDYPSLLGATAPASNNGSLEVKGWEVSLAWRDKVNDFSYSVRGNISDSRNKVTNLGGFSGLRSGLISNIQGYSTNAYFGYQSGGIIRDEATLREYKKMKGVPDNLRVGDMMYLDLDGDGAITATGDPKRGYQGDLVYLGTSNPRYNFGLNIDMEWKGFDLSIFFQGVAKRKVVQDGEPLIPFYPDWHYPLSEFYHNTWSADRPNAKYPILTHDDDRNLWNYRTSDNLLVNAAYVRLKNLQFGYTIPRFLTQKIKVDRLRVYFSGNDLFEIDNIPFKYDPEDNGNYSGYPFMRYFSFGVNLNF

SEQ ID NO: 906 - protein, 553 aa, Pasteurella haemolytica
MVFSIAMRRALLAGVATACMSAPAMAQAQDSSGRIQELERQIRAVQMQQARQIQQLQAELRHMRTQVAIHAQKVEVAHQRAIAAATQAHAEAQKAHQEALVVHHDAEHITDAFSRLPPPPQGSPIGGPAFTQVEKGAPGVRVGFERGRPTLSAIDGRYAFAVGLALHYDMGGYIMPDPAPGTRPAVTRLTSFGTNLRRGRIPFMFRYGNVTANITPEFGSSVDGAAGLYEANLNYSGIQPFVFTLGYFQPRVTLEDSTSSNEFLFLERPSIVDIARNIAAGDARATAGGKANGKRWYAALYGTGSSYGSQMTETLSGNQTGGVVRVATRPIAAKDVDMHVGFSASKAFNLDDVNGNTTLRLRDRPEVRIANIRLIDTGSLSATSAYEYGPEFGFRYKNLLIQGEWIAIGVDQKPSGTLPRPSLGFGGGYASISYVLTGEVRQYDPSAAAFRGPSPVHNFDPSHGHWGAFELVARYSIADLNSNVTPGIAASVTGGTYGGRQAVFAAGVNWYLNRHFRFMLDYNYIDVDRMNSAGKVQIGQTLHSIVGRAQAAF

SEQ ID NO: 907 - protein, 355 aa, Plesiomonas shigelloides
MKKTILAIATPSLFASAANAAVVYDKDGTTFDVYGRVQANYYGDHNTADSTAASGYKDVDGELVGSSRLGWSGKIALNNTWSGIAKTEWQVSAENSANKFDSRHIYVGFDGTKYGKIIFGQTDTAFYDVLEPTDIFNEWGDAGNFYDGRQEGQVIYSNTYGGFKGKLSYQTNDDKAVKVTDVGQGIKETAVYGADVKRNYGYAAAAGYDFDFGLGLNAGYSYSDLENTKTNNTGDKKEWALGAHYAINGFYFAGVYTQGDLSYDNTTGGDKDKGRGYELAASYNVDAWTFLAGYNFKEAKVKSNTAGAEYKDLLDETLLGVQYAFTSKLKAYTEYKIQGIDKLDDEWTVALQYNF

SEQ ID NO: 908 - protein, 365 aa, Burkholderia cenocepacia
MKRKSLAMAVAGIGIGAAVPPALAQSSVTLYGIVDSGITYTNNQKGHSAWKATSGNEQAARWGLVGREDLGGGTSAIFRLENGFDIENGTASQGGRLFGRRTYIGLANDRWGAFTMGRQYNAVQETLAPLHIATVLGRYAHHPFDADDLDSTFRTNNSVQYQTPDWGGVRAIATYGFSNSTSFARNRTWSVGASYARGPLQLAAAYVRVDYPAIDATGAIASDNYYGFVKGVARQQIWGAGGAYAWGGATFGLLYTSALFSLQTGGAERFNNFEGSVRYRVTPAVQVALGETYTQVLASHAAAHDAHYLQTSAGIQYFLSKRTDVYLNVSYQRASSNAVAWIKGLDGASSTRTQIVAVTGIRHKF

SEQ ID NO: 909 - protein, 148 aa, Burkholderia cenocepacia
MKPRNINNSLPLQPLVPDQENKNKKNEEKSVNPVKITMGSGLNYIEQESLGGKYLTHDLSIKIADISEEIIQQAILSAMSIYKFSITDDLMSMAVNELIKLTKIENNVDLNKFTTICTDVLSPRVTRHNKEKNKRHSTLLKNPLFNFH

SEQ ID NO: 910 - protein, 387 aa, Burkholderia cenocepacia
MKRSLVALAALAITGSASAQSSITMFGVVDAGISYYANENTAGVTASQKAVSNSGYNASRFGFRGTEDLGGGLAASFWLEAPITNDDGQGILMFSRRSTVSISGGFGEIRAGRDYTPTFRNDVVFDPFFTAGVGANMLYLANHGFGKWLAGTPATGSTYVRSGNSVGYFLPPNLGGFYGQVMYSFNEREKFDPGTATPATLHTQRTGRYLGGRAGYANGPLDVAASYSSAIIGDDFYAGTTTAVKTWNLGASYDFGVAKLMGEYSSAKKSVDSARPWVSAPDNGLKGYLMGVTVPIGPGLIRASYSQVKYDQNQPSGSNAAKNPQAGKFALGYVHNLSKRTALYAAVARLSNKHGAALSVAGPAFAQGQEALPKTSTGYDFGIRHAF

SEQ ID NO: 911 - protein, 707 aa, Burkholderia cenocepacia
MTVSLACPPVRPRRVAAALACLAASLAHADDSSGDAAVLPALNITAAHDSPQHLTDTLSAGALGTRRQLDTPFSTTIVTSEELEARQPYKLGDVFANDASVSDNSGAYSAWASYMTVRGMQLDWQNGYKIDGLPFVTYGITMPYEQLERVELLKGLGGFLYGFVTPGGVVNYVTKQPGAEPVRSVDVSYRSTNVWTEHVDLGQRFGPNNMFGARLNATHEEGKTYNDGNIRRNSVSLALQANLTRDLSVSFGALYQDRRTTGQTPSIFTGSYPGGALPATISGGSTNLGGKDQYLNTNLQLYTAGLQYQLAPDWQLDVAYSYSKATRRRNESTLYLQDAAGNYTDSRYVGMEDHRFSQWRAMVEGKVRTGPFSHQIVLGASWQKQANDYSANSVFVPLGAGNLYAPNPYRYESPHGFIQYRTSEIVQKSLFASDTVQLTERWSVLAGVRYMNYEQRAFQASGAEDPGYRQNGVVTPTFAVMFKLAPTTTAYVSYAESLEPGSRVNDVYANAGQVLKPLRSKEYELGIKSEHARWSATAALFRIERSAEYANAANVYVQDGESIIQGIEVGARAKFGAHWNAGVDAMLLDAWYANGIGNNGNRVAGAPRFVLAGDLGYAVPGVPGLTLGVDAKFTGATPLRAAGGLDAPGFLVVNAGARYLTRVGRHDVTLRASIDNVLNRRYWEYQYADYVKPGDPRTVSLSAKIDF

SEQ ID NO: 912 - protein, 277 aa, Burkholderia cenocepacia
MKKTLLCAAAGAAALAPLAAHAQSAGSNVVTLGWFHVMPQQSSTPMTTNVAPTPINTPLRLPPSFTSPGTGLRTSGADTVGLTVSHFLTDHIAVTSVAGVPPVFKVSGQGTIRPPGPAGALGTQNIGLGSVNPIVKSVRQWSPALILQYYFAQANAKFRPFLGLGVSYNWFSDLQLNTNFIKQTQDNLGAILAAGAGKPGTTSVEAKASSSWQPVFNAGLQYNITEHFGLVASVTYIPLKTTSTVTIKAADGTVLSESKSDLKADPIISYVGMTYKF

SEQ ID NO: 913 - protein, 243 aa, Burkholderia cenocepacia
MKRKLAITGAAALAFTFAGGTAHAQSAGDFYVSTGWLHLAPQDSSDPLFVYGVGGTPVNQSIPNTGAGISDADTLALATGYFVTDHIATEFIAGIPPKFDITGKGQFSKFGTLGRAYQWSPALLLKYYFNDANAKFRPYVGVGATYIWFTGAKITNSTFENGVLGGPTSATTSNQWAPVFNAGFTYNFTKHWFAGFSMSYIPVSVTATFTTARRTPVGTLTETSKAHISLNPIVTYLNVGYRF

SEQ ID NO: 914 - protein, 389 aa, Burkholderia cenocepacia
MKKSLLALVALGAFAGAAHAQSSVTLYGIIDEGFIFNNNANGKHLYGLSSGVMQGSRFGLRGTEDLGGGLKAIFTLENGFDVNSGKLGQGGLMFGRQAYVGLSSPYGTVTLGRQYDSVVDFVGPLEAGDQWGGYIAAHPGDLDNFNNAYRVNNAIKYTSPSYAGFSFGGLYSLGGIAGQFARNQVWSLGAGYNNGPLVLGVGYLNARTPSNFGGMFNNGSSDPTTSGKLPVTTPVYGAYANSANTYQVIGAGGAYTFGAATIGATYSNTKFKGFSVGPFVNQTATFNNGEINFKYQLTPALILGAAYDYTQGSKINGSSAAKYHQGSLGVDYFMSKRTDVYVIGVYQHASGNTLDSNGNVVQAHASINGLDPSSTSNQVAARVGIRHKF

SEQ ID NO: 915 - protein, 1760 aa, Burkholderia cenocepacia
MNHSFRSIWSEAAGCWVAVAETTRARGKRSGSASGASRRTAHEATRHATRRSPLRVAALGAALAALSVGTVHASTCGNGAAIASGGTCVLDSFNPTVNNDLVGATTVSGGDRVGLTGAWTGATGDMGYTPMPLANTSIISGNSNQPLVTLGGKTQSVGTPDSITGGRTSVATYDSSAFVSSNAGSTVVQVYHDVNGDQYVNTRIGTVASSGGTLDVSIGNAANAPAATGNVMTIAAKQSDLTYADGTGSVPSVINWNSRNQIWFITGDYLASGGPVGSIQLDVPTYAGTFTAFDGSTWTVTDAASLAAYNDFLVRSVRNGALGSQTAYDNAFGQAVTLSPQTFEYANNVSPGDKNALPRNYPSAMHGTGANATLHIGEDGQIDFRGSNTIDASAAVVAENGAHFVNDGRLSGDFTLVRLLSGASGVNNGTISSGYTAGDNVDTGTARPDNFGLGTYVEGSGVYANGAGTTFVNNGVMNVGAWDLTRNRLDLQNYAVAATDGAHASNAGTINVGVNATTLDSQVIGGLVAGGSFTNEAGGTIYLGRAAQYDVAAPEATNDVALAAHAYGILLGASGTASNLGTIVIGTQTQNGAALASIGSTSGTLTNAGAIVVNGAAAGTPLANVGMLAANTAATVTNTGTITLNGVNGIGIMVVGTGTNATAATSTGTINVAGGLDPASGTRNYGVWAEGPLAKATLDGALNLTGAGAIGVHARSGATIDVGANAVPAFMSGTNQIGFYAYGAGSKINVAAQHLSVDTDDSTLFRVAGGAAYTGASTAGVLTTDVNGQRSRGVLATDAGTTLSTGNAVYDVNGANGIAIAVEGGAKGTIDAGATINLNAAGATAGVVDGQAHDLAGANAGAPVATTLTNHAAVTSSTAGVTGFIAQNLGTLENRSTVLLTGAGSTGVVAGTLGTVNNASTIRVTNGTGALVQGASATLANAGSIEADDGVAGVRLTGAGASVALSGAGTVIANGNADGVLIDSTVTGGGIAAGATSIAVGGSGSGVRNLGANATIALSGTQVATTGNGADGLTSTGAGARIATDAATVVRTAGADARGVSVSGADSTLTANGTTIATTGANAHAIIMDGGATALLSGAKVTASGNAADGIVAQNGGRIADTGSSLASAAGSGATANSGGVLALTGTALTGATAGVLTSDTLANGATSSVLIDGGSVTSATGPAFAARGGTADIAVRNGTVVTAGNGTLLNLANGSNVTFSASAVNLAGDIVSDASSTGNVFLANGTTLTGKIDPVALTVDGTSTWRMTGSSVLSSLTNAGLVAFAAPTGSPTLTGSYKTLTTGGYVGNGGTIALNTYLGADASPTDRLIVNGGAATGTTGLKIANTAGAGAQTTGDGIAVVVTANGGTTTASAFHLAGPVQAGAYEYRLYRGGQGDANGWYLRSQLDPTDPVDPIHPSGGGDGGSNGNGNGNGGALAYRPGVSGYAMTPLLNADYGFSTLGRLHERVGDLYNVEKQQPGNRDGVWGRIGGQSLDANAGRFSADERTFFAQFGKDWTLDQAPGGAGSTHAGVTASIGVSNASFSDMARAGSPNLSTSTGSVEMHAQSVGGYWTRYLSDGTYFDSVGQVTHYGNRYRDSYGNEASQNGFGVALSQEVGKPFAIGTFPVAIEPQAQLMYQYLKLNGFNDNVSAVSGTTTNALRGRVGVRIFRPNLQSDAGGGAATPYFTADVLHDFLSPGQTVVGGTPFATHLGRTWYELGVGVTAGFGKSGELYANAKIARNIGGDYRRGIVGQVGYRYSW

SEQ ID NO: 916 - protein, 381 aa, Burkholderia cenocepacia
MKKTLIVAALSGVFVTAAHAQSSVTLYGLIDAGITYTNNQGGHSAWQETSGSVNGSRWGLRGTEDLGGGLKAIFTLENGFGINNGALKQNGREFGRQAFVGLAHDSYGSLTLGRQYDSVVDYLGPLSLTGTQYGGTQFAHPFDNDNLNNSFRINNSVKYQSANYGGLKFGALYGFSNSTAFANNRAYSGGVSYSYLGFNFAAAYLQLNSDVNALAQAASDPGAVTGDWTFASRVQRTWGAGLNYGFGPATVGFVFTQTRLTGIRAISASQSGVSGGITGLGGTARFSNYELNGRYALTPALSLAGSYTYTQGRLAGDKPTWHQFNLQADYALSKRTDVYLQGEFQKVNNDGLDLGANINGLGAASSTNKQIAVTAGMRHRF

SEQ ID NO: 917 - protein, 784 aa, Burkholderia cenocepacia
MSFTFAARPSRGRLALACAAAFAWPAAQAAAIDRASAEPVPGGAGNPAGRAAPVAAVVPAPPGDTLTEVSVTARRQPVDPDTPAVVESITREQIDAHTNVTTEDALKYAPNLMVRKRYIGDRNSVFAGRDFNELQSARGLVYADGLLLSNLLGSSYAYPPRWSLIAPDDVERVDVLYGPFSALYPGNAIGSTVLLTTRRPDKLEASLSTQFFTQRYHDGYGLADSFGGNHQTARIANRIGKFWFSLSLDRLENDGQPMQYASPNSAYNPKLGAAVPVTGAATDIGPNGKPRTIVGAQNIERTEQLNETVRMGYAFTDHVDATLTLGHWENHYRQHGETFLRDAAGNPVYGGNVSIGGRNMTVAPSAFAPQRGDQENWLYALGLNGRLDSGWRLSGVVSAYDVSRDVLRAASTAQGGAGTLFQGDGTGWRTLDLKAEAPEVKGHTFTFGYHYDNYFLRNVTYNTADWLAGPTTSLASVYQGDTRTQALFAQDAWRFAPGWLATLGLRYERWDAYGGALGNAGGTVGYADRGANALSPKVALQWDATDVWRFRVSFATGTRFPTVGELFQGTISNNAIVNNNPGLRPEKAIDWDFTAERDVGVGVVRASVFQSDLRDSIYSQTTVSGASTVTNISNVDRVRVRGVELGFSGRNVGLRGLDIDANVSASNAQILADTANPAYVGSRFPRIPRMRANLLASYRFDEHWLASVGVRYSGRQFNTLDNSDVNPDVYGGTSSFTVVDLKARYRFDRHWTASVGIDNLTDRRYYVFHPYPGRTFFGELKWSL

SEQ ID NO: 918 - protein, 781 aa, Burkholderia cenocepacia
MTKHADIHRKCRLSALIDESSHTKGGKNKNQVSNSIKHTLSNTLRTVMFRESVKKRIPVFQLSMLAVTSLVAASIAEAKAAEANTAKANMFKEDRSESQVTTTDISDVIVVTGTRQAENLLTLTGNLARINRQDIQTVSSVYPSDLLNRASGVYVQANNGMESLPSLRSPVLTGPGAGGAFLILEDGIATRAAGFANNNGLSELNLAQAQEVDIVRGPASAIYGSNAVHGVVNVINQAVRDGGDVSLLLGPNEHYQVQGTLGNDFGAHGLSINTQLIDNGGYQDDSDFTSAKVGLRHEYRDDLNAITTSVAGFVLDQNTAGFIASGDNGEGCFESTYADDRLFKDTQAMEKNCEDDAYRKWSSMRVASKWQRTLSDDRYFVLTPYVRTNDMEFRQHYLPSEAIEENSHSSFGLTSSYHWQFDPRLALVMGADAEWTSGELTETQQKASTFSFGKARQQGVHYDYEVDVLTLAPYVQADWQYSHALRMSASVRFDSTHYDYKNRLADGTTQADGSPCVNGNNEPVACLYQRPADSKDDFDNVSSKIGFNYLMNESVALFADWSQGFRAPQTTDLYRIQNQQVAGQIESEEIRSQEVGVRGLALDMNFELVAFYMTKDHFFFRDDDGLNVTDAETSHKGVEVGLDYPILSNVSIAVNYTYAIHQYESEHANSGVLKGNDIDTAPRQLGNVRLAWQPTEDSSLELEWAHVGSYYLDPSNEHEYQGHNLLQLRGQFSLTDKVRLLARLENVLDERYASRADYAFGSYRYFGGQPRAIHLGIEARF

SEQ ID NO: 919 - protein, 711 aa, Burkholderia cenocepacia
MATSRPFTLTHVALATLASTATAQAADDTATSLPTVSISAPRESNRAELTGFGDIPLTRSPLQARVIGEEQLKDTGAQNLRALTSQDASVSDAYNSVGYWDSLTVRGYVLDQRYNYRRDGLPINAETAIALDNKARIELLKGTSGIQAGTSAPGGLANLVVKRPDADVRSATLAWRGANSVLGAVDLATRFGNDRAFGVRVNVAAEHLDPELRAAKGKRHLFALAGDWRPTPDTLIEAEVETSRRSQPSQPAFSLLGDRVPSANRIDPRINLNNQPWSQPVVLEGQTASLRLTQRLNADWSAKAHYGTQRLHTDDRLAFPYGCDAEGNYDRYCSDGSFDLYDFRSENERRVTNALDLSLQGRFATAGLAHQLTAGVLFSRFKARFEQQIYTYAGVGSIDGSAVTPPGPAILSDNTDRTERNTELYLRDVIQLTPALSTWLGLRHTRLHRNAVTTSNTEATGYGQHVTTPWIAFNYEWRPGLMSYVSWGQGIESQVVPNRPLSYSNPGQALPALKSRQLEVGVKGRTDALDWNLTAFDIDRPVYARDDSVVPGPLRSDGSARHRGLEAGIEARTGAWTWVASAMLLHAERTDSADPAVDGQRPPNVPERVFKLQTQYAVAGLAGLSLQGGIVAESDRTLLPDDGATRIPGWARVDLGARYAQKIDTRTLVWRIGVDNVLDRRAWQESPYQFEHAYLYPMAPRTWRVSLSADL

SEQ ID NO: 920 - protein, 386 aa, Burkholderia cenocepacia
MKRTTLSLISLASFAAIPVAHAQSSVTLYGVIDTSITYVNHEQGKDNAWMLGNSSAGNLAGSRWGVKGTEDLGGGLKALFQLENGFDPSNGRQGQGGRLFGRQAFVGLTSDRYGTLTFGRQYDPLVDLVQGITADNYLGSVFATPGDVDNYDNSFRVDNAVKYTSAVYSGLQFAAMYSFGGIAGSTGAAQSYSAAVSYNNGPFSVAGGYFHATNSPASNGVRNGWTSSSDGTFDGPINSGYASAHSFGIARIAGQYVAGPFTFGLGYSNAQYRRDASSVFGSNEHYNTGQGFVNYQATNALLVGVGYSYMRSGGDTSATYHQVSAGADYSLSKRTDVYLSAAYQHASGQTGDGNGGSMAAQASIGSYGYAGTSSQTMVNLGLRHRF

SEQ ID NO: 921 - protein, 863 aa, Burkholderia cenocepacia
MGNESRTGPSFTDFSIMVSIRLMPRRRPASARHTRRTIVPAAPNRVAHRLAGAVLLSALLPLPALADADTDAAAAAPRTSRRAFDVPAGPLEATLNRFGRDAGLLIAFPPELTAGLSSGGVHGRFDVDDALARVLAGTGLVALRQSGGGYTLMRANGANGANGMSGAAVPAPSADTAAELPTIAVRSSALRAQSYRPPKEAGVLRADIPVLDTAQAVNVVPAQVLRDQRPRNLDDALGNVSGITQGNTLAGTQDTIMKRGFGDNRDGSVMHNGMPIVQGRSFNAAVDSVEVLKGPTSLLYGLMDPGGVVNVVSKQPQLTRYNAVSLGASTFGHGKNGGSATFDSTGPIGDSRLAYRLIVDQSNEQYWRNFGEYRQTFVAPSLAWYGRDTQVVVSYEYRKFHSPFDRGTALDPRTNAPLDIPARRRIDEPFNNMDGESHLAQLSVDHQFNADWSAHFGYSYNRETYDANQLRTTGVDPVTGTLSRSNDATHGSLSTDSYGIGYVNGKLTLAGMRHDVQVGFDTEYRRIYRKDMLRQAVKTPFSYVDPVYGLLPPSSTVSASDSDQTDALHDASAFLQDTIHLTDKWIVSGGVRYITYNQVAGRGRPFHANTDLSGSRWLPRAGIVYKWTDSFSLYGSYSQSLKPSSSIAPMASGYVIDAATPPEQATAWEVGGKLDLPGGITGTLALFDIDKKNVLVSQFNDATKLTDWRTSGKARSRGVELDVSGRIGERVNVIASYAYIDAKTIEDPLYAGNRLWNVARHTASLAAVYDVGTLAGGDDLRIGAAARYVGARPGDSANSFTLPSYVLADAFATYDTRLGKQKLSFQLNVKNLFNRTYYPSSANRYFVAIGDARQVSLLTTLQF

SEQ ID NO: 922 - protein, 227 aa, Burkholderia cenocepacia
MKKVCSLLAVAVLLMGGSASSFAGTPYASGNIGVTWLSDSQATLGDYSERDEYQLEVDFDSGIALTGALGYDFGSTRLEAELGYQSNDAAEIRWYEDGFDDSYDAYELSGDVSLTTLMLNGYYDIKPSDASDLEIFLTAGIGAAFYTLDFGEVDDDEYRGTYHGSTLAYQIGAGLAYAVSSELTVEARYRYFSTAEFSTDDDFDTFDDGYNLDLSSNAMLIGLRYNL

SEQ ID NO: 923 - protein, 446 aa, Burkholderia cenocepacia
MSTASTLSRATLLAVGIAGVLAVGQAHGAAFQLKENSAKGLGRAFAGSGSAPDDASIIATNPAGMRQLDGRLFQADVSAISFSAKFQPDTAAYANGAPVSGGNGGDAGMIAPVPAMYFHVPFGENDNMHLGTSLTVPFGFKTEYDRDWVGRYHGTKTELQAIDFNVAFSYDVNPYVSFGASVFAERLDIDLANAVDFGSVLAARRVPGFAPGSADGYSRIKGDSTEVGFTLGGLFSIDENTHIGFSYRSQVEHKITDGTADFTVPGSAAAVLSVAAPGTFVDTKGRATVKLPASATASFTHNVNEQWSIMADVTRTAWSKFDQVTVDFASNQPDSVLDFSYRDTTFASIGADYRLSDTVTLRGGLAYDQTPTTAEHRDVRVPDASRKWVSLGMSWRPSAQTEYNFGYTHLFTSDPTSDTRSATGDRLAGSYDVKGDVLAASINYKF

SEQ ID NO: 924 - protein, 906 aa, Burkholderia cenocepacia
MKPTALGSAIRSIVWAEVALTAALGTSAYAQTTPVDGNVATEQTGSAAAAAPAPASGASAGGQTVKKLDKFEVTGSLIRTSDKVGHTEVQVITAKEIQQSGYTTVADFLRSTSANSASSWGQTTMNSSAPGGAGMALRGLSEKYTLVLVDGQRVANYAQSVNFTDTFFDVNAIPLNMVERVEIVKTGAVSVYGSDAIAGVVNIITKKNFQGLQIDGQLGKAQHPGDGQGNFSVLAGFGDLNSDRFNVTAAASYYRDSGSTLGDRDMTSAQDFTQYPGGLAAPLGPNQQSYWSLADGSRVPLSPCPPGSKTSATNCTYNPAASTSLVPSTTRLNAKVRATFKIDDNTQAYAGFWVSRDETVQLQGPASISSTTNVYNPSTGSVSPLPRTVPVSNPYNPFGVPTAINLTFPGNVVGADTVSTFWMANTGVKGSFDTGRFGAWDWSADYGHSQSTVDTTYRNRINVAGLENMLANGTYNFSNPAATPNGLNGVFTDDDQQAISKVDSVTAKASTSNLFTLPGGPVGLGLGTEFRHESSTINPQTLASQGVSAPANVQTVEGSRNVAAAFYQVDIPILRNLTFTQAGRYDHYSDFGGAFSPSFALRFQPVQMLTTYASYSRGFRAPTLVENSQAVYLSHQNLVDPNDPSGVPTKHFTTEQVAGNPNLQPEHTKNYNIGFQLSPDAMTDIGAAFYKVRIDGVIGTDDPNAVLVANDPSRVVRNADGSVRYLVQHFVNLGALDTDGFDLNFRKALRTKYGTFTLAGDWTYVWHFKLHSPGTAPQDFAGNNLALLQPFGASNPRWKGNTSVSWDYRQLTTTLTWQYTGPYTNAVAAEFGDGGTGSVASYSQFNLMFNYRGFKHWTIYGGITNLFDKKPPFDVEWQAVPDITGYDQSLYTNLGRFFQVGATYRF

SEQ ID NO: 925 - protein, 941 aa, Burkholderia cenocepacia
MKQRVLALAIKRMVWAELALTAALVPPAFAQSQPAPGAASIADAVANGAPMTVAQADGAAGAVAATGASASGAAAEATPAAPGANGQGKVAQIKRFEVTGSLIRQADKVGFNQVQTVTSKDIENSGQTSVADYLRSTSANSASSWSEGSTNSFAPGGAGIALRGLSEKYTLVLIDGMRVSPYAFAVNGSDQFFDLNTLPLNIIDRIEIVKTGAVSQYGSDAIAGVVNIITKKNFQGLELGGSYGGATNGEGGQGTTKFSILGGFGDLNADRFNVTAALSYYKSNGISIADRDTTQNQNFSNFPGGLSNQSVSYWRNPATGAKVPLSPCPNGGQAVPGTSVAQVNGPGTVCANNTAYASSLSPWTERLSAKVHADFKINDAMQAFADLWESNNTTVTNNFVGRLGNSTQTYDPATGGLTPISNLVPGSNPYNPFGVPAKLVYAFPATQAVHTSSNFWRAATGVKGSFSTPRVGDWDWTASYTHSQNTVSNNYSNLINAAALENIVQNGVFNFADPSSTPNGLNGLYGSTSTQAITKLDAVDATLSTPNLFTLPTGNVGLGLGTQFTHQSQYIGTGADYANGTLIQPSLQSVNGERNVAAVYYQIDIPILKNLTFSQSGRYDHYSDFGGAFSPRFALRFQPIRELTMYGSYNRGFRAPTLIENTSSRTYGAQGAVDSNDPNNPNAYNLVEEVQTGNSKLQPERTKNYNIGFQLSPTRNTDFGFDWYKIHIDNVIGTEDIQTVIDQNDPSKVIRNPNGTIAYVLLPYMNLSSLDTDGFETTFRQSVSTKIGTFTLSGDWAYVWHFKMPVGGESTDFAGNNGSLNEPFGGSFPRWKGNTSLNWNYHNQWNATLTWMFTGPYSQAILSPGQYPNMQDSVASYSQFNLMVSYTGFKHWTIYAGIDNIFNRAPPFDPVYMNASYQTGYDTSLYTYVGRFAQVGATYKF

SEQ ID NO: 926 - protein, 212 aa, Burkholderia cenocepacia
MHKTIRTCVTAAAVAAAIAMPSLSHAASPGDGINQGDVLVRLRAISIQPNERASDTLGAINTGVNNAIVPELDFTYMIRDYLGVELILGTSRHQLTSSLGNLGGVGVLPPTLLLQYHFNHAGKVRPYVGAGLNYTYFYNNGLNVGGEGVSINKSSFGPALQFGVDVQLTKKVFMNVDVKKIWMSTDATLGDKGIGTLHIDPLIVGVGVGMKF

SEQ ID NO: 927 - protein, 685 aa, Burkholderia cenocepacia
MTTNVFRFSALALSIVSVLSSASALADDVAADAITSIEKITVMGEKTERSLKDTTSSVSVISAEQLANGQYLSVSNAIAQVSNVVVLSGSVPDIRGVSGNGAATGFNSFTGGAKARVSTIVDGVIEPFVADLTGDTGLWDIAQIEVFRGPQSTSNGRNSIAGSLFIKTNDPSFDWDGAARLGYRNQTNFVDSAIMLTGPILNDQLAFRITAQNVDGDTYNKGLNHEANPATYDLNELKTQRFRSKFLWQPNQNDDLQIMYSYAFNKETGDTGRKYFEGQDPWAYIPVFQRDMTTESGTHSVKVDYQLDNSSSVDLIVAIMDYDWGFDSYEPLPEHQSSVRMDDDSTMIDAKYSFGLDTPHLKGFIGFAHYQRSQDFGSKGANVYSGDDRSDSDAIYGEVSVDVGVQYRVIAGGRVEKEKQRRNFAMQSRTGVVGDKLNTDKTIVLPKLVLQYLYSDNTTISASARRGYNSAGGALSRDNEYYYYDEESVNTYELTLRSSLNNGNVNISANAFYNNYDGYQSSNKQRRITNIDKVITQGVELEIYTMLGSDLQLKGGLGLLTSDIKAADVTFGDIIGNELNSAPSITANIGATYWLNDEFSLALSSNYVDDYYADFENTKERIAGDYMLTRINVDYENEHWRVSAYINNVFDKKALTVNEPPGWYPQGYASVVDPRTLGMSITYYF

SEQ ID NO: 928 - protein, 820 aa, Burkholderia cenocepacia
MILVRTSQPARPAFAPTLLANVLSGMLCSAALAWVAPDARAQEATGREYRYAIAAGPLDQALRQFAHASGVNLSFEAAQVSGQHSAGLQGSWSLDRGLQTLLAGTGFEGIRLPSGGYAVRRLAGTALLEPVKVTGQGYRLSTEGSGSYTLPAVSIGKGEQSLREIPQSVSVVTRQRLDEQNLASVYDALENTTGVTLQQSPQGGKYIYSRGFDNSVIQYDGVPLERNMYGRASNYSGGTAFYDRVEVLRGAAGLLQGSGSPGGAVNLVRKRPLTEDRLMVETKAGSWDRYGLQLDASRVLNEDGSLRSRALIDRQDNHSFVDRVNLKNTTLYATLEYDISPRTQVNLGYSHEDLRGRPAISGLPRYSTGEAVDFKRPTSFAADWNRQKTSNQGYYADLTHAFNDDWRFKLTGAYVREKQYLKYTASSRAVNPLTQMATVSVARTVADIDTSGVDAHLTGRFRAFGRTHDVVVGSNYGHSKIDTSYSYLVNYASFNAFHFDPDLPEPSTAALRAGTDEVRIGSNRELGFYGATRLQLADPLKLVLGGRFSRSNRIWTTDTTTAGRLSNGQTKQANTHLTPYAGLILELSPQWTSYVSYTDIFQAQSEVNASGQALKPIVGESYELGIKGELLDGRVNTAFALFRIDQSHRAQVDFNSSPTCAADYYCYTDAGKVRSQGFDAEISGELTRGWNLYAGYTFNTTKYLKDQNSQGQAFAWYTPKHIFRLWTTYQLPGDWSAFTIGGGVNVQSGQSRQIGATTVQASGRAIWNAYSKYQINPNWAATVNLNNLLNKRYYSAVGNLVNGIHYGDPRNVMLTLRGTF

SEQ ID NO: 929 - protein, 361 aa, Burkholderia cenocepacia
MMKKALVAAALMAAGVVTAHAQSSVTLYGRLDAGIEYLNGLQNGHQVRAESGDWGTSLWGLKGSEDIGGGNKVLFHLEGAFNTMNGGLGTSGSIWDRFATVGISNDRYGTLLLGRELAIANGVWDFDPFGQSAWSTASLVRGRNWNKTSNNVSYQSPSLYGLDFYGQFSFSNSTSFNGNTTAGQPGRAMGGQVTYTNSLFQLRGIYDETRDSNGRFSDVFNYSREYFAGVNVFLGQFKVQAAYQASRADGSGGPAVNAGVTGTQQVWGGVTWQATPAAALIAAVYHVNANHGGGNANIYTIGGSYNISKRTLFDLQAATVRNSSTANFGLNANGAGTAVSTGNPHPGGSQTGVYAGIQHLF

SEQ ID NO: 930 - protein, 145 aa, Burkholderia cenocepacia
DRHGVDKGDLGVVWDPGWNWWEIGGWHFAFVVEGHAGYWHTGGNVHSNIGEFGVTPMFRFVKSAGQIRPFIEAGGGVRVLTHPTISDHFSLSTAFQFAPTAGVGVEFGQRQQYQVGYRFEHVSNAGIKEPNPGINFHQFYLQYNF

SEQ ID NO: 931 - protein, 358 aa, Burkholderia cenocepacia
MKAFARRASRTSVKLIAAAACVAAAAPVHAQSSVSLYGQVDEWIGATKFPGGDRAWNVSGGGMSTSYWGMHGAEDLGGGYKAIFTLESFFRAQNGQYGRFTGDTFFARNAYVGISSPYGTVTAGRLTTHLFLSTILFNPFYDSYTFSPMVYHVFLGLGTFPTYPSDQGAVGDSGWNNAVSYTSPSFGGLNFGAMYALGNQAGDNGSKKWSAQFNYANGPFAATAVYQYVNFNNGPRDLSALVAGMKSQGIALVGATYDLKYVKLFGQYMYTKNDQVAGSWHVNTAQGGVSVPIGVGNAMASYAYSRDGGGLDQTRQTWAVGYDYPLSKRTDIYAAYMNDHISGLSTGNTFGAGIRAKF

SEQ ID NO: 932 - protein, 373 aa, Burkholderia cenocepacia
MKQTTRLAALAGGAALAFASQYAAAQSSVTLWGVADVSVRYLTNANANNDGLLQMTNGAITNSRFGIYGTEDLGGGLKALFNLESGVNLQNGAFADSGRLFNRAAYVGLQSPYGTVTLGRQKTPLFDLLSDTYDPLTVGNYLENAWLPVALGGGLYADNQIKYTGKFAGLTAKAMYSTGTNYKDTSPDGFSGQIPGSLGKGNAWGVSLSYVMGPLSIAAGAQQNSDNSARKQTIYHANVVYAFSKAKIYAGYLRSKDDTGFVDSLLAQQTIPTAKGTGRIDDGPFAGVSWQVSTPLTLTGAFYYDHMRNAMTANGTLASGNRYAIVGIAEYALSKRTEIYGTIDFNKTNGAANVELPGRSNQTGIAIGLRNIF

SEQ ID NO: 933 - protein, 1093 aa, Burkholderia cenocepacia
MKNKKEGFTFRVGLFLLLVTFCLGTVQAQSSKITGYVKDQSGEPLIGVNVMEKGTTNGTVTDLNGFYSIVVKASNAVLNFSYIGYKNQEISVAGKKLIDVTMKDDSETLDEVVVVGYGTMRKKDLTGSVVQVRPDKIANENPKTVQDILRGTPGLVVGYGEGDAGAKGGGEMKIRGQRSVYTDGGHNNPLIILDGMFFQGELSEINPDDIGQIDVLKDASAAAVYGAQAANGVIIITTKKGKKGKPVVNFTASVGLTQKAAYRDRWQTTDEYLQHYVDWKEKNTYGVNAETGEYAAYSRPGNEYTSKPEYFRNPNNLSDAVSLEQWRNYSTNREGESDLSIWARRLGFRYDTALLDNLLSGKTVDWQDEAFRLGFNQDYNVSISGAGDKVDYYMSLGYLRNEGAFVDDTYRAIRANLKLNAKVTNWFEVGANINFQDRSDGEIGMDKGGFMENSPYAMLKDENGNYTQDPLMYQYDRANETNWYFEKQYIQLEKGYTTLNTIFNAKVKLPFNITYQFNIAPRFQFFYDRYFTSAERPNSNPNDRGTNREQAKRFNWSLNNTITWDQTFANKHHVILTFVQEAEERQYWSDRIEARNILPSDALGFHNTQNGDKSVSTFRTDDNHQTADALMARAFYSYDDRYMVTGTIRRDGYSAFGANNPYAWFPSGGIAWSFTNEDFFQKYAHIMNSGKLRVSYGKNGNRSLENPYEALANLYPGGGKMQGYITSSGDLYLMRYLMAQRMKNPNLQWEKTQSWNFALDFGFLNDRITGTLEYYRMSTKDMIMRQPLSNFTGFENITTNLGQVDNSGFEVALNTLNIDKKNFQWSSSFSLSYNKNRIKHLFGDRQDIVDATGSVVGSREADYVAAGWFIDKPISAIWDYKVTGIWQKDEVEEAKKYGQVPGDPKVWNNPANDQYDADGNLVKVVYNNDDKVFQGQTAAPVTWALRNDFTLWKDLTLSVNIYSRMGHKSLESMYLNNDDDGGGMTYRLVNKNAKEYWTVDNPTNKYARIEAQGPEGAKGARRLYNRSFIRLENISVGYTLPRAWTEKIQIDRVKVYGSVRNAAVWAKDWEGYGDPETGNFASRIWTLGLNLTF

SEQ ID NO: 934 - protein, 453 aa, Burkholderia cenocepacia
MNRKNLFTRTALAAIVGTLSSYASAAGFQLNEYSTSALGRAFSGEGVIADDASVGSRNPAALTMFDRPEFSVGAIHINPSVDIKGKSPLSGASTNAGDIAPSALVPNIHFVAPINDKWAIGASGTTNFGLATDFKKDYPAGLIGGKTDLKTMNLNLSAGYRVNKQFSVGLGLNALYADAEITRHVGEAGKLLGGTLSQHPDPNYQGLGRYLSSLSPSDRFAQLKGDAWGFGWNAGLLYEFDEDNRISFTYRSKVKVKFKDGDYQSDLKTIPLPGGNTIVGTEGGTIKGKLDLNLPEIWEFAAYHRVAPKWAVHYNLAYTSWSEFKELRATRKSDGQQLFNKEEGFRDAWRIALGTTYYHDDNWTFRTGIAFDDSPVPADKRSISIPDQDRFWLSAGATYAFNKDMSVDVGLAYMHGKKVTIKEKLSESLPLPAYEFESSGKAWLYGMNFNYRF

SEQ ID NO: 935 - protein, 390 aa, Burkholderia cenocepacia
MKQIRSFALLALPAALVAAGAHAQSSVTLYGIADAGIAYVHNAQNANGGNASSLVKFSSGNLSGSRWGLRGIEDLGSGLSALFQLENGFNIGTGALGQGGREFGRKAVVGLASSTYGTVTLGRQYDPIVDLVQGLTQDNYFGGVFATPGDLDNYDNSLRVSNSVKYTSPLISGFQFEALYGFGGVAGATGSGRTYSFGASYANGPLSLGAGYFYANGGTTVANGVRTWSSSSDTLFNTVINQGFSSAKSIQIVRVAGQYVAGPATFGLAYSNTQYGADTLSAFSQNAKFNNGSAFFNWQFSPALRAGVGYNYTSLTGPASAHYNQVNLGADYALSKRTDLYALFGYQKASGNTLNASGATVKAAASVGSYGVNSGTDTQELAIVGIRHKF

SEQ ID NO: 936 - protein, 357 aa, Burkholderia cenocepacia
MKKTRQAGVRVAARRVVGTLGMTAIFSAGLASTFVGARADSGSQVQLYGLLGTYVGSIKRSDTPQAAVQMGSGGLTTSFWGIRGKEDLGGGVGAIFVLESFFQPANGALGRSTADPFWSRNAYVGFQGDFGQVTFGRQRNPAYTAESLVNPFGSSTVFSPLVLQTFVTNYGGTIIGDTVWNNTVKYTTPDFKGFAATVIYGLGGVAGSPGVGNLGVHLSYQGHGLTAVLSGQRVRYTAAGPVGAQYAYLAGAAYDFKLVTLYGAWAMTSDASTPTGSRTYEAGLSIPLSPADFLLAEWARTKRSGATPGAGSLRNTASVGYNHLLSKRTDLYAVYAYDKLSAHPTGNTFAVGIRHTF

SEQ ID NO: 937 - protein, 376 aa, Burkholderia cenocepacia
MKRKVISAISLSITAYAAGAHAQSSVTLYGIVDTGIAYIHNSGGQASQWKMSAGNLSGNEWGLKGTEDLGGGLSASFQLENGFDLGSGQLQNDGRMFGRQAFVGLGSTRFGTVTLGRQYDPVTDLVQPITADSYSGLFAPPGDIDNYDDSARFNSAVKWTSPSWGGVTVETMYAFGGVAGSTGSGQSWSAAAAYSGGALSVAGGFLHVDNGNARTSARGTSSADSFFNSAVNAAYATARGIDIGRIGAQYVVGPVTAGAAYSYTRYTSDGASTFAGSQHFQNGSVFASWMATPTFQVIGGYNYTRSGGHSSATYQQVNLGVDYLLSKRTDVYATAGYQHASGDNGQGSAQAVIGSYDVNSGANSQIVAIVGLRHKF

SEQ ID NO: 938 - protein, 394 aa, Burkholderia cenocepacia
MIKKTVVLGLVSIGSVSAQAQSSVTLYGVVDAGIAYTNNQGGASNIQQTSGKLSGSRWGLKGAEDLGGGLQAVFTLESGFRPSDGGLGQGGRLFGRSAYVGLGKKGLGTLTFGRQYEPITDLVAQYSGAGFWSPATHVGDNDNLNQSFRLNNAVKFRSDTIAGFTADLLYAFSNQANGGAGTGFSNNNAWGASANYVNGPLSIGGGYVRFNHPNAASNTSGAVGGATSTTGNDYSGAFFYGLNGGVLKQQIGAVGANYALGPATLGFAWSHTQLNYLDGSSRKFNNYDVNARYQITPAATLIGVYTFTDGRASGLPGTSGQTLKPRWHQFTLGFDYALSKRTDIYVSGIYQLAAGDASTATSGGYRKIAAISNIGSASSTNRQLAFVSGLRVKF

SEQ ID NO: 939 - protein, 397 aa, Burkholderia cenocepacia
MKTAVCTAAVACALAAPLTVHAQSSVTLYGIIDTGIAWTNTVASSIKAQGASRWSMATGWGSGDRLGFLGREDLGGGLSAVFQLEAGFSGLNGTSSQGGRLFGRQAYVGLSSKQYGKLTLGRQYDYTFDYVAPLMAWLQFGSIYGAHIGDVDDSFQTFRLNNSVKYEVSPLAGLKLGALYAFSNQAGGGAGQGFANNRAYGFGLDYLRGPLHVVASYLQLNNPSAGIASSGNNPNGAIGDEYSGSTSIFYNAGFVERQRISALGAGYSFGAAAVNLVVTDTRLVYRGGHSLRVDNYEINGRYNFTPVLIAGVGYIFTDGHGYTGSGATSFATGDRPRWHQVDAGITYLLSKRTDLHMSMVYQRRAGDAGTVAINFFGPAGAGRSSQIAVLAGLRHRF

SEQ ID NO: 940 - protein, 942 aa, Burkholderia cenocepacia
MKKMKNWLLTGLFFMIVSTVFSQGKVTGTITDGTGSLPGANVQIKGSSTATSTDFDGKFTLNSTTSTGEIVISYLGYENKTVKFTVNGGTANVGTIALTSNSNELSEIVVKSTVVDIAKDRKTPVAVSTIKAAEIKEKLGTQEFPEILRNTPSVYVTKSGGGFGDARINIRGFNQNNIAVMINGMPVNDMENGSVYWSNWAGLSDVTSAMQVQRGLGSSKLATPSVGGTINIVTKSSDMKEGGSFSSGFGNGRNFKIQGSYNTGKLENGLSASVLLSQTMGDGYIPGTQFEGSNYFIALGYGTKNDKHNFQLTVTGAPQWHNQRSTASTIATYQKYGSLTEPNIKYNPDTGYLNGEQYNIRKNYYHKPVASFNWDYNINETTKLSSVLYASMGRGAGASATGGIGGNVYNSSVFLLPNGMVDYDKIQAWNNGTGSVFFNGANRTRTQVGGVYQNSSSTGRTGAGNAADPYVYNTTSGITQTSSINSHDWFGALINLNKKLSSTLTLDFGIDARTYTGYHFTVVNDLLGGGEFFDNTVASLRPAGRHLTSTYATNVQWNVFDKRDYDKISFNSTGKVRWYGAFTQLEYSKDNLTAFVQGAISQQGFKREDDFVYLPTDPLASTSYENILGGNAKAGANYNINEKHNVYVNAGFYSRQPFFNSVYPNNRSTVNPNLTNEKITGFEAGYGFRSRFFNATVNLYNTTWNDRYLKGNALPAGGGIAANTTYTEFTGLNEVHSGIEFEGSSNITDRFKVNAMFSYGIWEYKGNASVNAYYQADNTPVAGYTAATVYMDKVKVGDAAQMTASLGASYEVLTRVTVDANYNFNDKLYAGLSPVTFTSADNKGALQLPSYGLFDAGFSYKMLTGKNKDKSVNFRLNVNNLFDKIYIAESRTNIFADDNVSSSNAALGTYASNNRLYRGVADANQVFFGFGRTWNFTLRYDF

SEQ ID NO: 941 - protein, 688 aa, Burkholderia cenocepacia
MKGVKVGFPVIGKLIFVFGLSLTAWFSYTSRASLAQANPPTDEEALPSSIVEDEEVEITVTGEILDQPVYAPFRREGTVRDSSRPVYVINREQIEAQGARTVQEALKYLPGILRDGTAGGQLGALSSQFIRGSNTAQVLILLDGRPINDVGFMGGFDLSNFTTDNIERIELLPGGGSTLYGSDALGGVINIITRAPADEKPEVTLRAAAGSFGLNEQAVQARGRSGDLGWSVGYTRTQATNDFPFEINRIGLQADRNNADVLYNNLNLKLEGKLSDRNQVTFSALYLNKDFGSAGGVPIPDSIGQFNSLTPLARQTTEELFLDLTWQAQLDQAGNSQLTSRIFADLLDSNFDNPDPAAFGTRDDVDRRSIGAQVQHNWKVAKNQTLTYGFDYRNTQSRNTTFSYGLGTTDVNYDGGIDQGALFARYDVNITPKFNLNFGLRQDFNSLANGSFTSPSVGARLAIGDSTVLRANYARSFRAPQIVNLEGLAAFNVVGNPDLEPERGDSFDIGIDQSLGENGLLRLTFFANTISNLINFQFGAPSTYENIGKVRTLGLEADLNVRLLKNLYAFANYTLNEPEIIEDGDPTITGNELSFRGADSLNVGLAYENAKGVYIAAIVRYLSSYFVNNTNTESLPGYTTLDLKLRFPIGDSFAFTGSLDNLLDQHYEQFPGFPAVGRSFRLGVSATF

SEQ ID NO: 942 - protein, 701 aa, Burkholderia cenocepacia
MSRRNWAAAPMAIVVGTTGMGAADAQETALPTIEVSAQRATAPFRTRESTSATRSEADVMEIPFAVSSVDTKLIQTVAATRGDDLYDWVAGVSRQNNFGGLWDNYAVRGFAGDGNTSGTDYLVNGFSWNRGMSVPRDTVNLERMEVLKGPASALYGRGDPGGIISYTTKQPQFARANTIGVSAGSYGALRQTLDSTGPITKSLAYRFVAMNENNGSFRDTVSSKRYLFSPSFTWDIGADTTLHYEFESARQRAPLDRGVLAVNGQLGVIPASRFLGEPRDGDYDVRNTGHQFTLEHRIDSSWSINAGVAQRTTDLSGRSSEAFALQPDGRTLWRRYRQVAFHSNDLQGRLETAGAFRTGGIGHTLVMGVDAYRFNYDQFVTRSTPSAAAPYAIDIFDPVYGQPAPTPRTATNLLERDDGQGVYAQDTLAFGPHWKILAGLRWDRFHQSIDNRLKGVTTSQLQTALSPRIGVVYEMSPAWSFYANTAYSFRPNNGADINGRAFDPEKGHGYEAGAKWAGARSLTTVSAFYVTKRNVLTADPANAGFSRAAGEVRSRGIEFEWSGDLGHGLRGIANLAYVDAEVTRDSVLAPGSRLVDVPRLSGSALLMYETTLPFADKAGAGAGVIYVGRRAGNTANTQDGFELPAYATVQLNGYLQVNKHLRASVVLNNLFNRTTYVSSYNSLWVTPGAPRSLLASLAYSF

SEQ ID NO: 943 - protein, 254 aa, Burkholderia cenocepacia
MWLRTFGGGTSDEYNSGKYFEIQSGYDKLNEYSNFELYSGVMINYTNMNLSATDLSAKLNGYGIGQYFSLLFNEGFYSDFVLRYIYHQNEVNANFIPGNQGRLDDNDGSHNIILSAELGYRKNYDKFYLEPSLEFISGYVGAMDLKGDIASLKRSSYIPLVAKTAFFIGSQNQNLNFRTGLGLYADLIKTGEQILEDQASQRRYEGKKDQRMFINLGSDYKLNDKTRFSFEFEKTFFGDLNVDWSINANLRYSF

SEQ ID NO: 944 - protein, 791 aa, Burkholderia cenocepacia
MRMPLYSSAYSAKASTNKVNFTSPKLIGSKLIMPGSVRVRLAKALRTGSLLGLASLIFTPLLSFSIAAEEQVSSQDTAKVQLKSPNEQDKNHSTLEVIQVIGTRLNLRQKALEVPRSMTVVTDKYIQDTQATELTDVLVQTPSISVSDNDRPLMGNISIRGFGNERINLEVDGVSYKQFSDGSNANGYISPLDLDPSIVRGVEITRGADGIGSGSGAIGGQVKVVTKGAWDYTSGAAGSGVLVRTGMDDATHMRRGGVTGYVATDELALVLHANRRTFGDIKLNPRDSEGSLRGQTQTLKNDGQSDDLRLKVNWDSAHGQLDSDTFYTASEVAELPFGNNTRWIDQALTESETGERLSQSLAYHYASDSQWLDLRAKAYYQDYQRVREQDGKIVLGKNEYPFNKQDSFEDQSFGLSLSNSINHQMNDWKGELQLFASVDRSQFEDTVTDRLTNTQATYYGHSQGDMFALGVRHESDYSSWLSTEAGIRLDSFSNQSDNFTEYGENSDEQWSSNLGVTIRPTEWLRFYGRYNESFRGANLRELYKKDEWVCHRPSKHCYSEPQPGLKPESSSNYEFGFGLVFKDIAFSDQLLFKLNWFDTQVDNYIDTAPYMYKLVDGQKVAASPKEATHRDYSSKNIGKLYSKGIEAELTYQYQDLDIFANYSRVRMDVEGMPNFYLGTIEQVRQPYTRAPQDRINLGLSWQLVSELRLSWVSSFAMDMKRLPELYLENEMDAEGYQVHSLYITYQASWLSGFELRAGVENLLDEAYSVWPDDEDTSLPGRNAKLALSYHF

SEQ ID NO: 945 - protein, 659 aa, Aeromonas hydrophila
MSKKLHQALMLYLTLGVLVAMTSTSWAAQATVPSYELGEIVVSAESNETEKVATLYTLDAKNLKDRGVRTLEDALVLVPGVYVRYGADGVPRIDIRGFRTRHVLFLLNGIPLNSTYDGQFDPRTVPVEIIEQIKVTTGGGSVLYGSGGNGGIINIITKQGQPGLHGSIVAEIGQEDSALGRLSLVGGTEKVHAFASVGRIDRDGTPLSNHFSPTKAEDGDERDNSDFEQTNVFTNLDVQVTDKTLVGLTFNYQEGEYGKPAVTNYDKNDPFTKKEKFLRVDDSEGMSSQLAFSHKATDRFTVRGWGFYNELELEENRYDDNTYSSQAKKGAYESNSTTRTTGGAIQLNADLQDAGGLSLAVSTQNDDWEDKGFEVDKNNVAVNYKNNEDVDQYNVALEYEVALGGKAGMVAGMGYHVQDRSSGGDEDAYSYLIGFHFDPVVGTRLKINHARKVRFPSIKQLYDIDSGNEDLDAEHTMHYELGVEQALPGKTLFSLTGFINDAKDFIEKDEVTEINKNADEYMFHGFEVALENEAIDDLLLRLSYSYLESEDRSSDSDIHQLQNRPRDRVTFESVYDTPWNMTAQASVQYVANQYSYDDDANQRRTPAFTLVDVKLTQKLLEEALELYVGVNNLFDEDYEQSYGFPQPGRYVYGGVEYHF

SEQ ID NO: 946 - protein, 389 aa, Aeromonas hydrophila
MHTNNSKADQLNISNKLSGINNTVLVDFLNKPANGTNVTLITAPKGSDEKTFKAGTQLIGFSNVTPVISTEKTDTATKWMLTGYQTVADAGTSKTATDFMASGYKSFLTEVNNLNKRMGDLRDTQGDAGVWARIMNGTGSADGGYSDNYTHVQIGADRKHELDGVDLFTGALLTYTDSNADSHAFSGKTKSVGGGLYASALFNSGAYFDLIGKYLHHDNQYTANFASLGEKDYSSHSWYAGAEVGYRYHLSEESWVEPQMELVYGSVSGKSFNWEDRGMALTMKDKDYNPLIGRTGVDVGRTFSGDDWKITARAGLGYQFDLLANGETVLRDASGEKRFEGEKDSRMLMNVGMNAEIKDNMRFGLELEKSAFGKYNVDNAINANFRYSF

SEQ ID NO: 947 - protein, 578 aa, Aeromonas hydrophila
MAVPVKNGWLYTRNVAMSGEKKAKGWRFYGLVGFGAIALLSAGVWALQYAGSGPEKTLSPLVVHNNLQIDLNEPDLFLDSDSLSQLPKDLLTIPFLHDVLSEDFVFYYQNHADRLGIEGSIRRIVYEHDLTLKDKLFSSLLDQPAQAALWHDKQGHLSHYMVLIQRSGLSKLLEPLLFAATSDSQLSKTEISSIKINSETVPVYQLRYNGNNALMFATYQDKMLVFSSTDMLFKDDQQDTEATAIAGDLLSGKKRWQASFGLEERTAEKTPVRQRIVVSARWLGFGYQRLMPSFAGVRFEMGNDGWHSFVALNDESASVDASFDFTPVWNSMPAGASFCVAVPYSHGIAEEMLSHISQENDKLNGALDGAAGLCWYEDSKLQTPLFVGQFDGTAEQAQLPGKLFTQNIGAHESKAPEGVLPVSQTQQGEAQIWRREVSSRYGQYPKAQAAQPDQLMSDYFFRVSLAMQNKTLLFSLDDTLVNNALQTLNKTRPAMVDVIPTDGIVPLYINPQGIAKLLRNETLTSLPKNLEPVFYNAAQTLLMPKLDALSQQPRYVMKLAQMEPGAAWQWLPITWQPL

SEQ ID NO: 948 - protein, 753 aa, Aeromonas hydrophila
MACGIARHKKTLLGAASALALMLDGGDTAIAQTEHELPAVRVQASTPRPARRATARQNAVRTPVAAPRVVERHAPVTPPTGMIGALPPAYAGGQVASGSQVGLLGNRSVMDTPFNQTSYTAQTIQDQQARKLDDVLANDPSTRSNAPRAYGFDFVSIRGFDVPSSAYGINGLYGLASAFSFSSLAAIERVDVLKGPGAVLSGMPPDGGVGGSINLVTKRAGDNPIARMTNTYASRGQFGTHVDVGRRFGEADEFGVRFNGSYRNGATELANQSQELGTAALGLDYRGERVRLSADFGYEKNYVDAMTRFVVFGPALTAVPVPPDARASFVPSWGYWKSEGKFGLVQGEVDLTENLTAYAQAGVVSSESKYRYSDITLTNLNGNFDGSPRLNSQTREQVAAQTGLRASVDTGPFNHAINLNATISEGVVGIINTRGTAFSSNLYNPRPSPMPLISVGAPPKISDSRLSSLGIADTISMWDKRVQLTVGVRQQYVESNSFSATTGSRTGGYDASATTPAYALVVKPLENVSLYANYIEGLESGTVVGAQYANAGEVLSPYRTRQYEAGVKVDWGRVTTTLSAFDITRPLQLVDLASNTLTQDGESRNRGVELNAFGELAPGVRLLGGIMLIDARQEKTQAGQYDGYRTFSVPDTQLNLGGEWDLPFLRGFTLTGRAIHTGSFFSDQANSLLVSNWTRYDAGVRYTFASPWNSKPVVVRFQVENLLDNNYWQGANTNRYVFLGAPRTYLLSTTFNF

SEQ ID NO: 949 - protein, 361 aa, Aeromonas hydrophila
MKKTALTMAISSVLLAGGAQAATVYDQNDTKLEIGGRAQGMYYGTDNKDSEGDQSYFRLHVAGETKIDNELTAFGFAEYNLPVSGSDNDELRYAFAGIKHDRFGAFSYGRQDGLFTKAVNNYTDVLPEWGGDGLGKDTEVFGTGRTNGLAQYIYTYQGLTLGAQFTGNNDPQNAGRSEMTGPNSTWNSEGSAEGFALSANYDFDMGLSLGAAYNQAGKTDEQADNAAFGGDRDAKLYGVGAKYEAGDLYLAATYSHGEDHLFVNNGYAEKMDGYEAVAQYTFGKFKPSLAYLRTDVKDNARGIDDTATEYVSIGAWYNFTDNFNAYVDYKINLLDNVNGTHTNSLGKNTDDVVAVALQYNF

SEQ ID NO: 950 - protein, 698 aa, Aeromonas hydrophila
MAHKPHWWLITTFIISQSIILTSTAQTDSSHKSVFFTSSANEVMKLSKNNNNSVTTTSKKAESITEAAGIISVVTQKEIEAFGALSLVDVLDRLSSIYVLSTYAYPNNMVSIRGDNTAQYNNRVLILLDGRPMRESLFLGENRAIYSMIPLKTIDRIELLKGPGSTLYGTSAFTGAINIITKKGKEARKFDQSISYGAFQRFQTNFSGGISAKDATLSWGLNYVDDKGWDFTATDENGTTRTIQMLQKGLGGQMKIDYGNFTLQGYYGISEQAAIGNSPQFGSSINRPYDDYRSYSSRLFLDAGYDFRLSSKISNQTNITYNHYDFRFFYIEANDVSRQAGSNDVLVENTTFLNLGKKTEVILGGVANYRQGYGTQPVLNADGSGYDIFNNPVPNPNPFVFVPNSQEVFWGVYAQASYRPFSYLKIVAGGQLNKAPGTPIDIVPRLALISNFSKNFGAKLMFGQAFRSPSISERFRKSRSAYGDPTLAPETVTTIEAQIYREIPGKLLGTLTYFNSTGNRLIRRSRPSDSLLVIDGVSVAKYINEGSINTQGIELEGKRQLPYHLSLNVNASFFWEGDNTTATVTGMPNLMAKAGISYRLPRYGSLGIYHSFFGKGTDINAQQTVNPTPEAFHFLSAHLRLNLASLFKFNGLYSVFLEVYARNLLNAQVHYPEYIRRNINSIPGRAGRAFYGTLRLSF

SEQ ID NO: 951 - protein, 798 aa, Aeromonas hydrophila
MEKTLMKQSEFSNLMRVLSFIVFWSLVTLFSFQGIYPESKTDSIEDKTNIITVTGTRRKNLLKDSTITTEVITRKDIDAMGARDLSQTLGNVPGIEVKPAQSGERGQTVRLQGLSAQNVLILVDGQRTTGRFSGSIDLTRFKAEDIERIEIVKGASSAIYGSDAIAGVINIITKEAQDPLFAEFRSLGGAGSERYFGPYMEYRNYASVGAKSDNVSTLFTVGWHKGEGYDLTPDATIGPRNGRYASLAPGYNPYTFETPLANQYILATRFPMYTPPLESTSGSAFNDMNLSNKTVYRPTDNLIFTGQFYYRHLDQSAVDASPPRTIFDRRNKTHDFMGAFNVDWIASQKINLNLNANYSRFQDLYVTDQRKADDLDSQQRTDNAVTEFRTRVDYKISENHVTSVGAENLQDQISSARIAPDCRRTYPNLCYEDFNPLLTKGQSINGNAYRFRNAFYLQDEWRVSDKPRIQIVPGIRYDHDSIYGGEWLPKLAIRYDVTDQFRIRVANGLGYRAPSFQDLYFNFLNPGVGYRVVGNSDLKPELSRSYNFGWEWDITKRIWYSSNLFHNNVDNLIGYRTNPVRDASGLMVYQTSNYQKAMTQGIESSINIRLTDIVTTGVGYTYTDSKDELTNLPLEGRGRHRWNLNLRVEEKSSGISLSVFAVVFGKQPYYCIKNSFWCNPDLPSNFDSLETILNQESQSSIQNLFGTLPTVLSDYCAEKNISYCTTSPTYGYRMVNPYSNLNLRLSQRFLGHFQWFVGVDNALDAWDLQYNPQRPKFYYFGLDGKFAFSDVKLKNGDS

SEQ ID NO: 952 - protein, 382 aa, Aeromonas hydrophila
MKKVALGSGIALLFSAPAFAQSSVTLYGVIDEGINYTNNVGGKSLVEMASGFAQGSRWGLKGAEDLGGGTKAVFQLEGGFNADTGKAGQGGLLFGRQAYVGVADNRFGTVTLGRQYDSVIDYLSPTTAAGNWGGTMFGHPYDNDNFIYSFRVNHTVKYTSPVFSGFQFGGTYSFSNDTSFAKNRQYSAGMQYTNGGLLLAAAYLQADNPSSTAGGAINNGGDQNFLANRLRIFGAGVNYTFGASTVGLAYSNSNLNQPQSTEYISGSILPAGGTLSSLRFQNIEANFKYQFTPAFYAGVLYTLTLESFHASSGDAKPKVHAFGVMADYNFSKRTDVYFQAAYQRVAGGKTGTALDLADLPGAANASSTANQFQARIALRHKF

SEQ ID NO: 953 - protein, 280 aa, Aeromonas hydrophila
MAKFTKTLIAAGLLAAAATPAFAADYSGDIHKNDYKWMQFNVMHTIDQRPFTTGAEDYNDTYFEMEFGGRSGLFDLYGYVDVFDIFDSRHSDKHKGQNLFMKFAPRMSLDALTGKDLSFGPVQEVYIASLNNIGDNQMENMIGLGADVQVPWFGKVGMNLYARHATENQFFTEEEGEWNGYWFAMNWFKPFYTFSNGSFVSYQGYLDYAFDLDTHNRADRTSDNLATFHGIYWHSDRYAVGYGLKYFMDAYGTKDGSTAYDGTPWKSSGFSHYFSVTYKF

SEQ ID NO: 954 - protein, 624 aa, Aeromonas hydrophila
MNIRSLPACLRPCALAVLAVGAGQMLHAQGLPDTPGLAPGLAAPALQDTVVSATRTEQPLSDLVADLSIIERETIERSGLTGVADLLARLPGVEMARNGGIGGAGSVFLRAADSRHTAVFIDGVRVDSQTTGGAQWELIPLAQIDRIEVLRGPAAAVYGSDAIGGVIQLFTRKGEGPAKPYVGLGLGNLGSRMFDTGISGSAGQDGAFGYTLGLARDSSAGFDAKTGVAHNPDRDDYRSTSGHARLGWRIDARHHVDATLLANRMDAGYDEYSAAPPVDDRSLGRLRTAGLTWAAQWSGAYGTRLSVSDALSRYASAPTPYLAETRLRGYLWQNDYRRGAHRFSAALERREDALQNGPIDRSRAQDALALGYGLSTGRHTVQLNLRHDGDSDFGSSSTGSAAYGYALDAHWRATASLGSAFRAPTLYQRFSAYGLPTLQPERSRNIELGLRYGQGRSSFSLLAYRNRLRNLIAFAEAGPCASSHGCYANRTRAQYQGLTLAGALPLSGWQLHGALDLQNPRDPDTGRQLARRARRHATLGADTRLADWSVGAEVQASGRRFDNAANTKVLGGYALLNLYASTRIARDCTLLARIDNLADKDYPLARSYATPGRTLYVGVKWAAQ

SEQ ID NO: 955 - protein, 333 aa, Aeromonas hydrophila
MKMKMAPALIALAIAAMGTSTAQAADDWYTGIGAGWAYGHDLNDFGKDADKDATALSLFGGYNFNDYYAAELGYLYAGKAGVDGVDFKTQGATLSGLARLPLNDIFSVFAEGGAYFNHVNGNGNSDNGTAPLAGVGLTAKLSDLIDVQARYRYMWNLGDEQKTWETNMSVATLELVMHPNRTSYVAPVAAPAPEPVPEPVVVDKSFALSSDVLFAFGKSTLKPEGVAALNTLYQQIVDVQPKDGSAVVVGYTDRIGSDAYNLKLSEARARTVADFLVGKGLPAGKVAIEGRGEASPVTGTQCDGIKAKAQLIACLAPDRRVEVRVTGIQEVTQ

SEQ ID NO: 956 - protein, 344 aa, Aeromonas hydrophila
MMKMAPSLIAIAMAAMGATAAHAADDIYFGAGAGAAHFNGLNKIGGGGYAGTEDAAAANAFVGYNFTENFGTEFGYQYAGRGNTDGLRYENQGATLSGIARLPLGGDFSAFAEGGAYWAHTDGLGTSDTKVSPLAGLGVTYKVNDALDLQARYRYMWDVADLHAGDAPDDVRYKSNQSVATLEAVYHPFRTSYVAPAPAPVVEEAPAPAPQVVEKNFALNSDVLFAFGKDSLKPEGVAALNGLYQQIVEFQPKDGNAVVVGYTDRIGSDAYNQKLSEARARTVANFLVSKGMAASKVAVEGRGEANPVTGTKCNGVKAKAQLISCLAPDRRIEVRVSGVQEVQK

SEQ ID NO: 957 - protein, 738 aa, Aeromonas hydrophila
MKTLLFACAATLTTFGALAQQTPQDSTDVEKLDEVLVQSVRVDADSPITYSNLSKDEINERNLGQDLPILLNYLPSVVTTSDAGAGVGYTGFRVRGTGNRGINVTINGIPYNDAESLGTFFVNLQDFSSSIQSVQLQRGVGTSTNGAGAFGASLNILTDAATLEAYAEVNASGGSFDTRRANVKFGTGLINDHFTFSGRLSAIKSDGYVDRASSDLKSYYLQGEYRNEKTLLKAVVFGGHEVTYQSWNGIDAQTLATDRTYNPIGFQYDDDGNFEGFYDNQVDDYKQDHVQLHWNQKYGGGWSTQLSLNYTMGRGFFEEYVDSWYYANVNFSSDATFDFIGWEPYEVDGELQTDTDLIRRRWLDNRYYVANLTTNYKSNAIDFDAGVFGSMYSGDHYGEITWARYFAQDEEAGYRYYFGTADKNEFTTFAKATWRINDMWSVFGDLQGRFISYETDGINSDIDEFIIDENYSFFNPKAGLTLTLNEENKIYASYARANREPSRTDFENGNPVPETLNDFELGYRFTKERARIFANLYFMDYRDQLVLTGAIDDVGAPIRQNSGSSYRLGLEVEAGFQLGRKFAITPNIALSTNKNRDFFFQRDGELQNLGNTNISFSPEIIAGNRLDFFPVQNLRLSLLSKYVGEQFLGNIDAESSKLDAYFINDFNVQYDLKNIGFAKQITLTALVNNIFSETYVSNGYFFTYDDDFSNPGTVTTIEGTGYYPQAKINFLIGATVRF

SEQ ID NO: 958 - protein, 1058 aa, Aeromonas hydrophila
MYAQEEVTVKGTVTSEADGEPIFGANILVLNTKKGTGTDFDGKFQIKVKTGEIIQISYLGFKTVTIPYVNQKQLNISLAEDASTLDEIVIVGYGDQRKKTITSALTKVDGDDLQKQSVARVEDALRGRVAGLRIQTVASEAGGDPKITLRGPGSVTGSSSPLIVVDGIVLGTDPDILATIDNNNIESLSVLKDASSVAIYGSRGANGVILVTLKKGVVGKTSFSYNTFTGYKFSTNNDNFNTTIAQERARLNGLQSEVAAILPSSPNFDRINSDYNNAFAELEAMDFIASLGGGETNWQDAIFTGGFIKNHSFAARGGTDLTTYTASLGVLEDQGIALKDNFNKYNIRVKIDSKSKNKKIKYGANVRVNYNDQERLPSRFTDPLRQLGHLPLYLNEDHLDYVTQFSTDVGVSTDAGKLFENLGVGSYGFSRAFDHVFTVDPNNPRSILRDPVTGLPIASPLTSGGLTLSTTKNVHPLVHFLERSRTKKKLALNASSYIDFKLAKGLNFRQTVSGVFRHNKSTADDFFFGQENRDQESFRFERRDELNQYAFESTLKYKREIKKHNFNGILGFEYTQRDFYRQESEAVGYTNDFNNNIALADGGTTYTDNGTDKLVSYFGRIDYSYDDKYLFQVSARADGSTRFGSDNRFGFFPAASVGWVASNEKFLENNDFISFLKFRASYGVSGSNQISNNVYESLYRFEESFSTISYDQNTGVKGITLANQSLGWEKLIEFNPGIDVTFAGGLFSLTADYYIRTSEDLLLFAPVSATYGTDNWLQNLGEVENKGVELELSSRVITRENFRWTASGQFSLNRNEVKSLGSNEQIISRIDQDTRPTEFIARVGQPITSFYGWVYDREIPLEWVDNPFNRFNNDFADVYVKDLNGDGIIDGDDRTELGSPYPDFEWGFNSDFAFYDFDLSLQLQGSHGAEVRVADLDQLYYASESAVNEVSNFPDRDLTVHRRFTDDHIQDASFIALRNVTLGYTFPTDVTDKLNINRLRLYLTGENLLFFTAKGYEGFNPEAQGQTSNNANTPLTAGYQRGDGPIVRTVSAGINFQF

SEQ ID NO: 959 - protein, 800 aa, Aeromonas hydrophila
MQLPTRILLLTAVLAAASTLRAQPAASVPSANPADAPPAFADETVRLERFEVTGVPIEDSVNPLTRPLESLFGDSRSVLETPRSASTITQALLRERGIEGVREFVAFAPGSYAPASYGKATIPNIRGDLAETFLNGQRLSYNNFGVMPSFNGVEAVDIVRGPGSAIYGSGFFTGGYVNYTTKRPKFTRETTVTARLGSWVPRGGSWLNGSWQVDTTAPAADGKSAWRFSYEGKEDDTFFKNHGGRDDRQDLFASWIREANDALTLEANAQYMWQATPQLLGVNRPNQELIDHGRYYTGDLPDLGYSDAGALAGTIPGTTWVDLPRDATLLSVGDFSNANIVRGQFIATLQLAPEQKLVNRTLAEYVDRRRYHAFEYAEWAEQTTFENRTEWHASFEQGGLAHAVIAGGTLRWEDRLGYTNYFNEYFFQYDLTRPNRVFSHTADYPNSYWPGFAGPGGRLFFPASYGSPETTDSTLWNPALFAQDEVRFSEKLSLLAGVRLDGFYAKATDPLGTAAENPWSDTHRDTATSWNASLIYRVTPKATLYATHQRAYAVHGNVTGGGIMLKEDAQGRGIIDPDDFKNLSKLTEAGVKLSLLENTLYAGAAVYEQHRQEVELGGDVKNLKFRGAEVELVYQPTTRFNATFNAAFIDGRFDHSSATQAGGPSLYNLYAAGHGPGGRGNGLGFQWDKLPPGDYRIPGLSRWVVNSSFSYRFPSGFGGGLGGSWQSEQPGNLTNEYHIPAQVFLNAFLFYRQPTWEVDVEILNVLDRRNWIHNGDNYSNNVLVFQDLPLRVEGYVKFRF

SEQ ID NO: 960 - protein, 789 aa, Aeromonas hydrophila
MHSHHIKKPVRLSKKLLPLLIANLAFSGYSYAQAPADSIEEKNVEATTTKKLAAVVVTAQKRAENIQEVPTTLTAVSGKDVDEKQVVLSTDIERLAPNLSAQGGGRTGKPRWFLRGIGTNDPNQNQDGPLAIYVDEVVVGFQQLQSFPLYDLERVEVLRGPQGTLWGKNNTGGAIHYITRKASFNNEGYAKLTYGSYNTRIVESAFGGAIIDDTLAGRISIYNESYDGWATNIVTGNEGPSLKDQNVRVQFLGNFSPTLDAQLILSTREINAGDSPSYVVGATTLPGTDVTQVDPNGTINQGGTPYIPPYGNNPTVYSDYWGGDGYDHKTDHSATLKVNWQLGENTLSSVTGYSTRDSNGLTLVGVPLDTTLNRTSSTAELDSQQVSQEVRLTSPKDQQVSWILGAYYYHLNARNDSRSARFAVGTTREQYSESSWDQDAFSKALFGNVKYQFNEQASITLGARYTEEKKDITETALTVTDTATSNRVTFVSENGWYLPGGVSILPAFSNVTLVSKSNTWDEFTWDITPEYRFSDDVLGYFRIATGFRSGGFNQAITNGDIVETNPETLTDYEAGLKTAWLDGQLTVNTAVFYYDIKNLQLNIQRAYLNTSTNTYTTSTAGESDGNVKGIEVEFNALATVNWRIGGSLGFLKSEYTDFIYYIGDGGPFDASGNSFYRTPETSVRLDTDYTIPLASGNIILATDWSYRSHIYHNATVQNDPWQETSGYWIGSVRASYETANGNWVFTGFINNVTDKAPVYLRQIANPNTGTQPNSISAPKTWGLQVNYKF

SEQ ID NO: 961 - protein, 1180 aa, Aeromonas hydrophila
MTTADTIRGRSGPCGRVLRGLLTSLLSLGCVLCLFGTAARAIDVGSRGDWDNAVVAVGAAAAGATVTINITAGFTLTSSLPQLLAVQLNVTVNVNGNGLVIDGGSTYQGIQVNGANALTVNISNLSVINTKATGGSGLAGENGYYSGGLSYGSGGGGGGGLGGGGGLLVGSGAIVTLSAVTFTGNIAQGGAGGVGGSAQNTVSDPVNGGNGGAGGVANNSGATGGGGAGGTGGHTGTQGTAGSPGAAFGDGGGGGGGSGTTASINYTSNNPGGSGNANGGAGGQGGDGATNASGAGGPGPGADGGNGGVGGGARGGAIYVATGGSLTILDTPVNGATAIGGAGGTGGTGTGPSAIPGGAGSTGSTAGAGIFLSGVMANIGVSAGNVTYANSIGGTGLTTGGVNTAITKLGAGTLALSATNDFTGNVAIAAGTLSIAATANLGNVANDVVISDGAGLAVTATTTLAAARAFFIAGTSTIDVASATTTTLQGVVGNGTSAGSLVKSGDGTLLLSATNTYSGATTVSGGTLRAGASNAIPSGTAMTVANAATFDLNGFARGLGSLAGAGTVSNGGGSAVTLTTGSNGTDTVFSGVVQNGVNAVSLTKTGAGQLTLDGANAYSGATTVNAGTLSVNGSIASSALTSVNAGATLAGTGSVGNTTINGGTLAPGNSIGTLSVTGNLTLTAAASYMVEISPTASDRTNVSGTATLGGATVNASFAAGSYANKQYTLVNATGGIIGTFGALSNSNLPSGFKSSLGYDANNAYLDLVLDLAPTPSPTGDTPAVGLNVNQARVASALSNYFARAGSIPMVFGALTPAGLSIAAGEPATGMQQSTFTAMTLFMGVLTDPFAAGRGVDPSSGAAAFADAAGERGAPRGAFAMVGKAVPHPLPRPIVEPRWNVWAAGFGGSQTTDGNASQGSNRATSRLAGTAVGADYWLSPMTVAGVALAGGGSSFGVDGLGSGRSDLFQAGAFIRHQRGAAYVTAAAAYGWQDVTTDRTVALGGLAQLHGSFNANAYSGRVEAGNRYLLPSFGGFGSFGLTPYAAAQVTAFDLPAYAEQANAGPNTFALAYGAKTATATRSELGLRSDKAFALNAALLTLRGRVAWAHDFDTDRSLAATFQTLPGASFVVGGARVARDAALTTAQAELSFAGGISLLASFEGEFSDVSRSYAGKGVVRYAW

SEQ ID NO: 962 - protein, 373 aa, Aeromonas hydrophila
MKKTILAIAIPALFASAANAAVVYDKDGTTFDVYGRVQANYYGDHNKSVAATDGSWGFSGTGTPEYTPGTAAHYSDVDGELVGSSRLGWSGKIALNNTWSGIAKTEWQVSAENSANKFDSRHIYVGFDGTQYGKIIFGQTDTAFYDVLEPTDIFNEWGDVGNFYDGRQEGQIIYSNTYGGFKGKLSYQTNDDKAVKVTDVGQGIKENAVYGKDVKRNYGYAAAAGYDFDFGLGLNAGYSYSDLENTATNNTGDKKEWALGAHYAINGFYFAGVYTQADLSYDTTTGGDKDKGRGYELAASYNVDAWTFLAGYNFTEGKVASNTAGAEYKDIVDETLLGVQYAFTSKLKAYTEYKIQGIDKMDDEWTVALQYNF

SEQ ID NO: 963 - protein, 868 aa, Aeromonas hydrophila
MLRKSRLSAAVAFALASAAVMTTPVLAEEGQNVEKLQKIKVTGSRISRVDVEGATPVVSVSKAQIEQSGQQTVADYLKQASYNSFGGVSPASGSSFQSQATVGLRGLGSERTLILLNGKRVAGSPTMGGTSINLNTIPMAAVERVEVNLDGGSAIYGSDAIGGVINVVLKEGYEGLTFQGRIGSPTEEGGDEKSGSIVAGVASEKGSLMAVYEHDKKDVVYARDRDYLAKQGNDSPSVYGRNVEGITGLDANGDPIWKYGPLAGATNANGTCKEPFTNFEGGCNFNYGQVAATTASRSRDTLYLNGRYHINDNVDFVPQIIGSRVESFGRFAPAAGVFTIDPANPKNAKFFTDNGLDAAATQGLGEAAYAYYRFSNVGTRDNLVTDTTGSMNLGFEGTLATESVGDMQWNAGYMYSKTDNKENGTGYVLKSAAQKAIEDGKFVGGEFDASTTASMAADTSRRSTMDFYQWYAGVQWDMGELPAGPVSWYAGAEYNDWVYADKYDAQSEAGNIIGSAGNSSGGVRDVTAAYIESLVPITDEVELNVAGRYDKYSDFGSAFSPKASLRYQPLDNLMLRTSWSRSFRAPSLSDLYSADSESADWAKDYVYCAANGISAAACPNQQYTTIRTANENLKEETADTWNFGVAYSPLDDLNLSLDYYTIKITDLIQLNSLQSIIYDELNNGSSSNIVRNSQGKIKQGTAPMVNLGELNTSGLDFKADYKYDLNMATVRYDFGGTYILEYKEGLYAGGPVIDKIGQNGMPQLRFNTGVGVNVPQWWNMDTYLSASYIDSQSQDYIADTGAEVGHIASQTTWNLNVGVEAPWDGKIQVGVKNMFNTAPSLESDGFTYDDEVYGIDGRIYYLDYTQKF

SEQ ID NO: 964 - protein, 342 aa, Aeromonas hydrophila
MNKTLISTTLASMFTLTSFGALADGPNFYGRLDLAVTNSDTGATTQEKKDGTVIENNFSHIGVKGSETLTKGFDVIYQMEFQVENTSSNKDVFKARNTYLGLKTVAGTLLVGRNDTVFKQSEGGIDLFGNSNADIDRLVGGQTRSADGIWYYSPKIANAISINATYLMEDNHRDANGNVIDETQYAISAIMGDKKLKNQNYYLAAAYNTIGGIDAYRGVAQVKLGDFKIGGLFQNTESQTDSTQEGNSYFVNVAYNLNGINLKAEYGKDEAGFGKYYKNITADVRGTEIDVQVITLGADYKLTKSTLIYGHYAMYEGDHNTLAGKVSLEDDNIFTIGARYNF

SEQ ID NO: 965 - protein, 197 aa, Aeromonas hydrophila
MKKILPLMIAAALASPVAMAHQAGDFLVRGGLAFVSPQSSGNDFEINDNAQLGLTLTYMATDNFGVELLAATPFSHSVKMGDTEVAKVKHLPPTLMAQYYFGDVQSKVRPYVGIGVNYTTFFDEQGRGPLSNADVSLDNSWGMAGQVGLDMAINDRWFVNGSAWIMDIDTDVHVNGGDGIKTKIDPMVFMVGVGYRF

SEQ ID NO: 966 - protein, 406 aa, Aeromonas hydrophila
MHRNITMTRLACAIAALASAPVFAQSSVTLYGIVDTGIGYQSSQAPSLGSTSGGKSKVNMINGVWAGSRFGLKGAEDLGAGTKAIFQLESGFNSATGAQQFSNAMFGRQAWVGVTNPTYGTLQAGRQYTAYYSMLSPYSPTTWLTGFYGAHAGDVDALDTIYRANNSLVYTSPKLYGFTFSGSYSLGGVPGNLNRGSTWSGAVQYIQGPVGLAVGFMRINNSTLGGGAYGADSTVSNNGAQPGVSAVTNGYQTAQAQQRFAVTGGYNFGGGWDVSAAYSNVQYIPGVGSSFRDTAIFNTGGVVLHWKPTVSWDFATGYSYTRATKANGITSSAQYQQVNLSEYYSLSKRTGLYALQAFQRTNGNTLGTAGSGHIISATATIGDGFQSAPSSSRSQFAAGVGIVHRF

SEQ ID NO: 967 - protein, 368 aa, Aeromonas hydrophila
MNKSILAALVSGLLATGAVQAAAQDNTWYAGGKAGWSKYFDVDQKQVVSDTLGALQNTGTSKDALGLGAFAGYQLNPNLGFEFGYDWLGKYTSSGELSGVRVEGEAKSQMIQATMKIGFPVNDALDLYGRIGGGYAWTDSELSARTATDFIKETGDKHGAVFVGALGAEYAIDRDWAARLEYQYTTPLGDASLDRSGIEMDNGLLSVGMLYRFGQHGNEVVAPAPAPAVEPAPAVVVAPKTFSLSSDVLFEFNKATLKPAASHALDTLFSQIVAANPKDGAATVVGHTDRIGSDAYNQALSEQRARTVADYLIAKGLFADKVRVEGRGKSSPVTGNNCTTGSRPALIACLAPDRRVEIHLEGVSQPVQ

SEQ ID NO: 968 - protein, 1041 aa, Aeromonas hydrophila
MIFEKYKPLILGLWALFSFSVYSGNIYAKQTENTTVPQPVQNATVKGVVKDATGEPLIGVSVVVKGTTNGAVTDVNGNFSIACSANDILVFSYIGYDKIEVKAGNASFHTITMKEDSELLDEVIVIGYGTTTRKHVIGAVDQIRDDVIKDRPVANITQALQGATPSLSIQQRNMNPNNNNININIRGVSSMNNNDPLVVIDGMAANDINAMNLLNPNDIESVSVLKDAGTAAIYGSRSANGVILITTKQGRTDMKPVVTFTASVGNQNPDILLKPVSGYQNALLRNDSYVNAGKDPIYTPEQIHEFAKGDSEWGYKAIMKNALQQNYNINVQGGSKVTTYNVSFGYYDQESNFKGQDFGIKKYNFRSNLTSEIQRLKLKVLLAYDRNEGRSDRGDMQLADVMRVPTYNTYSLYPDEDGKYYNNEITTGGNYLARLRHGGLTTNDKDHFQGIVSGDLKIWQGLKLRGVVGYDIISEHRLIKRRYYPVYKYLNKDQIANAGQSKNYSIQDYNNKATMLNLQFFLDYNHTYNDVHQVTGLFGFTSESFRSEKNEIRRNFVDPDLYQDTDDTVYETSSYNTPNGFRERALHSWLGRLGYSYKDKYYAEVNARYDGSSRFAKDNRWGFFPSMSLGWRISEENFLSFWKDKVGDMKIRGSYGLLGSQTVDDYQYLTTYKVNSDQYGFNNSSVTGTGFTFGNSELSWEKTKTFNIGFDASFLKNALNVTFDVFQKNTSDILLTPLSPGTLGGAVPKANIGKVRNNGWELTVNYRFKHKDFSHLFGFNIGDSRNKVLEYGDESVKLTDGVERIIREGEAINSYYGFRTDGLFQTEEEIQNSPKFEGVKLQPGDVKYVDIDKNGVINDDDRVVLGNAFPRYVFGFNYNFSWKGLDFSMLWQGVGKRDMALRGEMIEAFHGSYSYVIYEHQLDYWTPDNRDARYPRLINVASSSYQHNYKHSSDRNLYNAAYLRLKDIQIGYTIPASYTKKIGMKKVRVFLNGQNLLTFTKNKFIDPESTEFGNSMDTSSANSGRNYPTLKYFGGGIEIQF

SEQ ID NO: 969 - protein, 488 aa, Shewanella sp.
MINRQLSRLLLCSILGSTTLISGCALVRKDSAPHQQLKPEQIKLADDIHLASSGWPQAQWWKQLNDPQLDALIQRTLSGSHTLAEAKLREEKAQSQADLLDAGSQLQVAALGMLNRQRVSANGFLSPYSMDAPALGMDGPYYTEATVGLFAGLDLDLWGVHRSAVAAAIGAHNAALAETAAVELSLATGVAQLYYSMQASYQMLDLLEQTHDVIDYAVKAHQSKVAHGLEAQVPFHGARAQILAVDKQIVAVKGQITETRESLRALIGAGASDMPEIRPVALPQVQTGIPATLSYELLARRPDLQAMRWYVQASLDQVDSARALFYPSFDIKAFFGLDSIHLHTLFKKTSRQFNFIPGLKLPLFDGGRLNANLEGTRAASNMMIERYNQSVLNAVRDVAVNGTRLQTLNDEREMQAERVEATRFTQRAAEAAYQRGLTSRLQATEARLPVLAEEMSLLMLDSRRVIQSIQLMKSLGGGYQAGPVVEKK

SEQ ID NO: 970 - protein, 733 aa, Shewanella sp.
MSRCIQSRATPPRRASASVAFAMMTCAAAPACADEGEPRHAPHLSPIFVHGERDAGSRVDRSGSAKYATPLLDVPQTITVVPRVVLDEQQALSLREALSNVAGITFNAGEGGGGSGDMFNIRGFSANANVQLDGLRDSAQNNRSDLFNIEAVEVIKGPNSVFGGAGTTGGSVNLITKTPKAGASTEAGTMLGTSGYRRVTLDANRPLPGTDDRAAFRLNAMAHVNEVPGRDDVRKRRWGVAPSLAFGLGMPTRVTLGYFHQYDNNLPDYGLPAHNGQVLAGVSRDSYFGWRNLDRERITSDAFTVKAEHDVSSGLKVQNLSRYAHLNRDTVISASHVNLQGLPPGRYKPAGPQGYGRDASTTMWANQTNVTSEFATLGIGHTLVTGFEISRETYGRTTYSYGLNRFYPADGFALAAPPGVWQGPARRQDSARNDTALVVKALYAFDTISLGRNWDVDVGLRHDWIDGWAESTAAGKPTERADSDDRHLSTRAALVFKPTDNGRAYFAYGTSFNPSAEFLVTTGSGVSAATGALAPEKNESFELGAKWEGLAGIALNGALFQTEKKNARERMADGSYALVGRQRVRGVELGAAGKVTPRWDLFANYTYLASVTLSSPATPRREGQALGNTPRHAFNVWTTYRLPAGWTMGYGSHFVGRRNVTSQGDGKLGAYWVHSLMAGYEVSRRLRFQLNVDNLFDRAYVERVRQVSGSESRSSAVEFGDGRSAMLSAVYTF

SEQ ID NO: 971 - protein, 188 aa, Shewanella sp.
MKKLSLVAGSLLSILVAGQALAATDTTGFYVGGALNRVTVDVLDDAETGTGFGVYGGYNFNEWFGLEANLFATGDLGDKDVDISAGALTFTPKFTLQINDMFSAYAKVGVASMAMNVDGDGFDEDFTGFGWTYGVGVNAAVTERLNVRLSYDVTSGDLDADHHYVNYVNVKDIDTDIKQLAIGVHYQF

SEQ ID NO: 972 - protein, 723 aa, Shewanella sp.
MTFKTSFVALAVFAALTQSAVAQEAPDTGTNKNKDIEKITVTASRMDKSPSSIPNTVTIIDRVQLEEQFRTTKDLSTIIGNLAPSFSPSRQKMSNTGETLRGRPPLIMIDGVPQSNPLRSGGRSGQTIDPAMIERIEIIHGANAMHGLGAQGGIINYITKKPTGDNQHVVSFDVTVPDSLKSNGVSFGASYAFSGESELIDMLGSVSYRNNGVYYDANHDVIGVDTTQGESMDSQSKDFFIKLGHNFAESRLELMVNHYNMENNGDWMPVKGDITTGKPTGAIEEKQPWEAANNQVTTTSLTYTHENIAGQQLSIQLFNQDFEAVYGGGCNKTFYDPAFANNDNLVQCEGPKGESWYYEQSRNSSVKWGLKTSLIAKNIADTGIDAAYGIDLFRDTTEQDLVQTGLSWVPESTYDNFAPYLQLDYDLITDLTLSTGVRYEHAKLNVDDYKTLYGAGNKQIEGGEASFDETLFNIGISYKITPDIRVYTSYNQGFGMPDIGRILRDGNSFPGANPSISDSLSLAPIVTDNVEFGADYQGEYLSAKIAYYRSATDYGARLALNSDGFYDVKREKSVIDGIEANITAYLTSNDDLGMNLAIQRGEYDSNDDNNTDTDLDGANISPNRINLFWTHNFDNEMSTRVQANYFMDRDFEDATGEKYAEFNGYTTVDASFSMPLYTGTLTLGVQNLFNKDYFNYYSQTMGTNDRYFKGMGRTATIGYTVAF

SEQ ID NO: 973 - protein, 745 aa, Shewanella sp.
MPKSIGPISLVTAAVICQLGLVNVATAAENDMERMVVSATRSPTQISDLSSTVWIIDEASIREQTDSGKGIKEMLAALVPSMDVSSQGRTNFGQNIRGRAMVVLIDGVSMNTSRSISRQLDSIDPFNIARIEVLAGASAIYGGGALGGAINIVTKKAADSSDTFEAEAGFKSGFNSSDDVDYRTALAVTGGSDSLKGRFSTAWQENGQWFDGSSNPVILDITQTGMQYTQGYDLMANMDWQLANDANLSAMAQYYRNGSDDEHGLYMGENFSGVTGDASVLETRKGLDADRSPATERTLLNLSYSQNEFLGQTLYLQGFYRKENLDFHPFPYVNETSGVYNFSASAQNTNIYGLKAVVESKPVDSLTLTWGLDWDKESFDSSQMSFDLDAANQHGGLVMRELFTTGRYVDFSVESIAAFVQSSWEMNSFLVLNAGYRYQHMENSVDDFIGYNQQVAIASGKAKGADAIKGGSTDYNIGLVNLGLVAKLSQDQQLWLAYSQGFELPDLSKYYGRGTYKADADGYLKLQNSININDTRLDGIKTDSMELGWRYLADRWQAQASVYYAVSDKVIEVNSKDLTINVKDQDKRSYGLEAQLNFDISSDWQVGTNLHLVRSEVKDENNWVDETVTYASPSKATAFIGWRGDTQKIRLQAEHSFSAESDYRFKTNDGLASELDSYTTLDLLGSIDLPVGTLSYGIENLLDKDYSTLWGQRAVYFYSPTYGPESMFDYHGRGRTFALNYQLSW

SEQ ID NO: 974 - protein, 906 aa, Shewanella sp.
MQYLTFIALACTSLTHVAAAAQSTVLDEASAAEKTPAKVIATSHYQQCKKNTDTCSENIEIIEVTGQRPNPISVSSQGVYTLDRKMLRDYRFGNGNLNDVLGVLPGVQYGETAYAADQVSNIKPSEVSLAGAQGNATGYLIDGLSNNSNLNNDSANFDKNLAQDVSGHTQAVFLNLDLIDHLEVYDSNIPAKYGNFTGGLVKAETRKAGDKLQFGINYRQTSDDWVEYHKLYAPDFSGDNELNSAIFNKRDLSTYIATPLTDKLGFIGQFQYTQSQESLQQLGQTRLQQQTNYNGLVKLDYAATANDDFSFSFLFAPYKGDYFDVNAKNSDYNIEGGGNNASLTWQADRSWAYIKTQLGYSDSRNSKNTSSIRYAWLNIPGTDWGNIDGSITSLEGGFGDIEKRQQTVSLKQDFELASKTWLGAYSNLSFGYELAQQNSVFDRLEDAIVYNGAIVSPQIDCAGYALDCIETRLYQSVADIEAKLGHALDLSNPDDFLIYQNNFATTGQYFQYRQITPKSTASVKLNQLSAYVENEFEWQNYSLNLGVRYDYNDFLKNHNFAPRLRGSVSVFNDQGKIVLGANRYYADDSISYKLNQAMQPSYTEVRAIYQQQPQQWQAQLSNRGYRYVYSDLKTPFSDELSAAYRHQLLGGTLELKWLYREQQDAVNRVKGTNDVGEATLFGANSGSSRYQRYTLSWMATYNNQHVEFNVSHATNTTSREQFDGEPRSFNGDGDAFLDFSYDDNELVFLRSDHYDIAGSTNKANYYLVTRHDMELEKQDFNRPVIANLSWGGQWDNWTLSAYARYNGGQDAIYATSKTQSIKEASNICDGCAPNRREYPVYRIEKRPAFWLLNTSVKYTVAVANNYQITLSFEAENILNKRTYQISPYNTGIELGRRFWLGANINY

SEQ ID NO: 975 - protein, 730 aa, Shewanella sp.
MKFAKRRNGRVTLGAHVLGSLTIGMAASAIPAMAAEQAQVVDKKVEHIEVNGEYLGYNTRKVQSGKFTEDLLNTAKTVTVINQDLIKDMGAQSFTDALRATPGITLGTGEGGNPYGDRPFIRGYDAQSSTFINGMRNVGSQSRETFNIEQIEVLKGPSSVYNGRGAVGGSINIVTKKAQAEDFINADVAVGTDALKRANVDINHVITDEAAVRVNMMAHDADTPGRDEVTGNRWGVAPSVTFGLTTPTKVTLEYYHFENHDIPDYGIPYDQATGKPADVDPDNFYGLLSRDFRDTMDDTASVLISHDFNNDMQFTSTSIYSRNSNYYIVTNPDDTAGNVAKGYVWRNTKSRHSVTKTLATQLQLSGEATLAGFTNRFAVGTELSNEHTSNLSYTVDTGNGRNGGCNEAMLANYNCTLLDNPNPHDPWIGKIALGTDATVTETDTRSIYGFNTIELTEAWMVNAGIRWDDYSTSAKNSTSQFGNDADFFNYQLSVLYKPAENGSIYAAWGTSSNPPGTSNGDGADRLGSTNADLEPEDTESYELGTKWDLWEGRLSLNGSVFQIEKNNARVATSGDRNAPQENVGEQKVKGFEIGFSGDFTEDWHGFGGYTYLDATLESNGYNAALNGNRFPNTAKNSLSLFTTYDITEQLTVGTGAYYMDKVYGNTANTLSIPSYWRFDLTSSYKISEFMTLRLNVQNLTDERYYDKAYTAHFANMAPGRLVMLSADMHF

SEQ ID NO: 976 - protein, 369 aa, Shewanella sp.
MKKTFISASVASVLALASFGALAEGPSFYGRLELALTNTETGATLQSGTNGVDTKNYADENNGGTYLENNFSLLGVKGSEKIANGYDVVYQMEFQVENTSGSGDVFKARNTFLGLKTNAGTVLVGRNDTVFKQAEGNVDVFGNTNADIDRLVGAQTRSADGVWYYSPKIADLVTLNATYLFDDNDTTAKTNESLYALSATLGDSKFKDQNYYLAVAYNKGIAGIDAYRGVAQVKFGDFKVGGLFQNSESVTNSSVDGNTYFVNVVYTLNGVNLKAEYGVDEAGFGNYYNNVNKYTEVQIIDGKPTVVAKSTTGTDISVQNFNVGADYRFSKSTMVYGQYSMYRGDHVVAGNKVDLQDDNVFSVGVRYDF

SEQ ID NO: 977 - protein, 1146 aa, Shewanella sp.
MKKNLLQKWYVHQQLELTHIIRIMKLSVFFIFVFLFQLQAGNVKSQEVRVTLSKSSLTFGELMREIEKQTNYLFMYRDAEIDLSQKIEVKNTSATVKEILTTALRNKKLTYKFSNNYISLYVDKEKAPETMVTQQERKIKIKGVVIDQVGEPIIGANISLKGQPGTGDITDIEGNFTLEVPEKAVLVISYIGYLTQEIPVNGKASFNIQMKEDTKTLDEVVVVGYGSQKKQTVTASASTLKVSSLKNVPTANLASSLGGRVSGVLIQQTGGEAGYDDPTIIIRGSSSPTSSSPLIVVDGIIGRSMSQLDPSEIESMTVLKDASAVAPYGARGANGVILITTKRGKSGKAQVDYNFKIGFGTPTRMPEIASSYDHARFMNDAWRNKEMDLGEDPGMYGIYTEEELQKFRDGSDPYGYPNTDWNKEVLLPRAWQQMHSLTASGGSDKVKYFAGFGYVKQDALYGDTRTNKSTSGFNRYNARVNIDANIVDKYLNLSADMAYRQEDRNSIAGSTSDVFNNMHRNPQTDPGRFPDGNLGKVSLGVNPIGLATEGGWVKDRKSVLNTRFMLDFNVPGLEGLNLKGIFSYDKIFNSIKRWTTPVDFYVWNKITGEYDGHSPNREGAELKQTYSTSQAMTFEFQAAYNKTIAQDHQLGALFVFSRSEGADENFWASRTKYRIYSIQQLFAGPDKDKDNSGSASETGKVGSVFRLTYNYKEKYMLEANGRLDGSEKFPKSKRYGFFPSVSAAWRISAEPFMEPFSGVLSNLKLRTSWGRAGTDNIGQFQYMSAYGTGGDAVFGGQNPEIAPGYTETRFPNPNITWETSEMFNIGIDASFFNGKLNLEADWFYKKTNDILRERTDMPAILGYKLPAANVGKVDNRGIDLNITHRNHLRDFNYSIAGNLTWARNKVIDLLEPAGEKNNPRQRSTGHSMSQYFGYEALGLFQSDEEANNWPQPQFGKAKAGDIKYKDQNGDGIIDAEDEIAIGRSNYPELVYGLNLNAEWKGFDITFFFQGAALADFYYNGYLAFPYIEGRGGALLEHHIGNTWTPENPKAEFPRLYYGGNANNQLFSSFWMRNGSYLRLKNVEIGYDFKKLLLSKVSEIQGLRLYFSGSNLLTWSQIKYFDPELRSTDGSAYPQMKTFVFGANITF

SEQ ID NO: 978 - protein, 861 aa, Shewanella sp.
MKRPQILPSACAIAIAMAFAPSISYAADNGADKVERIEVTGSRIKRTDIEGPSPIQSIGKEDIANMGFDNLQQLLERMPANGAGAFSTRGNSQDSTANGGASISLRGLGPDATLVLINGRRVAASAFAEGITNSFVDINNIPVSAIERIDILKDGASAIYGSDAIAGVVNIVLKKDIEGIEVNLGYGDTPGTGYDETTASVVWGVKSEKGSASVILDYFKNDTLAATDLGRFGTADQSSYGGEDFRSSRGFPGYFYVDGVKTIDPSCPPDRATASGSCLFDYGPYNLVLPAAERIGAIGQFDYHFNDDLTAFLELAAQHNSSIAGGAPTPLDEDAALTVPGTHPNNPWGKDIEIGRFRTVDAGARRWDIESDTLRLVAGLRGTIKEWDWEASVQRGRSESTQTGDRTQGWVRTDYLQAEIDAGRYNPFGGTMNSQDVIDAITTSLVRQGLSSMTSYAANISGQAFTLADRDIMMAAGVEYREESVSDVPDEQFQRGLIFGTEAVSAAASRDQYAGYVEFSIPVTDNFELQLAGRYDHYSDFGSTTNPKVAFQWGITDELTSRGSWSTGFRAPSLAQIGLGPSRESSFFIDTYRCAADGVDCEALDYNTEFQGNSELDAEESETWNLGLIWAPSQKFDIGFDVYSITQDNKIDKQPLGDIYTANCNDQNSTVCERLAPQAGQTLGPISIIHSSFINLSSQDVQGVDLSTHYGLELDSFGDLKFGLEYSYLHNFEKDGLDYTGEYKFPQHRWLLTTNWTMDNFAANVNLSYIGEFEDTPDIDFDGVLDFETNKSRMVDAQLLVDMSGSYRFNEMFKLTLGVNNLFDEEPPFAIGDGDTDLYGYVISVHNPMGRYIYTKLTMNF

SEQ ID NO: 979 - protein, 706 aa, Shewanella sp.
MGKANAFTAPITVVNYDEQALNNTEARTLVDAVAKKDASVWQFGGESNTLTGLYFRGYQLDSRQFSVNGLAGMYGTQGTASVQVGSAQLIKGASTAVNGMDPEGAVSGSVNIETKKAADEGNRKIGLGWFSNNRAQGTFDLGQRFGENKAFGVRANGKLRHGDTPRHGYSEDNKEFAVNADYRGETLRVAFDSIYAKRKTNGGRARMQDIQNAGGRLFGAPDGKTNLLPSWNWQNTAGQTNMLTFEWDAFDNAQITGGIGYNKARYYGTLISPTVCLNATSTCTDMQNTNASGKVTARNYDYNTGTARLTDQYFRTLSMNLSARGEFETGPVTHNWSTAFDRVIRQRKTINGSGNGNSKIEVKANENIANQLASFKADYPNSWAKTANLDANIKVNSLALSDTLGFVDNKYRLTLGGRFQAVEYTDKKKSQSGDAKRFSPMLMAAWVSQPDLVVYGNYMEDLERADIKTDDSGETTMAKPRVSRQFEVGVRKNWGNFVTTLNAFQIKRPGYWRGQTTTNAKTKKKTLTYGDNSDFARYKAQGGAAGDEQGMERSRGIEFNTYANLLNNTLRPTLGLMYLQSTVKNYPNAADNLVNGVQVANPRVIAKAGLEWDTPFAKGLTLNGNVSYFGKSYQDTKKQYAFPSYTLVDVGARYKTKLGKNTLTVSSSVENLFNKNYWQVQRGQFDRSFAVVGMPRTYWLKAELDF

SEQ ID NO: 980 - protein, 683 aa, Shewanella sp.
MSSRYFVMSLTALAVSCVYANSLNANPLYSQTLDLAKLNDQYHSTDDAMQLSNLNSLTLLRADHSGNSANISMRSATQGVAVMQDRVYFSPAPYSAPQLQLLPHLLLQQSVTTTPLANMAVGGQGSFGVVDYQSLNIIERSQSGSVQIEGTTDSDVNAGMRWGVNQKEYGALFAANYIKEQGDAIFFNGSDADRKKMDMLFKVNASSLLGARSPQQTEFTYQFIDDDSYRSLLGITAADWQQDPLLLYSATAQDKHQGRQHKYQLSHQVNLGDSKVMSDFYYQFYSQRLDQLGAFNGQNIGLGTLYDIAAFDRNPSANGADVNMLVQDNDYSAFGAQTQSINQYGEHQITYSARYHTDKAEMRFGDQTALWQADRSIVRDESNAVLAYTDDATALTSAIDSLWRWQGMQIKLGLTYEHVSVNREVSLAFAGLDEADFSDSDWMPQLGVLYDAGDWRFSTDIRRAWAAASAGNLTQDAQESLHYQVSAQYASDGIKADLRAYVQEFDNLHVDCDSYSMCVDSRLLTQENIPDVLTYGVEFGLGYRSMLGELELPLELSYQYLSAEYQTSTCTDIQGCVLEGDKLAWLPEHQLQLSAGIEYAQYQLNLVAAYQSERDFSQYGSELQRVDGQWRADIAANYDIDKHHRVYFRLENLFDESLVTTVSNSGIRTENGRISYLGYQWRF

SEQ ID NO: 981 - protein, 758 aa, Shewanella sp.
MRFNKVAKLVSLACGGVVALSVPVNAAENDEDTVERIEVTGSRIKRVDMEGASPVTTITAEDMANAGFSTVGDALRASTLNSFGSYGGTSNNSWSSQATIALKGADPSHTLILLDGKRMAKSPVLGGGATNINTIPTDAVERIEILSDGASAIYGTDVIAGVINIILKKDFEGIEVKVRAEEPDAEGGGDNHSASFTGGLSSDKGNLMFTIEHFKKSGITFAERPYTAAHVKNGQDPSDYRSWIGLSQTGRTLDMGPNGGWEYQTPFTNSDLNCADVYGSNFTGSLSDRAYPGETSCAYDYTKAAYNDVDQERTSTLINYTYSLSDDIELTARAYWASNKTTDVSAPIPGYIQFPQAMPAYTTAEGLDLRAVPEGGAMLYRFDTAGNRVRESTDNIYDFLIGLDGTTDSFDWNASVSYNKYDVFKWGTGYQLIGATTDLVGAWDDDTNSFEGWDPRDPNSEMPGGATANSDARLTSSALEIDGGLSFELFELAGGSTGLYVGASYREEKLDSQVDALDEAGLIAGGSGERDVKAIFMEMAFPVLDNLELNIAARYDEYSDFGGTFNPQVSVRYNVLEPLLIRASWGAGFRAPTLEDLNQSTSVGYNNVTNYLKCYEDGMGIDGCDIVDNIPVSIGRNENLGPEESESYNLGMVWDITDNFNMSVDYWSLETEGLIGSLNNSEITRTQAELWAADAAGQPRPDVSAIYPGTSISQNGAGKLTRMDNVLQNIGLSERQGVDTKFASTFETEVGDFKLGLA

SEQ ID NO: 982 - protein, 972 aa, Shewanella sp.
MLFHTSLTDPLHNRHRRLFAGKSKRDILFATWISLSFHRGFPTLTENTMRHLFSYLFICLTTLACHGFAAPGIAQAETTGSSSGTTITGRVVDEVDGLPLPGANISVKGTSKGSITGQDGRYRLENVSGATAVIEASYIGYVKSDIPITLSPGKAVIKNIRLKPGVLISEEITVVGELLKGQAKALNQQKNDVNVTNVVASDQIGKFPDSNIGDALKRIPGISVFNDQGEARFGHVRGTEPRFNSVTVNGERIPSAEAENRTIQLDLVPSDMIQTIEVTKALTPDMDADAIGGSINLVTKIPAEERFSLSAGGGLNFLDGTGGERYQFGGTYGNRFADEKLGVLFSLSYDNNDFGSDNIEGEWDAGNDGIEGIKEFQVRKYDVQRIRRSFSGALDYRFNENHILKFNGIYNWRDDFENRYRIKYKDLDEDFATVERETKGGTENDARLEDQRMMSFTLGGEHDFGKLDLDWQASYSKASEDRPNERYINFRAKNQPFTVDISNPEKPFVTVLNPDVSGGISDSEDWKLKELTEEHQYTEDIDKNFGLNFNYAATDALAFKFGGKIRDKKKKRDNDFYEYEPVDEDAFRDEVFANLKNETKDHFLPGNKYKSGVFVSNKFLGGLDLDGDDFDKELVKEGLAGNFDAKEQIKAVYAMATWDISDNTTLLGGARLEHTRNEYDAFKYFADEDSLAAVTGKPSDYTNVLPYVHLRYNVNDQTNIKLAYTHSLARPNYFDLAPYQEIVAEDEEIKLGNPALEPTLSKNVDLMIEHYLSDIGILSAGVFYKSISDFIVTKKEDVDYSGDTFEQFQPVNAGDGTLMGIETAAQFQLPFIPGLGLYLNYTYTHSEIDNFDIKGREGDDLPLPGNPEHTANASIAYENGPFNIRLSGNYHSDFIDAEEGSIGENKWEDRYYDSSFTLDLNGGYRMSDIVQLYFEVSNLTNQPLRFYQGEKQYLAQEEWYDRRFLVGVKADF

SEQ ID NO: 983 - protein, 286 aa, Shewanella sp.
MKNVKTLALAATAVAAMSAPTFAADRTDLRSGDYSWMQFNAMYAVNELPRSDADDGGHDYLEMEFGGRAGIVDLYGYVDVFNLTNSSSGDKGAGKSKMFMKFAPRFSIDAMTGWDLSAGPIQEVYFSTLFNWGGGAISGVDADGNEYGGDVNMSFWGLGADVMVPWLGKTGMNLYATYDMNAKDWNGYQFSMNWFKPVMNFDNGSFVSFQGYVDYQFGADAVDDMFVPTTSSGGAAYFGLHWHSENYALGYGLKAYQDVYLVKDNGGIVGLESTGFAHYFTATYKF

SEQ ID NO: 984 - protein, 431 aa, Shewanella sp.
MKSFNKTLLAVAVALASSQTFASGFQLNSQSATGMGRAFAGDAVIADNASVLSRNPAAMALFDKDAISFGLTYADITVDVKDVNFGGGAYDLGSIDDAGSSKVIPNIFYIHPIDDKFAVGFAAFSNFGTGTDASSLSKNLPAGSPAPFDLLGETEVTTVNFNASVSYRINDMFSIGAGVDAIYGEGRLTRNMGTTPLVDVDADGWAFGGIVGATIELDKDNRFGISYRFSPTVNVEGDINTVSMTTIPGVGAVPVTTNFDSLDVPLADIFQVAGFHQITPKFALHYTAQHTQWGNFDQITAKDGTATIAAVGVTKPVGDVALKEYQWKDSWLFSLGGTYTINEQFTVRAGYMHDQGVVDEISSISFPDSDRNWYTAGMSYHINPQNTVDFGIAYIKGEEVHLIENSALTGPVNAVTESSGMYYSVQYSYQF

SEQ ID NO: 985 - protein, 675 aa, Shewanella sp.
MKKKLLAVLIPLAFSAHAQETEQLEAVSVSADWLGAATPEAAKKHPGARTVVTEQELAESGARTVEDALRTVPGVRVLDESGTGILPNIGVRGLSPLRSEQVLVLVDGMPITLAPYGQTGLSLFPLTLNAVEAIDVARGGVAVHYGPNNVGGVINFVTKRIPRKPAFTAKETLSIASSGNLLSDTYLRAGGFVSERLGLQAQANLIEGEAERDHSSTSVQNLMLDADWFLTDSANLRAGLQYYKTENDMPGALTPASYEADREQSTRPLDRFDGDTLRGHVTYSQAFANGAELSWANFAHRSNRQFFFGNSSNADTPSTNEMSSPREFWVYGSEPRLTFDIDAGVKQKISLGARYLREEVDYVVDSRTLATNAYAVTRDWRFENDAVAAYLSDTFFLLDDRLKVTPGVRHETVDLYYRNNLTGAETRDTTKDWLPGIDIGYQASDAVFLFANYHKSLRPVQFTQITFGGDLDAERAENYEAGIRVAPTANVDTSLTAFRFDFDNKLEFVSQAVGFRNLGEARHQGVEAEVAWRPAAVRGLELKTAYTYVDTEQRSGQFEGNELPLAPHHQLNLQGNYRSGDWNWNLNGLYQSASFSDGANTVDENATGSVGRIPAYSVWNAQVTRDFRWNGTKMKAALALNNLFDRDYYFRGVDFSQGRMPAPGRAALLTLQMDM

SEQ ID NO: 986 - protein, 737 aa, Shewanella sp.
MEFKIIIMKTFPLNRLTAHCQLAITRPELILCSAILSMPYAYADASDTQKKSTKDIEIINVVGAKDLHDNRYKTQAMNTATGLDLSYLETPQSVTSVTSQMMHDQQLNSVIEAMTSVAGINARPMDNDRYSISSRGIAVTSILYDGVPTTYDTRFNYGDNLIDTAIYERVEIVRGATGLMTGAGNPSAAINLIRKRPTQEFMGSTSVSVGSWNNLRGMVDLSSGLNDSGSIRGRVVAAYQDKESFQDRYEQQRTTLYGIFETDITDSTLLTLGVDYQDTTPEATMSGGLPLFHSDGSRTNYDRATSTAPDWASAHTQGLNTFASLEHRFDNGWELKGTYSYGDNSLKYNVLWATGYPDPVTNLGATAGSIAYVDGSRTQHNLDLRAQGMFALFGQEHQLTFGWTGQRQEFANPYYYPTAAVPPLGDFRDPNFQYPKPQWKETHTTGSFGETEQSAAYVATQLNLTDALALLAGLRLNQWQTDQDNFGSMYDFKVDNELTTYFGLTYALGEQYSLYASYTDIFAPQTLQRIDASYIDPVKGKNYEAGIKASLMDESLDMSLSVFEIRQDNVGERTGDVLPGTTIPVYREVNGTKTQGFEFESTGKITDDWNIYFGYTQFSTDDPKGNRINTSSPRQQLKLFTTYTFSGNWNKLQLGAGVNWQSRVYQTVNSPLGRVEVEQDSYALASLMASYAFTEQLKLSANVHNALDKTYYSQVGQFSQYQYGTPRSVSVNVDYRF

SEQ ID NO: 987 - protein, 99 aa, Shewanella sp.
MDIGASTWFASNNLNPFNQVKSRTIFQLQGKFGIRWNREKYDNTGRYLLGSSVELGVKVPAFKVNYYSDNYGDKLDYKRVVSVYLNYTYNFKTNFKNKH

SEQ ID NO: 988 - protein, 883 aa, Shewanella sp.
MRANSTLAKAVRFALIGGATTAALSSTAVYAAEENAKVERIEVTGSRIQRTDMESALPVTVLSAEDIAKTGLSDVSAVLAQMPFNTAGSFISDAGSSASNHASSGMRGLGSNRTLTLINGRRIAPSATFGGDSTNLNLIPMDAIERIEILRDGASAIYGSDAIGGVINIILKKTFDGLAFDAKFGSPTQGGRDEKSASVTFGNTSDKSNSLVIIEHKQFDPLQGGQRPHLTANWDKKYGRSGLYAPEGTYRPVESRPVKGADGTFGTPVYTGLQVPGKDCPADRIVTSKDGSACGFNQFDGTDYLPDQTKDSVFSNMTYRITDELEWFGQAIVMRDKSSTSSTALWTPNLYMAADNPLNPTFGTANASEVQAYHRLKGVADRKTEFDSNVVDIVTGLNLELDAGSLSWYVQYSDQIVNIETDSYVFEDKLQEAVDKGLYNPFVEGGNATQETLDTFLHTATRKATSNTTGTGLSWAALAPISLPGGDLGYAVGMEYQKIEYKDTRDAQQAAGNVLGTYGGDSAGDRSYKAAFVELELPVLDHLNVKLASRYDQYSLPDVGQLSSSVNVRYEALDNLVLRASYGQGFRAPSLDDLLGKPATSYDRITDTTLCQSLPDDQKDGNPACEDNQYLRKSSGNKELDPEKSAQYSFGAVWNITENIDLVVDYYNIEITDQVSYIDAQTIVDLEAIGGLGAYDPNYIYVKRKDDGTIDEIGAGNINMDGVQTSGLDVSFTSNFDFAEFGAFKFAVEGTYALEYTEQASPIAKRYDVLGTKGYPPLRFNTTFSYAIDDFSASLIAKYIDSYDGETPQQQEVGTNKQDFSSFTTWDLTLNYDFDSYGKVTVGARNLFDAMPTVNYSLGYPGYDTDTHNIVGRVVFAGYKVKF

SEQ ID NO: 989 - protein, 822 aa, Shewanella sp.
MPAQHRLTPLTKALLRQAFSPKLASRTLGLALTLPLMAQVQAQEIHFNIVSQSMSAALQEFGRQANMQVLYNPDDVQGKRSNALSGSYSPERAIAAMLNGTGVAYTLKDNSVTIRNHGGNGSLELGTSTISGQGLGTTTEDTGSYTTGAMQTASKLSLTARETPQSVTVITRQRMDDQNMRSLEDVLKATPGISITKDGPQRPTFYSRGFAVENLMTDGLPNDLTHYLSRDMNSSADMAIFDHVEVVRGATGMMQGAGNPSAAINMVRKRPTATPRVTVTGSAGSWDDYRTEIDASNALNESGTLRGRVVAAYQSKGSFQDFVSSERNVFYGITEADLNEDTTFTFGASNQSGRNNTSWGGLPVAADGSDLHLKRSTYLGSKWEYWDQNNTTAFSRLEYRFANSWKMLLSASKSWSDLNMLGSIPERMGANYDEFGQNIGRYDYEDQQNSYDGYVTGPFSLFGRTHELVVGASRRDLTFKGKGLPIDLETHTNIYKPSGIPKPDMSANPWTQRRTSQLEGTYVTTRLSITDDLKLILGGRLDWYDYDVTTTWNGKASASSLPNKVTRHLTRYAGAIYDLDQNHSVYVSYTDIFKPQTELDTSNGALKPIEGKNYELGIKGEYFDGKLNASAAIFRIDQENRAKVLNPNQCNPVGSTCYEAAGQVRSEGIELEINGTLAPGWELGAGYTYASVKYTKDSNEANVGRLFDTDIPRSVFKAFTTYQLPGDLNRWTIGGGIYGQNTIYNKGTNDYLSTFDYRIEQKSYALVDLMTSYKASENVNIRLNVNNLFDKRYYQSIGTNTDYGTSLYGDPRNAMVTVSWSL

SEQ ID NO: 990 - protein, 891 aa, Shewanella sp.
MTTQTTVARAVRFSLLALVSTSIAPIAMAAEQGAVDANKVERIAVTGSRIQRTDMETSSPVTVISRAEIDASGTATVSDFVRNLSQNSFGSFREASGFGSGQSSQSTVSMRGLGSQRTLVLIDGRRMGSSVAFGGGTQNLNVVPMAAIERIEVLRDGASAVYGSDAVAGVINIITKKEFEGVEFDADLGATQHGGAEKSNARFTFGVNSEKTNMVASVEYYNRAALYDADRDYSDTLYSAHGWPGTGSYVDKTKPILDADGKPTGKYQTVSFADKRCGEGNSLVTGPDGNQTCSYNAAAESATMAAQERFSTFVKVDHELTEDINWTNRLMMSRVWTEGQYAAAPNSYSPKLRWTKENSDIYLATVNKYGNDYLKNQLKYDAKGNLIGGDTINLKMRTTPLGPRVTNVEDTDINFLTALEGHSDILGGTAWNLGAQWIRSDVTTIQTGLANANMIQEFLDNGKLDYFAAGTGYVEGSNELQLQEAAHTGIFTGRVQTYGIDGGASFDLFELPAGTVPLAIGFEFMRTEYDKTNDAGSNLGNIIGTSGGDNIQGKSREVLSFSAETMFPIIDGLDLELSARFDDYSDFGSTFNPKVGLSYRPVDSLLVRASYGTGFRAPTFDDLYATASETYLWARDWTQCPGNPNGCVQEQFKAQYQGNDDLEPEESTSLSLGLVWNVTDALDFELSYYDIQIDNVISTMSTQDVLNQERDGFDMSNVLFRDPVTGKIDYVVLQKMNLGELKTSGIDFNIRYLLETSVGEFRFGAETNYVLSWESKDGPYSELEDIIGDVGQPQFRANLSTTWTQGEWEASLFARYTDSQEDEDYGKTPSQWLLDAQAGYNLPWNAKVNVGIRNLLDEEPAMNENLGFPGYDTYLYDPIGREYYVRYNQKF

SEQ ID NO: 991 - protein, 855 aa, Shewanella sp.
MIKRTKVASAINLAVVSSIAAGTFVASSAFAAEETAKVERIEVTGSRIQRQDMETASPVTVIDAAAIKAEGFTSVDQMLQVQTSMAGAAIGSTTNNGADGVAQVDLRGMGSQRTLVLLNGRRMVNSGSGADSAVDLNSIPVAMIARVEILKDGASAVYGSDAIAGVVNIITKKDFDGFQLDFNGSGTDKGDGQNGDVSALYGFNTDGGNYTFGAAYSDRRGVIQSDRSWTKPGASSFVPNGGLVGNVLDENGQPVLDEDGVNEKEVKINQGGNWSPLENGYNFTQDSFYQTPSERRSLFANMTQELGNDVVLTADALYTNRRSNQQLAPQPADIMLNVCGQGVDPTKCVTLDNSMATAGIVADDGMVNYRRRMNDVGPRIYSQDTDTWRLSGGLAGTLDVHTGMNWDVTYTYGKNQAKTAVANSINAKDVANSIYADQDVWFSGAELSNQIGNDVSYTEKANGGNEQQTLSAGLNGELFDLSAGAVGFAIGAEYRRESGFYNPDPIVVAGESTASQQDPTDGNYNVISIFQEVSVPFTEKLTGEFALRLDDYSTFGKATTWKIGLTYNATDELMVRTVAATGFRAPSVSELYGGNSGSFDYLTDPWGKELDEQIEVNYISDADLKPEESDSYTAGLVYSPSYLDGMSVTLDYWRFKVTNAIARANTQDGLDACFAGDTAACDQFNIGAGGDLTNLSNALTNVGSQDTSGIDFNLAYNFELIGLDWKVNNDTTYLVKFEQDGEEYTGTIDGNFGAYARVRNNFSISAGQDDWNVMYFNRFIGDMRDLSKGYNVGDILYHNISGTYHINDMATISFGVKNFTDEKPLTVSNGSDGGTVPEVYDTIGRTIYGGVTVKF

SEQ ID NO: 992 - protein, 936 aa, Shewanella sp.
MFKQTYLASAILLALASQATYAAEAEATQSPQAEETAQPSSGGKAQNNNEEMEIIQVQGIRGSLNKAVELKRQNIQVVDAIVAEDIGKFPDNNVVEALQRVTGVQVTDRASGEANVVSIRGLTDVTTTVNGRQIFTATGRSVAIADIPAALLGSVEVFKTRSSSQVASGIAGQIDIRTHKPFDFEDSKVSVAAKGIYSDQPDTIDPNFSALASNRWDTSIGEVGALVNVSYIRTNYKDESVSPGASFPYFVEDGTRITSGWNVGSAHGIDTSAGATIDGKEYLLARDAMFGNILEGERERPAFNISLQWAPNDSSEYTFEAFYNGYRNESFNSMLFSFVDSPANWQQVIQDGIEVYDGTNVVKSRTAYNAYNFTSGDHSKASTDSYVFALGGKWDITDEFQLKSEVVYQQSTYENEFTAMRGDATVYGVEIDANADDGIPSWSYLDNPDTVLDESDMTNPDLWQTADFFDNGSKDEGDSLSWTMDGSVYVDYAIFTKVQFGARYEKRGATNFSRTVSSAKKIAYTDLDPSMYMVTSGFFEGRANVPDSWAVINGYNLYKNRSEFEKLWGFEARKLQLMKTFDISEQAWAGYLMADFDTEVFGKRLDGQMGVRYEGTKADMDFFDNDAKDANGNVYTAISSDTTDSSKLLPSLVMRYWLTDDFVARFAYTETIRQPAFADLNSFTYYVPDLSKTNYGSASGGNPDLEPVTSKNYDFTLEYYFGNGNSIYGTYFRRDIEGLVYNSLSTTLYDYDGDGVDETYILSRPGNTSNGKLTGFELGAVYFPEGLPSLLDGLGAQLSGTLLDSSQDIPEYNTGTGERIGVTTRDMFGVSDESYSAVLIYDKDFFSARMSYTWRSEFLNAYDAPNFAMPRGIYRKPEQSLDFQLSYNISDDLVVSFDATNLLDDVYQEYYEDSTLFNRTNNIFTRTFALGVRYSF

SEQ ID NO: 993 - protein, 703 aa, Shewanella sp.
MQSRPAAPRPCSALSRALLASTILVPALSLTTAAAAQDVLPEIVVSATATRTSNAIVGTSSTVITAEDIARSPAQTVQDIIAQTPGVQSTSLYGGVNGTGSSVDLRGFGATATSNTLFLINGRRLNDLDLQGIDLSSLPLQSIERIEITRGGSGAVLYGDNAVGGVINIVTKTGAGGPPATFRAEGGVGSFNQRLAAVSAAFNSGPWSTSAFANHVRTDGYRTNNALEQNNALGELRYTTSDFSAFVNISGDNQRLGLPGSRTVDPSIGLNQLQTDRRGTNTPFDYADKQGTNITAGFTKSLWDGAELIVDGGLRDKRQQAAYFGNVPLSPFSASSFDAHLQTWSITPRLSIKNAFFGLPSKILTGLDYYDATYDSDRGQYRGTPPVHVYNLSQKTLAGYWQQTIAVLPTTDFSYGGRVQSVKVEATDRLNPLAPGYFGGAQALPLDSTETQHALHVGLEHRFNDVFSVFARAARAFRTPNVDERVASGPSYDAFFNPIPGTFALKTQTSVDVEGGFRIKSGPFEMQTSVYNMDLTNEIRYDPVNFYNTNLDPTRRYGGETSSSIRLSDSLLLRSGAAYTRATFREGPFSGNDVPLVSRYTANAGVTWNVWQKYVVFDATARVWSSRFMDSDNANSQVKIPANGTVDVKLSGEVDHFFWSLSVINLFNAQYYDYAVASSFTPGRYGAYPLPGRTYLAKAGVTF

SEQ ID NO: 994 - protein, 939 aa, Shewanella sp.
MMRFKPSLLTLALVAAGASMHSYAADDVKEKDLKAKDAEIEVIQVKGFRTSVIKSLNEKRFGDTVSESISADDLGALPDQSIADALTRLPGVTAVRTGGQASGLNIRGLDGDFVFATLNGHEQVTTGGKRAIEFDQYPSELISQAAVYKTPKASLIEGGVAGTVELKTADPLKNDKDQSFNINARGSFNDRADEISDAEQYGNRLSLAYQGKFLEDTLGVAVGYAHLYQPYVASQFIGLRFNDDKKDVNGDGVTEAISEGFELQQKGGDDTRDGYMAAIHWQPSDSLSVKGDLFHSKFTSENFARGFRVKSLKNGTISDAVVENGSMTGGTVSTDGTDNFAVFVINDNDSKYSELTSGSLNLEWNNGGALTVAADVSYSKADGEFVNGGTRAVLYDDLGNEVRSAESVTYQLNGLSPADVSFANDYTNTSTLGLKEVGMWPYNQQNDLIAYKLDFNYVLDTSFVSSVDFGVRYAEREFNAQRSQAGYGFEFGKNPDNQPVLALNGDMAKVVDFGGELAGYPSFLAIDFNKAIELVNAQLAATGQSPFTPTANWSNNWTMIQSGAVNEDVLAGYVQANLDFDIGDVKVTGNLGVRVVHTDQSSTGLQQVGYGLGEAITDEQGVVSTDYIRNKVGKTYTDYLPSLNLTFHLTENDQLRFAAASVMSRPPIDKLKSGMGSWYDDSATPGYKKYNAWGNTSPLLDPFYADQYDLSYEHYFEESEGAVVVALFYKDIKSFINNFTIQPFDFEANGFIVPDTIIDNGVEFPVVKDEGQYQTAINNDKGGYIRGIELGYTQVFDFLPSPLDGLGFTGSYSYSDSEVEFTTDLSGSNLTIPLPGLSENVLNTTLFYTLDGFDTRVSMRYRSSYVSEQVAVESQLAFFDAETIVDYQASYALDNGLKFLFQINNLTDEPNKTYFGEEHQTGTIQYFGRQYFLGLTYSL

SEQ ID NO: 995 - protein, 915 aa, Shewanella sp.
MSNKFKLTAVAFSVLSTCVYAEEMLDQINVEYKLPPKQEVFKKAGATSVRENISTSTQSIDDIIRTVPGAFTNLDKSSGIVSVNVRGQTGFGRVNTMVDGISQTFFATSGDNSEKAGGTSQFGATIDPAFITSVDIQRGSFDGKAGANALVGSANFRTIGVDDVISEGRNVGALLNAGGGTNATGPNYMGAVAFRYPFSDTRTLGFMYAYSWRKSSQDFKVGGGRSIKDVDAEEVGRIVKEACKGEFLCKEDEKRKLYGLQPYDPSKLLHYPQSHLAKIEYNDKYNKAILSYRSLSTALSGRNLENKNYQLNYQLKPKENLQFELILADNTSTQTYHKGSVFNGKMLKDVLESKNSAKTTDINMHFSIPFTEKFSYEATLGANILKNKYSKNRHPRELGYYFDGGEPNSRDFCDYVGKYKNACIYHGIRSNTFQPDGEQRFKTLYFDQTFKYDIYTLKVNANRQIYKYSGATFPRDPRDRVTRYFPADPEQKTKDGYTVYVNGNSSAIVHKYGYDGAIKFGCYHYENDEEQWVDVYNCPTFYSVQKGNSRAHDNYSMSFSADFHPLFSPFVSYAKTHRVPNIKEMYFSEFGTLAIRPDLKSEKAKTIQFGINGYKNGIFSDFDALGFKVLAYQTKIRDYIINIKQECSSNSWRGADKAPTIYDCVGHLTHINYEGGKTILKTEMVDSGSGFKVPLNQLIPADSSPIVKIQGLELELNYDIGWFYANLSYARQKTNQPSSYSDSSNSVGDDSETGQYLQGFGLSKISSLPKDYGSLDLGTRLFDGKLTLGGTAKYYGKSKRARLDKADGDVILPGTFTSRKTGETFLTYVRISGTEEIKAQPIIFDFYAIYQPTENLTIKGEIQNAFDKKYINPLDANNDSANQMTYAMGVGDGYQKALNNYSKGRTFVLNVNYKF

SEQ ID NO: 996 - protein, 994 aa, Shewanella sp.
MKPYSQLTRMKRLRGYRLAIYALAATATASTGFAQDEDDEEVFTLSPFEVNASEDEGYRATNTLAGSRINTSLKDVAASISVVTEAFIEDVGAVDLNDILVYTGNTESTKNYTAAGQFGTNDNVANNPQNQNRVRGIGSADLTRDYFRSIGQNVGVDSYNVERVTINRGPNSILYGLGNPTGVVNYSTKHAILSEDSNEVGIRIGSNSDLRGTFDFNRVLADETFAIRLLGLVSDRGFEQQPSHFKDRRLNLAATYRPFENTTLKFNYEKVDQKQNHPNTITPLDHVTEWVEQGRPAWDAANDDYWNGPGYLTRVQSDTQVAIINSDGTPDHFFIGGAGDNYWAAVTQQSSGADIWTETAFSDNSVAPFHDMNLNPNIYNQDMDAFGFSWDQKLAEDLYLNVGYVKEDLSYDGLSFTRGFAIYVDNNTTLPDGTTNPHFGETYIPQRTLDSKSAGENGNEMIRATMTYELDLAGKADNKWFGRHNFTALAERQESDYLSNVFNEIREDTPSYLDASNRADSENWQITRIRYLGGTADSQATIAPVSPVLEPDGVPYTYYNWDTSSWATDTYNSMFTTKRRDLGSTVIESSGLIWQSYWLDNMIVGTAGWRKDKATAAQGTYNAIGSDGLVELGNDTEEGDPVSGNTSTFGVVAHPTEWLSLHYNESENFQPSVGQVNMYGETVAPPAGSGKDYGFSLDLMEGKMNVRFNWYEVEQTDSRLPWGDAMQLAQWELLFMDQNVMADVAAAEGVPYTRVSTLDVGDGNIVTTADVVAEGLEIDLIYNPTQNWRFMANLSQQDAVSSNIGKSVTRFLEEALPYWQGLEGGSVWDSDITYATWGYEGNPHEFFDYFPGTRTLTYNAAEGRSNPQLREWRMNAIANYTFTDGRMKGWNMGGAVRWQDEAAIGFATIQENGLVVGLDLENPFVDEATTDLDLWAGFERQIMNDKVTMGIQLNVQNVTRKDGFQAINANSDGEETGFRIEFGPTWTLQSTFTW

SEQ ID NO: 997 - protein, 811 aa, Shewanella sp.
MKSRANSAVNGSVKRWFGASALVVSGLALLPLSVALAAQAGSEQHSVLFNFAIAAKPLPQALSDFTRVTGISVVYTDEAPYNLKAPAVTGQLSAEQALQRLLGNSGFTYRRSDAHTLVLEPLPQGAGLNLGTSSITTQGVDESTSYQPPATTSVARSQALNQEIPQIINVIPAQVLRDQTPRNLDDALKNVSGITQTNTLGGTQDAVLLRGFGDNRNGSIMRDSMPVVQGRALNATAERVEVIKGPSSLLYGIQDPGGVINIVSKKPELQQSTALTVRGSTYGSGKNGSGGSLDTTGPLGDSGLAYRLVVDHEDEDYWRNFGTHRESLVAPSLAWYGERTKVLLAYEHREFLTPFDRGTAIDPKTNHPLDIPATRRLDEPFNNMEGRSDLYRFEVDHELSDDWKAHFGYSWNRETYDASQVRLTAVNANGTLTRTMDGTKNALTTDRYATVSLEGKVQLGGMQHDLVFGLDDEYRKIYRADLIRGKNTSFNYLNPVYGQQVAGTNVSAPDSDQTDLLRSDSLFFQDAIHLTDQWILVGGGRFQEYDQYAGKGRPFHANTDSNGQKFVPRAGLVYRYTDQLSFYGSYTESFKPNSSIAQLAGGSVVLDGSIAPEEAKSWELGAKLDIPGRITASAALFDITKRNVLVTTATASETVTSVAGEVHSQGLELDLTGQLTDQWSLIGSYAYTDAEVTKDTQYKGKQLQNVAKNTGSLSAVYDFGSLIGGDRLRVGAGARYVGERAGDAPNSFDLPGYTVADAFATYDTKVEGQKVKFQLNVKNLFDKTYYTSSVSKYFVSLGDARQVSLSSTLEF

SEQ ID NO: 998 - protein, 966 aa, Shewanella sp.
MHKNNFLAKSVRFALIGGVAATALNVPLVMAADEAGAEKVERIEVTGSRLKRTDLETATPVTTVTSEQIASLGVQDIGEFLQSTSVMSGSPIATTTNNGGNGDAYVELRGLGSSRTLVLINGRRPVSSDMQGIPASMIERVEILKDGASATYGADAVAGVVNIITKRDFDGVEFNAQTKQNFDVSAGEQTSFSLLAGKKFDSGHFVVNLDYVKQEEVYQGDVKDIDFFQHPWNIDDPESFAQNGLIPPGKDGANAFEAGSSIIPCGNFFLFSQTGSFTNGTCRDNGDVGSGVATLSDMRKYSGATDTYNYNPVNYLQTPYEKINFYVDGSVDLNDSVTVYSETRVNKRNSRQELAAVPFNTGTDPGYTVINPTTGIASNGVSKDNYYNPFGEDVRQARRRMIEGGRSFEQDVLRAQQVIGTEIALNDTWSLDVNYNYGIEQIQSTDFGQLYGPNLAKALGPSFEDANGNIVCGTADNPIADCVSLNLFGGAGSITQEMLDYITSPLVDTSKYTLDTFTAFLGGDIFDLPAGSVSGGFGYEYRSEKLVSQVDSGKYMGQVSGNKGQGTSGSFYVNSLFAEFRVPLLEGLPGVERLEMPVGIRYDNFNTFGGATTYQAGLEWAIFDGLLARSTYGTVFRAPTISNLYSPGGDSFNAGTDPCRINNWSNLTADAQARCMADGVPAGGLNNDDQQQLAKVGGNPELEPEEGDTLTVGVAYSPDFIEGLGLTLDYWAVDIDNVITAIDPIDSLDACYIGGLDTLCQNVNRKSDGSIDYIEARNTNLARMTAKGIDFEANYALETGIGDFSFNFVWTHFLERGENSFETTEMPDGTVEYSYGFGDVAGTFINDTSYAEDKWNFTTAYKFEDLTVTYRTNYISSMTYQDLTYWTKSDLLGEYGYLPTYKIPSVMYHDLTASYAFKTNTTVTLGVTNLFDEKPPYIETGFNANTDESTYRLFGRSWFLNLNQKF

SEQ ID NO: 999 - protein, 402 aa, Shewanella sp.
MNKTLVATALAALFLAPSVSAIEIYKDDKNAVEIGGFIDVRVINTQGETEVVNGASRINFGFSRELTHGWNAFAKLEWGVNPVGNSDIVYNNRFESVQDEFFYNRLGYAGISHDEYGTITIGKQWGAWYDVVYNTNYGFVWDGNSAGVYTFNKDDGAVNGVGRGDKVVQYRNSIGDVSFAVQAQLKNSSFYTCDIENITEEACEVEWNAGKKEAQQVTYDYTYGGSVTYKATEKLSLMAGVNRGEFDIAYGNGEQKTAVDLIYGVGATWGDFDKNGLYAAANVHKEENHDTDNIGRLIKDAYGVETLVSYKFDNGLRPFVSYNILDAGKDYVIQPNFNADPNDVFKRQFVVVGLHFVWDPNTVLYVEARKDYSDFTSADQAQEARMSLSEDDGIAIGIRYTL

SEQ ID NO: 1000 - protein, 951 aa, Shewanella sp.
MKLLTTKPAAIALAIAAALTATHSAANEIPAEQQTETKEQVQPKDTAQTQDAEVERIQVTGIRNSIKEGMFLKQNAVSVVDLVVADDIGKFPDENLAEALQRIPGVTITRNGGEGQNILVRGLGDGYNVTTLNGRKLASENAGRDFNFDTIASELVNVLAVYKSPEARLTEGGIGAIVDIQTRKPLDLEGRTIQASAKGIYESRTEDIHPHASLIIGDKTDDDSFGALVSAVYSRKTLRADTYSAEGFFDEDEGWGVDSAGVPVDTNNNGVIDPGEIYASKIPSYMYFANAQDVRERVGGTLALQWRPLDNLDINFDGLYSRYNTDGHKYQIGFVNYDEEWTPGTPLFTDAIFDDQGRVVSMNQTGDNTMVELLNLSTPRKTDTYQMGLKADWYVMPNWSITADVAYSAAQNANNGDNRFVVARGFVDGIDIDYTRGNMLPDVVISPGLSADQKYGAHYSRNSGVDVDDKITDIKLNSQYIPDEGIISKVDFGVNYVKQVKKQTEFASSNSSQFSRGGYYLTRDGYTFDNSTVFTQGEFELFQIPSSVFVPANFDNFLDGENSISPEPWPSFDYDKLLEYYRSINQEAADKSIVASLNKAGSYEVTEAVTSAYVQVNIEEEIFDLPYMLNLGLRASQTKVTSDGYAYDLAKVELDSAGQPTNNDWKNVVQTSYDDSYTNVLPSMNFKLNLQDDLLLRVSAAEVLSRPSLYALRVWAAPSFTTRENGLPTLTRGNPSVAPEKARQGDISLEWYFHESSSLSGAIFIKDIESFITDDKGPQMVEGTEYYVTQPVSGKYGAKVQGVEAAWQQSLDEYLPEPFNGLGFQLNYTYVDSSYDDPEIDAKGLPFKGMSKNSYNAVLYYEQYGLQARVAYNWRSKFLVDPEAWGGPAWIQDYGQLDASASYDIFENVSIFAEASNLTNNRYSGYVKYEDQVNYLERFGTQIALGIRGSF

SEQ ID NO: 1001 - protein, 170 aa, Shewanella sp.
MMNKTLLACAAMAVSAAAQAQPTQQQLIDDFSGPYVGAKLGVNVSSASGATNKPTHSTIFPGLVAGYGFNAGPVVLGAELFADLHHGSATFKDGGIDAKIGYPIGSLMPYARLGVTTDWPASRFNYGLGVEYMVMKNLSLFSEWTHDSTDADNTHWRNNSFTIGASYRFR

SEQ ID NO: 1002 - protein, 737 aa, Shewanella sp.
MGYQPKIGISKTMIGCLGLCALPALPLNAKEVLGAPKVEPIEILTVHGQQYRRATTMTKPGEAIISMAEIEEMQATTFAEVIDDMAGAHIDGGTRSGGERINVWGFGETEDFNVYVDNAPVGFEQYRYGSFFLDPDLIKRVEVIKGAHDVRSGNGGFGGAMYVVTKSADDFLKYDQSVGARVKASYASNNDAQSYTGTVYGRANQQLSGLLHFTRRDAQDVTLANGEAFEYSGYEQNNYLGKVDYEQGDHQLMLSVTHYLDEGRKPWANRRGPMPAISDFNIRKYGSYEQALYATTAYNTYEDNTWSANYRYSPSNPLIDTQIVVSHSANARHWIRPPIAWEKMTVSVGNFGHESWLDYKRDYIDINNLSVVGAHEITAGLQFRSLDRTSLVFNKSYEKNPEKNFGWYTPYYQPEGRQDTYAAYLRDAISLTDDLTITPSLRYDFVYSVGKPNIAPDYNDIAAGHDYSSTHHSGFSPRLGVDYQLTPNTRVNFDYAYSLQAPVVDEIYAVQYAKASITATSRDIEVERLHAFKLGLINQQTDLFADQDALSTQITVYANLGRDDIAQRRGAKSDPNQAIQSGYTNLDGYEIYGADLESQYRYQDFFSDLAVSWLQGEHRGSLKDSLGEDEYLANIAPLDIQLRVGMYITDSISVAWQGTWYDAQDNVPEGDIFNAESPSENYFLQNIYLAYEPLDSLKGLSIRLMAKNLTNQQVTPFLSDGIPAPGRDVRLSLAYEF

SEQ ID NO: 1003 - protein, 314 aa, Shewanella sp.
MMNVFCKTLLASALASATLASAYAAEPLTVYGKLNVTAQSNDEKGDSTTTIQSNASRFGVKGDFELSSSLEAFYTVEYEVDTGAATSDNFKARNQFVGLKGAFGSFSVGRNDTLLKISQGNVDQFNDLSGDLKSLFKGENRLGQTATYLSPSIGGFVFGATYAAEGDADQQAQDGFSLAAMYGDAKLKKSPFYAAIAYDSDVKGYEILRASVQGKIADLTLGGMYQQQEQTYKNALPVNTDSVNGYLFSAAYDINAVTLKAQYQDMEDLGDSWSVGADYSLGKPTKVFAFYTNRSMEASNDDDKYIAVGLEHKF

SEQ ID NO: 1004 - protein, 823 aa, Shewanella sp.
MPVLQPVFRLSLIALACLSALPHTAYADDTPSARDENVERITVYGRQNSVVKNSGLATKSDMSLMETPAAVVIVDQELINSQGVDNLQDLIRNISGVTQAGNNYGIGDNLVIRGLGANYTYDGMYGGAGLGNTFNPTRSLTNVESVEVLKGPATGLYGMGSAGGVINLIEKKPQFESKHKITTEVDQWDTYSLAIDSTGGIADDLAYRLVAKTARSEGYRDLGADRDEVFGSLKWVLSDSQDLMLSGAYIKDAIAVDSIGHPIRIYNADSVGGKTAGEVTWQDLINDPKGLGIQLTDEQRQQLAASLASGDGLTPYSFGDAGLISPMAKDNEGEELRFKLTHNIYFTDNLFLNQQLQYRDYTTGFARQTGAYNYVYWKRKIKVGGVPTDVINEDPRAPLVENGVLYPFAARRQEYRQLDAEETSWQYFADLRYDFKIGNIDNELLVNANYEDRNIRLEQFSIYDADQVIKNKQGEVIYRGSLPYIYDIRNPNWGTGKFADYDPLKTANYNKKVSAWGLGVQHVGYLGYGFTTRVGVAFNEIKQSYEHLGLDERYSASQASPTPEEDSKDNGVTYNLGLTYMPIDDLSFFVNHSKGRTAYSILGSITGENTDREDSESVSNDLGMRFKAFDDQMLASLVFFKSSRTNVPYNNPDYNAGVSGAEVPVYFYDGSEDTQGVELDLNAHLNDNWRINLNGMYQDARDKQNPNDKANYDSRQKGVPYVTASAWVTYGADWFALTSPIELSLGAKYVDDRSTHSSSFGIPDGYVPSYTLVDSAISYATDSWKLQLNINNLFNKDYYSKAMFLGGMPGEERNVKLQYSYSF

SEQ ID NO: 1005 - protein, 1007 aa, Shewanella sp.
MKKKLLTLAIQASMFGIAPSVAWAADPIEVNTVNESANRIEIEVADKQEAIEKVTVTGSRIKRDSFSLSTPLQGLDAKDIADSGIGSLADILVDQIPALAEGVSSTNSQSSVQNTGLSTIDLRNLGTDRTLTLIDGRRVVSNSYSGNYISLSTIPAAMVDKVEIITGGASAVYGSDAIAGVVNIITQQNKTGFEINARGGETTEGGGRETTVDMGYGADFNGDKGYIFASATYDKQHGLFATDRERALYESSFAYDKKQMCNAMNTVDGDQCMRDITRDDWRERSNDIVGGRFKSNSWWYDGTELKTDFKEERDGYNGYTTGLLKVPEDTLAAAVKMNYDLSDDVRANVQVQFSRNTAFRRTDAEGQDYNDSELYIDPETGLPGSIAAGSISPNNPYVPAEIAATAGKSISWDRRFQEVGPVESDNERTTLRTWAGLQGYLFDTWTWDASIGYGKFEQRQRRSNEISIRRLKYALDAEYAADGTTIQCASEEARAEGCVPVNIFGEGSISKEGADYIRANPYINTDITQFNALGFISGELFELPAGGVQSAFGIEYRRDSQAVDTDKAMRGDAITFNDVPPFEGDVTVWETFGEANLPLLRDESFAHKLDLDLSLRLADYSQKNIDLMSSYRAGILWEPIANYALRANYSRSQRAPNITELISPPRGDYDSIRDICDGVTATSTGAGHDSCRLDPGIAAVIASTGSFEAESGSKYSPNAGNENLTEETADTYTLGFTMAPAFLEGFNLAVDYYDIKVADAIGSLSNEDILAECYNSSNPYGADNEYCQVITRDTEGQITQIIQQELNLNDIVTRGVDIAMAYEWQLDGYGELSLKTNWTHVLEFSSSYYGADGLVEDDYVGELDSGIFEDRGAISLTWRNDDWRVRWSAKYKSAMVDSHERVEEWNVLKAKNQAKLDAGDDTAVANPETPAFLFYSSYITHDLSVSYTMDVSKAELRLYGGVRNIFDNQGPWVADTGDLDETGNGNYNSAYGGGVGRYAYLGAELKF

SEQ ID NO: 1006 - protein, 870 aa, Shewanella sp.
MRPSNFKKTVLATNIALLLGTAMSMSVVAAEAESAGSAADDENIEKIEVRGMRASMKASVNAKRFSNSVVDAVTAEDIGKFPDGDVGESLGRIPGVAVNRQFGQGQQVSIRGASSSLTRTLLNGHSVASTGWYDQQAIDRSFNYSLLPPEMVGAIEVYKSSQADIAEGGIGGTVIVKTRKPLDLDANSVFLSAKGDYGTISEEIDPELSGLYSWKNENESFGFLLSAASSETNYQRNGVESLLGWGDIVPTTFEQERERTAINGAFQYRPTDSLEFGLNIMSLDMKANNANTSLFVMFPDDKEAACEQTNASGTCTFYRRDGNGANPGWAQTWARKASMDSNTYDLDFKYEADSYTLEGRVGNTKSEGGTDMTANYGFWLGQPGDYAGTYDATGEVIDIDIANKSFTAEDFNGQLAPAGWSLKKQPNSDEETYAQFDITVPVELGAITSFKTGVRWAEHDVSQETFPAIVNADVTAKDASEYYSGTVSSGAGFTLPKPNLDAMLADANAAIGGFSKEGPVYKSGYGTINEENLALYLMANFESDGIRGNFGLRYISTDASSDYYQLQSDGSYADNLSTMKSSYSDVLPSVNIAFDVTSDVIIRTSASQVISRPNYGDMFASSALAGYADGTAGNEVVNTGNIALEPFKATQADLGVEWYFSPDGIVAATYFIKDISSFVTSDQILDQSIGIIDPDSGEDNWTKSTKKNGTGGQIQGIELQLQDSFENGLGYSANYTFADSDAPADNYPDEVSVFSDSSKHTVNLVGYYEMEDFSARVAYNWRSEYMIRELPGFYGNREHQDYGTVDLSANYNITDYLSVTFEVVNLLEEDSVQLGVAPDSAEVKPELKNGYPAWSFEGEARYKLGVALRF

SEQ ID NO: 1007 - protein, 370 aa, Shewanella sp.
MDLEKMMKNTLKVVLLTSMLPLAASASQELTPWYVGAGLGVNNYEHIATDNGDDNPYAWDIFAGYMFNDYFGAEIGYRDLGSADWTTGGISNDAGVKGATLGLVGVWPLGNRWSLSAEAGAMYYTLENSQHTGTTSSSYSSNDFAPYVGAGVGYNFTDNLKLQAKYRRYENLDDTDFNTIEADSNYWGLELSYRFGTPAAAAPVAAAVVAAAPVDSDNDGVYDDKDECPATPATHKVDSVGCTLYENVKKQEDVGSIQFANDSAVVKKEYYKDIERLANYMNKNPEFTVEIAGHASNVGKPEYNMVLSDKRADAVAKILVEKYGISQSRVTSNGYGITKPLVAGNSKEAHAANRRIEAIVTTTEKQPVLK

SEQ ID NO: 1008 - protein, 383 aa, Shewanella sp.
MQKKNLAVIVASLFIVPVAAHADVTIYGFLSGGIESAKATGNGNSAKDYASRTRVVDENSRIGFKGWEDLGGGTKAIWQVESSLRNFENGGTNDKGQTASFGTRNTFIGIDNGDFGKVLLGQNDSAYKMFTGSGNSALGTDVMINTTADNFGASSVNSRGEARLANSIHWFSPNWAGFKLGASWGVDEARTNGTDAKRISLGLGYTWGALNLATAWDKQYDKGVAANTTTASVNSGSNISFYSIAASYKFDSGTFIGGNYEWGNFDQVGGGQVKQDDWQIALGQDFGAASIKLAYGQLGALKNVGAGVNGNDFKAKQWILGGTYNLSKSTQLLAYATKITNNAKASANFANNPVYDTNLGNKDASLTAGNSPQAFGIGMKVSF

SEQ ID NO: 1009 - protein, 758 aa, Shewanella sp.
MKLALSSIALAVASVCSPVMAAQLQGRVTDLQGAPIAGALVSIDGGTSTSTNPQGQYQLTVADNSHIHLHISDADFKHVDRDLQITTGAMTQDISLTKTAMENIVVTASPLARSALESTTPISVLTEDQLKLNIEPTLGDTLEKLPGVQASHFGAGASRPIIRGMGGPRVQVLENGLSVGDASTVSADHAVTAEAASAQQIEILRGPGTLLYGNGAIGGVVNVVDKRYHESPVDELSGQFGTRYDTASNGRTFNGDIDGGNGQFNWHVDGTHRITDDVDIPGNAIANLPETHGKLANSNQKLDDYAARVGYTGDTGFVSVSGARTESNYGIPGRGEADAPDITIDLKKTAWQLHSGLLDPFAGFSKLRFDAGYTDYQHAEEEDGVAGTTFFNKQSEARLSLNNRPWGEWQGTMGLHAVHRDFAVEGEEALTPDSKTDTLAAFIVQERKVGDFRFELGGRLEHYRLAPDSMTLDTLNGEQTYQAEDLVDNDLTVSAGMVWDFDPAYNLGLSLTRAQRSATAEELYSYGPHDATQSFELGSQFSVENGQIITNSGNNDKEVANNIDLTLRKLEGAWTGSLSMAYNRVNNFYYEKNTGLIASDIVNGDAEGDLPVYQYTQGDAELYSLEAQASIPFNDTWSLDMFSDYTRGKLIDGGNLPLISPMRIGSTLNFDQQQWHAEIGAIGYAKQTDTAENETETAGYALVNAAVTYRLYTSAGDMLFYVKGTNLLDQDARPHTSLLKDYAPLMGRNFMLGVTYNF

SEQ ID NO: 1010 - protein, 758 aa, Shewanella sp.
MKQNTIKMSCIALAISSALAAQYAVAEDENSAGEKQATLERIEVSARKTVESLQNVPVAVTSVSAADLAENGISVMTEIQQFSPNTTLQASRGTNSTLTAFIRGVGQEDPLWGYEPGVGIYIDDVYVARPQGAVLDILDVQRIEVLRGPQGTLYGKNTIGGAVKYVTRKMSGDAELSLNATVGSYAQRDFKVAGQYPLVDDKLYFGFAVASLSRDGYGDFVTSALNNQDAENYNKDLMAGRISLEYTPTDALFMRLTYDKTEDDSNAKGGYRVLPSLLTDAPVPDSKYDSYTSMPTWNKVETEGWGLTLEYGLNDDWTLKSVTSSRESYSPTNIDFDNTSLRIFDVPAIYDDEQFSQEFQANFNGENLKLVSGLYYFKGDSCGVFDAILEEAFKVYGGLTREVSGCNNSESYAAYAQGSYDITDKLSLTLGARYTRETKDATVYNGIIFDSIYPETGWYPGYVRDEAQIQASIPKVLDDEETWSRFTPRVGVEYQLNDDMMFYASYSQGFKSGTFNPRATGPEPAVDPEVVDSFEVGVKSEWNNNLRINATAFYLNHKDRQFVTVLPGEDAADLNQRLGNIGTSTASGLELELEYAATESLHLFASLGLIDASFDEVISYDADGNQIDISDTYTITNTPDTTANVGFSYNIDTDFGSFVANGNYYYRSDYDLAVVDNLLSQDGYGLLNLGLNWYSNDGHWTAGLHWKNITDEEYMVGNYAFVTPDGNGGYIPGLGGDNTLIGYYGDPETISLTLGYSF

SEQ ID NO: 1011 - protein, 653 aa, Shewanella sp.
MGTHPTKIALLIGSLCSFSIIAPVMAADDTSTAKVDEHLVVIGRSDKTPLNIAANVNVIDAAAIEMSGATNLTDVLRGQSGIQISDNNIGTSFAMRGFSASTAVNNTLILLDGRRLNNIDIAAPSLNAIPLNLVERVEILSGSAGVLYGDQAVGGVINIVTKSPENTGGSVQLSGGSFNTYEGRGDVSGAINKDWRYFLSGSYNQGDNYRQHNANETGSILGRIQYKTATDSFFVETSYYDDDRENPGSLTVDQFKFDPRQSSNKSEYVHEMTTAARSGYQHQLNQNWALAADLDYSDTLVSSVNWGAGSHNTRSLLMFSPKALANYSTRQGELNLVTGLDISRGKADYDSMARSNVQDMQSAYLQATVPLSHTLSYVVGGRYARVTDELVDGNVYPNGIDLDEDATAFEFGLNYRPSAEHRFYLRGDENFRFAKVDEQAYTPKDVFGLKPQTGRSYEAGWDWTVASQSLRVSLYRLDLEDEIVFDPSAEKPVGGSFQGANVNADASRRYGASADWDWQVTQALQLGLEYNYIDAEFTDGLNDGKKLSWVAEHSGRGYVSMDVAEHIQLFAEAIYTGERFVEGDNANQGEKLASYVLGNLALNYSRDAWLASLRIDNLFDKDYVSSGYYGGNWGDGYYSGRGRDIRLTVGYRF

SEQ ID NO: 1012 - protein, 666 aa, Shewanella sp.
MKSLPSHRSTAAWKPFALVSALATLSFPAVAQVETGQKLTPVTVSASRFENDPSFAPIGATVITAEQIREAGIGNVNEAIRKIGGVYGRQSPYGTSDYSLDLRGFGATSDQNMVVLVDGIRISENEQAVPLMSAIPIDAIERIEIVRGGSSVLYGEGATGGTIQIITKKGLAGATRASLFAELGSFNSKEVRASLAKGWDNFSIDANLSGIHTDNYRDNNKLRQDNFSGSMQWAFKDGRIGLRVASARQDSGLAGSLTSAQFAQNPRQATTPLDYASIDSNLYTIFAEKRLGDWELAADLSYRDRVVKTSYSPFLQPLVQGPVSTYDGHATQFSPRARYLSQVGAIKNEFVVGLDFSDASRRVSSDGNPLVKNGDQKSQAIYLKDELRFGDARVAVGARHEQFDQSFRGGVPYDQKFSLNAWDLQGSYQLTPIASIFAKAGRSYRVANVDDNGYTQNNVPLRPQVSNDYELGATLGNANQKLTAKLFRHRLKNEIYYDPLTPPCGFGFCAGANVNLDPTEREGIEIEASTRLAETFTLSTVLQHVSAKFIEGPYAGREMTLVPKNTATLRLNWAPGNGHNADIGLQWVDKQRYAGDFTNACNSKIPAFTTLDARYAVRVGTWEFAVRGANLTDKNYYTQAYGECSSDASIYPEAGRSVRVSVRKDF

SEQ ID NO: 1013 - protein, 507 aa, Shewanella sp.
MEDEHSFIDYVNRRNNTLYGTLEYDLSPQTQVSIGASYESFKGRPFISGLPRYSDGRDIALPRSTYLGANWNRQDNSTRTLYADLTHQFNDHWRAKVSAIQVQEDVYLKYASSQRAVNPATGLGGTVANITDASQKASGIDANLTGEFTAFGRRHEMVLGASYNHTRLNTDYSSKTPFTPIDVFAPNPYRAEPSDAEIRYANTENRLATTRQLGAYAALRLQLSDPLKLVVGGRAASYKSIWDTTVTTLGTATPSSTLQDNHRFMPFAGLIYAINPSWSAYASYANIFNPQWSLNAAGQNLKPIQGATYEVGLKGEILGGRANTAFALYRVDQKNRATEDLSSGPNCRDGYYCYSDDGRVRSQGLDAEISGELSRGWNLFAGYTFNRNTYERDINNQGLDFNTYTPKHMLRLWTTYQLPGAWSAFTLGGGVNTQSASYRKIGTVDITAPGRAVWSSYVRYQINRQWQASLNFNNMFDKRYYTSIGNLVNSSHYGDPRNVMLTLRGTF

SEQ ID NO: 1014 - protein, 250 aa, Shewanella sp.
MKKTCLCLALMLSPQAFAGDLVQWWDFSATALYGEDYDLAPSDKQATVTLETAGAWKYGDWFAFQDFIYFKGDHTGMDSTTYGEISPRFSASKILGEKIAFGPITDLSLALTYEEGEGPVHSLLYGLGVDVAVPYFTYLNFNTYRRNGMSSGNISDGWQFTPVFRIDIPVGSANIILDGFIDWVFASDNDGYEENFHFNPQLKYDLGKSLFGDHKANKLLVGIEYDLWTNKYGVKGVDQDTYSVIAQYHF

SEQ ID NO: 1015 - protein, 812 aa, Shewanella sp.
MFSFQPKGYSTLRGFMRPAVIALAVSSTLVFPVVHAEEQASSFEKIEVVGSRIALRTATDSVAPVDIITAEQLESTGMTETAKALQFAAPSYSFPFSSVTDGSDAVRPASLRGLSPDHTLVLVNGKRRHGSALVHLSGTVGKGSSNVDLNAIPMTSIKRIEILRDGASAQYGSDAIAGVINVVLKDNDQGGSVSAQAGQTYLGDGEQWRVGVNHGISLNNDGFVNIGVEAHHKDSTNRAGLDPRQQYPKLPDGSADPREATFNRKSHQVGDAEYDNLGLFINAAQPFSNDSKLYAFGGISQRETKSGAFYRRALDARNLTELYPDGFLPQINPKIIDSSLVLGYEFTLGEWNIDTSAGYGGNSFEYNIVNTLNASLGPDSPTEFDAGTLSTSEANLNIDASRYYNFANDSEILVATGVSWRQNGYQIEAGEPNSYINGGYDNRAAGSQGFTGFTPESEVDETRDNTGVYVELENQLTTEFYWAAALRYENYSDFGGNTSWKLAGRYDFTDNLALRGTVNTGFRAPSVQQLYFSNISTLFNPDPTTGQLVPTESGTFNTLSPVTKALGINELDPELSQSFSLGLVYTNDTGLALTLDAYQISIDDRIILSSSVTPNDSPAVAAALANTNAESARFFINAVDTRTRGVDLVVSQDFDLGNWGDLRANLAYAYNKTEIQDIHFPEILDGLGPKLFDNIEQTRMTSATPHNTGNLGLTHELGDFKTNIRLSYFGDYTVGYSTGDVNYSDQWVMDLSVRYAATDALSFTAGVQNLFDVYPEKRPDDNNFNGIFVYPLTNTPFGFNGGYYFLEAKYTY

SEQ ID NO: 1016 - protein, 437 aa, Shewanella sp.
MQKRLLTLAVTAALLSTTTQVHAAGFQLAEYSATGLGRAFAGEAAMADNASAQFRNPAMLTYLTGTQMTTGAILVMPNIDVEGEVTVGNVTQATAAKDMAGNAVIPNFYVSHQLNQQWFIGVALGTNFGMATELDDDFLGSQFGNEASIKAIEINPNVAYRINEQLSVGGGVRLVLGEGSIGAKSSADAVLPTPIGNLPVPKGTTLKYMEGDDISWGWQLGGAWQINADHRIGLNYRSAVDQRLEGEANGLAFNPLAPNQKLAGSMELSLPATVELASFHQLTPQLAVHASVNWTDWSSFEKLEAVIPSLKVPTQLVKQENWEDSYRFALGATYRLDDQSSLRAGVAYDMSAVSDANRTLTIPEMNRVWLSAGYGYQFSKQLDLDFGVTYIIADESPVVEPRPGIDSDNSAALFGGTFSGTTSGNILLFGVQASYRF

SEQ ID NO: 1017 - protein, 714 aa, Shewanella sp.
MKKTAYPVPLSLIALSIMAANPVFSADTLEVEHQLDTVTIEADALSENVPKVGSSASSIDYKNIEKTLVRNLDDLVRYEPGVDASQDSRFGISSINIRGLDGDRVKISVDGVTQADAYGPTTTYLRTGRNTVDMDSLESVEIIKGGDVVEGSGALGGVVKYRTKEPSSFLSAEGNDTSGSLKAGYKSASDEFNQTLTIANRTGKVESLLVYTNRDGHENENHRGDAGSDQTVGVKRASVDPADTGSDNVLAKVQVQVNDNNRIGVVGEYFHSTSESDLFSESSATDQQSSDDKSVRRRIGFFHENTQTNTLYDRLKWQVDYQDTKTTNKTHRSNKNRLVNRFYDEESTSLKADLVKQIEAHQIRYGLNYDKKSLENLNKDTVSGTTTASRFSPKADADIFGVYIEDSWATTDRLTLVPAIRYDNYKYTTTGDEYIESWGNNENEALTAQLAAEYALTDTYTVFGKTGSGFRAPNLDELYYYFANSAPYGSYQITPNPDLEPEESLFIEAGIRAQNIYGAAEFVAFYNDYKNFIEQVSLGSSAAFSLGQYTNQNLNHVVIKGVEIKGNLDLSKSIDTLNDGWVLNGAIAYAEGDNLENGEPLDSISPLSAVVGLGYDAPSEKWGGKLNLTWASGKKKEDISTSKQWLATSNYSLVDLTAYYKPTQNLTFNAGLFNLTDEKYMNWNDIRNLTNTSTNLNRYTRAGRNFGIDATLSF

SEQ ID NO: 1018 - protein, 685 aa, Shewanella sp.
MECRAFKKSAIAVMVSSLVMSSAYAAVDAESAEPIEKITVYGEKIERSLKDTTSSISVIDKDALDSGQYQSTSSALSEVPNVVVLTGSVPDIRGVSGNGSASGFNSFTGGARARVSTLVDGVAEPFVADLTGDTGLWDIQQIEVYRGPQSTINGRNSIGGTVFIKTEDPTFDWQGAARVGYRNQDNFIDSAVMLSGPILDDELAFRVSGQNVTGNTFNKGLEYETNPAPFDLNELITNRWRGKFLWQPSAIEDLKVLYSFSYNDEKGDSGRNYFTGDDPWAFKPIFQRYIETKSTTHSVKVDYDLGEGRAFDLIVAYMDYDWGFESYEALATAQQYVDMNDQSYTVDGKYSFGLKDKDFNGFVGLAYFKRDQDFGSTGSSVYSGDDSTESTSIYGEMTYGLAESLWVTFGGRVMREEQLRNFNMLYQGSQLQEKLDNANTVTLPKLVLQYALNDSTTLAASVRRGYNSGGGALSLAESEYYYYDEEYVNTYEISSRSAFMDGDVNFNANLFYNDFEGYQASNSARKITNIDKAVSYGIEAEFSAMLTDDLQFISGVGLLDSEIKEADPSYGDIIGNQLNSAPHVTANAGLKYWLGDAFSFGFSGNYVGEYYADINNTESRVAGDYVVARLSLDYQTDSWRISGFVNNLFDEQALTVNEPASRSYPDGYAAIIDPRNLGISVMYRF

SEQ ID NO: 1019 - protein, 590 aa, Shewanella sp.
MLLRQNSVSFRKLKRPPVKSQLLLRTGGLIGKLVVLNALVLPGAFIGEQLVGGNEAKARTVEVDGYECTWTPNANIFPGEDATRPGSWSCVPKWIFEQEFPEDPGRPPNIPPFEEIIPPGPGDEEIIPPDPGDEEIIPPDPGDEEIIPPDPGDNSNRVPPGPGSPPPAEARRRCGEGRCLAILRSFRPPNPDKGTQAVSFYNQALMERLPLLTYEKITIEPEPEPVIEPAPSEPVRGLWKTTPVGDEKLYDFELDGTFYKASDSVTSYYAERESLRTWVKGFGGSTSNFDPDRWGHREFNATFGGGVVGLDYSFTDNFQLGGYANYGKINTTEYSPVNPDWDPNGWGGGVKAVYWTDNFYVQGVLGRTQWNGEQVRDIPASGRFGYLTDAQVAASSRPDLIGALRTVKPQASGDKTLNSTVGAVRVGLPMQVGKFYFEPRFTGTYSNNQEEGFTESRGAFPFNLRYGERTTNYWFTDLGFKLALPMRTKQRGALVTPNLLVSWMGNWDQGNPAQRYYATFRNSQGQKGSYFVRSGAENENALVLEGGLDYTVRNINATSFLLYARGGALIWDDATKPADWRASGGFTFQF

SEQ ID NO: 1020 - protein, 424 aa, Shewanella sp.
MLNKRMGMLALGIISASQAMAEGQADSKGFVEDSRLIVNLRNAYINRDYKNDREDKSEWGQAFMGNFASGFTQGTVGVGVDAFALYGIRLDGGKGRSGNGGIDFFKQGDSGAAADDLSRAGAAVKARISNTVIKYGDQMPQLPVLSYDNSRLLPESYTGTMITSKEIDGLEVVAGRFTQEARKSAEGRDSGDLKSINVYGASYKFTDAFSAAFYASDNEDVLKKQYVNLNYVFALPQDQSLTFDFNGYKTKLDKDFTTSDARDNKIWSLAATWAVGIHSFTLAHQRSTGDMGYAYGGYRNDGGFGDGGNTIYLANSYWSDFNGKDERSWQAAYGVDLSGLVLPGLSYKAAYVRGDNIDDGTPGSGDGTEREIFSQLTYVVQSGPAKDLSIRLRNSFLRVSDDALAYNSEGNETRIFVDYPINVF

SEQ ID NO: 1021 - protein, 709 aa, Shewanella sp.
MVFKYSVVGLAVGSALMAAMPVMAEAPNDTNIERINVTGRTFNDYKVGSASGAMRGDIDLMDTPQSVNVIPDFVTDEQLATNLAEVLVNDSSVTAGTTRWNRQVFSIRGFELDSGNGYLINGHQQWSHYVQPIETLQQVEVLKGPSSMLYGQSGPGGLVNMVTKKPTYDSMLNLGFDTDGYGSTRAQLDAGGSLNEAQSIRYRGVLVKQDTKYWREYSTTDENQERDRWLGYLNLEFDISDDLLLSLKYDHTQDKTGIDAGSWLDKQGNVVGQRKTIWDAPWAFTDNTVSNLGADLTWHMNDDWKVKLGYNDQQFNRQRFDSAPQYNEDPFTSGYKIKPFDRYDDWQHKTAYVDFTGEFALAGMEHQLLIGANYLDYYYGQYIERYVNQATKGMITVIPGQPVAKPDLDYHRDSTKSESEYKYYGFYLQDLMTINEQWKLLAGVRYDEQKKDGFGENSYAVSPKFGVIYSPMTNGSIYVNYSKSFTPQGGITDPLNVNHDTNLKPEYGIQYEVGTKWELFDDSLLLTAAVFDVTLENISINEVLTASDPRSEDGKYTSITTQGGEQKHRGFEVGAQGKLGDSWFVTSSMMYLDAEYQTGDEREGKTPIDAPEWSANIWTRYEVTDNFAMNFGAIYVGERFANVDNTISKDGYVRFDIGAAYTMDIMGKDVSLRANVRNLFDTDYIDGGQYNMVTLGQDRNFSVALEAKF

SEQ ID NO: 1022 - protein, 284 aa, Shewanella sp.
MSNKKKFTIGTVLVSLLAFLPTYSFSAPISNNSEDNIFGLYIAGQYRPGVSHFSGFGVTETNFATQKLMRVKKDSKEGLPNILKSKDNFTEPYVAKFQDNAVSFSGAIGYSYPEGLRLEIEGSYETFDVKDPKDCSVKDAFRHLALVRELDTGLSMPKEKKYTVMRNNGLSIASILINGCYDFDFDNLIVSPYVCLGIGEDFIEFFDVLHIKFAYQGKLGISYELSPRINVFADGYYHKVIGNQFKNLNVNHVVELDDFPKVTSAVATLNVGYFGGEVGVRFIF

SEQ ID NO: 1023 - protein, 721 aa, Shewanella sp.
MVLKTSFTLLALIISGQALSQENKSEPNQTQQKSKEQDIERIIVTGSRIAENIDEVPASITIITQKQIAAQLKVSSEIQSLLANLVPGMAPSTGSSSNSGQTLRGRSPLVMIDGVPQSTPLRNGSLGIRTLDASVIERIEVIKGATSIYGNGAAGGIINYITKKANSDKALSGHASISSRFSAVETEDSIGQRYEAGINGEINNFDYVLNASYEENGLQRDADGDILGLKYGLSDAVMQDYFAKVGYHFDDEKSLQFTYNYYESKQDVDLIDQVGNINTGEKTQAIPVPEGQTVLGEPQGPSNHNMMLKYVDDEVFKQTQLMVDLYSQEVDNTFFYSPVLANPDAGYAGGQSLINSDKKGLRVTFNTLVDFSFDNGDSLEATFIYGIDALNDVTSQSMVDGRVWVPEMDMENLAGFLQTKLIYNNDLVIKLGIRQEDIDLTVNDYSTLKLCKSAEQCSVPVDVTGDTLNYKATTYNIGIKYNALPLFSPFVSYSQGADISDTGRLLRTATVTDISLIRTEASIIDNYELGFSSDFEQVHFEFATYFSTSELGTTNKFNATTGVYMPVRAPQEIYGYEALINYNINDAWAVNATYSWVEGKNTEADVYLGAKQISPPKATVNVNWNPNSDISVAINYLYVGDRKRFEQVDGKFVGDQGPIDSYQVVNLSGNYNFASDWSAFIGVENLFNQDYYPTKSQGYTYGGYNIKGLGTTVNMGVNYQF

SEQ ID NO: 1024 - protein, 212 aa, Magnetococcus sp.
MNIDGLRQAETLSSQGFKELFEGYGNFNNTRNGAEIETLKEVNITKGADSIKNGSGSLGGSVIYKTKDARDYLINKDYYVSYKKGYATENNQSFNTLTLAGRYKKFDVLVVTTSRNGHELENYGYKNYNDKIQGKKREKADPYKIEQDSTLLKLSFNPTENHRFTFAADLYEHRSRGQDLSYTLKYQKTDPNLAEVDSRHTNDKTKRRNISF

SEQ ID NO: 1025 - protein, 783 aa, Magnetococcus sp.
MGFRVPLRHQNNLNQLKNLSTMMKNQKRAVCLLACLLIAGFTAAQEKKESAQTASGSKEEGNRNVMLNASSANGPREISIGLPGGDVNVLENGLPVVYTSNPHNVNTHWRGDSSLGHVGLLKISETAITTGNIGYAVNSFTQLGTEKFRGIVNYSTNHFGKQQFDANISGGMGKGWFYSGSVYQNFDPGSFKLRFTSNQDRTQIYKAALTKNYNEGRGQLSAIYHYSNSRWPSNEVTSAPFIYVGDGSVKEIPGFSLGTSSYLPTTGEMLYRDMRTGELKETNLYDATLNRGNQLTLLNTYTWDNGLNWKINLKYDHALGSYVYQTPMAMEQKDASAGYYLKAVDGTLKPYEGYVQSRMSCLNRGKIDEFFATSELSRSYRNTTWRIGVNEWHYKVDYASNTTMYDHTVGEYPERLVREGNTDGVYYDFNKNASEYYKGHENKLAVYATHDWDISPKWNVYYGARLEWQHLEGENAAVYDAEGNAVGRFPDYYLGAVSDKGVRITPRLFDYDWMNMAFTAAATYKLTREFGFTADFTYNTQRPGLSNFAPATMPNTDKISVPLGRAGVYYNTDWISLTSLFSYISKTNNNSTLNLINPNDQTEILAAPLSYDIQTIGWTTDAVIKPFKGFNFHFLFTYQSPTYKKYETSVTFKDGTVGEIDATGNIVTEIPKVLVELDPSYNITNDLRVWASFRYFSKTYANIKNAYYFNGRWETFGGINWTVNKHLALSATVINFLNQTGAKGSIAGAELVDKKDAASYNGHWMAGSYIRPFTVELAASIRF

SEQ ID NO: 1026 - protein, 668 aa, Magnetococcus sp.
MKRSMLLKTSVLCLGFAGLTQLAFAGQVTTDESNVFTLGEIVVGDSSRVQDVAINNTVTAEEIESLGATTAAEALAFVPGVNLVQTTKGTSNITIQGFQQKDILVLIDGVPYYETKNGPLDLQQIPASIIGKIEVIKGASSVLYGPNAMGGVVNIITKKGVEGFAGSARVELGRDGYNREVASLNYGAENGFSVLGTVDYRRRDALRFSDSYQPVATKIKGDPTGRPNPRVIDDGGKKNNSELESLSLWTRLGYAPTDEAEVYASLYHYELERGRLFSDSYNKVKGAFSTFARYDSYRDMGVDLGGRVQTNDWLALRTMAFYHNHKDDCSFYESENLANKLATSTWDDDSYGVSIFSDMDLNRFGDLTLTAQYREDKHKDRHEKIDPYKHSKSDTFTLAGQETISWGPLSTVLGVGWNHFDVSEIAGNDDGYDSDSIDPMLGLTWTGESGLRLFGSVAKKTRFPTFSDMQDKSGKVYVLDPEKNINYTAGAEYLFFDRTNVTLSAFYNDVEDGIDTVMIAGNKTPTNIDSAKIYGIELSTDTEITERVNLGIDYTWTHARNDSADRRSDYLEDTPEHAIGTKISYQVPMIEAKFTLHGLWKIDNYILVGDGENVAEDSFVLDLSLLKDFDNGFTAGAYINNLLDADYYEGNGMASNGFNFKFIVQYAF

SEQ ID NO: 1027 - protein, 350 aa, Magnetococcus sp.
MKARQWMAMGATGAALAAGNAAAGTMQLFGVVDASLEYAKGSDSVVRMREGQQAASRWGIRGIEDLGGGLKANFLVESGFNIDTGTEFFGNNRLFGRQAYMGLSDGWGEFRLGRQYTPSFYALLRLDPFLLNGAVSPFNLLSATASQGTGHVAYGARFDNAVQYFSPNWGGFSFTAAVAPGEVPGAPRSGLNFGMNATYEAGNAYAFYSYQGMYTGANVPVDTTLTSNHFIGGSYRFQPIEVGLLFSTASSNRPDTRSARHYGVTFSWTVTPRDTFKAAAVKRQILGGGERPLAVTLGWDHDLSKRTTAYLRAVLVHNSPGGSVTNNSIAIDPGSGDDARSVSVGLRHRF

SEQ ID NO: 1028 - protein, 1044 aa, Syntrophobacter fumaroxidans
MFLLFIPMMYALPPEGITIKGKVTDETLKEGVPGANVTVKGTSIGAITDFDGNFTIVVPNRKSVLSISFIGYVTQEIVVGDRKFITVTLKEDSQNLGEVEVVAIAYGNQDRRMLTSAVSSIDNKELIKSPATSITNILAGALPGVSSVQTTGQPGKDAAAIYVRGVGSLNDSQSKPLILVDGVERAFSQIDPNEVETISVLKDASSTAVFGVRGANGVILITTRRGKSGKTQISASTKLGLQQPISLVEQTGSYEFARFWNMKQEMDHVTNPKLYFTPEQIEAYRTGSDPIMYPNMDWKKYIFHNLYLQSQNNVNISGGNDNVQYFVSVGYTYQNGLLKELPGQLYDNNYRYNRYNYRANIDANLTKTTTMKLGVGGVLGKIQEPRDVQSGTGNDPNAWVIAQIWSHPFAGPGFINGVRTLVPDDLVPLGEVMRDGMFVFYGKGYNQTYDTTLNMDLDITQKLDFVTPGLSVSVKGAYDNQFKLYKERAGGAIESQTVYYQSYFDSNGNMPQTDPDYDKTHIFVPSGSDTPLTYSESSGRAQNWYLEGRINYDRMFGDHKVSGLILYNQSRNYYPDSYTYLPRNYVGLVGRATYAYQSKYLLDVNVGYNGSENFAPGSTRFGIFPSFSAGWIATAEKFMENQKVVDYLKLRASWGRVGNDKGVNSRFMYMPAVWGGSGSYSFGINNPISQSAAAISSMGNPEVTWETAEKQNYGIDLKFFNSRLSATFDYFIEHRTGILISPESTPNIIATSLPNLNIGKVNNHGYEISLGWRDRIGKNFGYYVDANVSFARNKILYMDEVPKQFSYMNHTGGSTGRYSRLYNFVRLYQYSDFTTGAGGELVLNPELPQPSVKVYPGDAMYADLNGDHVVDGNDKCVTGFATRPEYVFGMNMGFNWKGFDLSMQWVGSKNVNRMYEIEYRIPYTNAGKRGLLTYFYDGCWTEENQLGAVYPRASETSESWNSEPSTLWLADASYLRLKSLSLSYTLTGKKFLKKLGLTSLGFNFSGYNLLTFSPLKYLDPESNPDNYGEYPLIKVYSFGLNLNF

SEQ ID NO: 1029 - protein, 443 aa, Syntrophobacter fumaroxidans
MLRLNSLVVRAGLAAGLALSAASPALAGGFKLSEYSVRDLGMGHAGYAALADDPSTIWSNPAGLARLDGTQIQLGAHAIIGQGDFTNQGSVDVLGRPLGGTEENDLFNDAVIPNFYLSHRLNDRIVLGLGVTAPFGLATEYNQDSVTRFQSVKSSLKVAEINPSIGYQVNDRLSVGFGVSAQYSEATLANHLDFSAICLSQLTPAQCTATGFLPGRPEGYLRVTGDDWAFGWNVGALYDLTETTRIGVSYRHNVDHNLEGEADFGAPANAAIFAPAFTDTDGSAELNLPAELAVSLAHQVNERLSLNASVVYTFWDFERLVVEFDNPAQPDAGETLGYDDEVRYAVGGEYAYNSRLTLRAGVAYDQSPTENEHRTTRVPDSDRTIIALGASFQATDSIQIDAGYQHLMFDDAPINHVGSTGDRVVGDYDNVADIVGLSLTWRR

SEQ ID NO: 1030 - protein, 222 aa, Syntrophobacter fumaroxidans
MKHASRNRKRNRIGTAAIAASLLFAGALAPQAHAAGDDAMSGIHAGDVLVRLRAISIMPNVSTTQSLSALNVGVNNAIVPELDLTYMIRDNLGVELILGTSRHQVTSNIGGLGGVNVLPPTLLLQYHFNHAGRIRPYVGAGLNYTLFYNNGLNAGGQSISITNHSWGPALQAGVDVQVTKSLFVNADIKKIWMHTDASLGGQPLGRLSIDPVVVGLGVGMRF

SEQ ID NO: 1031 - protein, 537 aa, Syntrophobacter fumaroxidans
MRTFIKTAGILLLWERCPPANRSGEDTKINSEQLERLLNRLEQAEKRIQELEETKPVTPPATPQPVPSLPPKLERAAGGLDDSDEMLINNYTDDSGSPAFETRLSTLEEDWKKFSESEQEKKAKDASKATTLKVFGRIHLDAWNFSDSTPGIAAFNNPGDPMDPENRFEFRRLRIGVGGDIKDNMLYKFEYDFGDPGDPAFKDVYIGWKDLPVFQTLLIGNQKRPLGMDHLNSSRYNWFMERPLVIEAFNEDARRLGICAYGVSEEETWNWRYGIFNLENIAGDGKYVGDAGQMSVNGRFAGTPWYDETSGGRGYLHLAIADMWANPDGDTTGSGSNNNEGRFRTRPEARTGSTRWLDTGRIAGADWFNTLGFEAMLTVGSFSVVSEYQVTYLGRGAEGPDLTFEGAYVEAGYFLTGEYQPIDRKSGTIGRIKPLENFFMVNTCDGETGGGWGAWQVVARYSYLDLSEGNITGGDERNFTFGMNWWWNSHSRVQFNYVHAQIDDRGPVDGYTGGRSEVYLRCPIHGRFLIPARRIRV

SEQ ID NO: 1032 - protein, 501 aa, Syntrophobacter fumaroxidans
MRGRRVGSQHKKRSAMTQHRSMKRVARAVVLAWGLPMLAGVSISGAARADDAAPAAPALAPSAATLAQQAATPNAVVSADATQAVMPPAPVSSQAKSKGFIADSHFDVLLRNYADVLDAKGGPHRRAWIQGVMANFESGYTGGLIGFGVDASIYAALKLDGGAGGGNMVHVAKGGGGSNQLAWAFPGIYDVKARISNTVIKYGLQAVDNPFMEQHDNRALPPTFLGATIVSNEFKNVMLEAGSFTKTDARGHTTLTNLTTQYGGTRVDRFTYVGGTWDYSPTGSASFYAGQADDVWRQYYGSVKQSYGSPQTVKWTGFGNFYSTHDTGDARQGKIDNNAYSLSLAAQHGPHELLLGYQQVLGDQFFDYLNETNGIFLVDSMDVDYNAPHEKSLQLRYTFHGKDAGLPGFKAMVWGVTGWGADGSASAALDPTRSSIYWKDGAPVQGRHHEFGFIPSYTIQSGKLKDTKITFIAMWHVGSAHYSDSTNQEYRLVVNVPVKVF

SEQ ID NO: 1033 - protein, 778 aa, Syntrophobacter fumaroxidans
MLLISSQSFAQSGSGSLKGHIVTDKNEALSNATVQLQHTGISTQTDAGGNFSFTAIPAGTYVLVVSTIGYAAHKQNLVITAGKNAFLNLQLSENRAELKEVAINGGKNQYQMKQSSSSTRMDIPLLETPQSVQVVSSAVMQDRQAFTLNELASTFTGMKANNGNGSFTMRGFTAYSPNDASFLLYNGVRGNLFLWSQQPLLYNVAAVELLRGPSGALFSEGAPGGVVNFVTKKPLAAASYSVDLSFGSWNFRRASADLTGPLTKNKKLLYRAILGYDRSESFRNDQDKENIFFAPSLSYLFSANTNMNLEVNYAHQKAVHQYDNGSFIYTNPDGSFDFNYYPNNLTIQSPTDYGKTNNASATLTFNHNFNEKLKLSVVQRAVSNTLDYNDHIPVGKIRNDSISRALQDWETDRFSLQTTAFATYDTKTGPLKHQLIIGADYNRYGWTKNDYQYKPSTRISIFNPDYSNDVPGPDVAAEESDDNKRITNLIGLYLQDQISLGRQLKALLSLRYDDYDGKETPLSARDNKQGDALQASGWIPRVGLVYLPMEQVSVYGTYLKSFNPQTSNNVLSGGPFPTRQATQYELGTKAEFFNRQLSTTVSAYEIRYANILTAAPTDENSHRQAAIDGTRSRGIEFSATGTIQNFNIIAGYAYNEHIILSTSAYGKKGDRFANAPKHMANLWLKYNVNATALEGLGFAAGLRYVGDQVGLISNQNFVFPEYTVFDAAVNYQKGRYNLQLNAYNLTDKHYFTGSRSSTTTAGLGDPFNFRVGLSYQIR

SEQ ID NO: 1034 - protein, 794 aa, Syntrophobacter fumaroxidans
MTRLSALKSALLATCALLPTAVFAQQTLQTIEVVGVSPVQGSEMAKDKIPSNVETIGTRELDHSRAPSLLDNILQSVPGVSLSDQSGNTFQRNLDYRGQTASPVLGTPQGIAVYQNGTRINEAFGDVVNWDLIPEMAIARMTLMPNNPLFGLNATGGALSIEMKNGFTYQGGEAQLFGGSFGRIQSGAQYGWNNGTYSAYIAAEGAYDRGWRDFSSASQIRRMYADFGARGDTTEFHLSFTGADNRLGSVAATPIEMLNNRWSSVYTWPQSLHLQMQMVQASAKWTPNETWTLQANGYYRNYKSARVDGNGTDAQACDLGIGLDNQFCIGDGQTPLNQNVPTFNTLAGDTALGQIDRNSVKTDSYGGSLQATSTTQLFGHDNHFVVGASVDHGNTNFAATSELGTIDNNLFVTGLGVFVDQPNAGLAPVNLNAKNTYLGIYATNTFDITSQLAFTAGGRFNWAQINLRDQGGNLPLLNSNNNFQRFNPVAGFTYKFTPNITGYAGYSEANRAPTPLELGCSDPNNPCLIDNFLIADPPLKQVVSRTIEGGLRGEISGGASAFAAAPPPYRKAPIKAVSVDDGWKLRWGLSLFRTENSDDIIQVVDPANPVRGYFKNAGTTLRQGVEAKLDLTWNRWTAYANYTFIDATFRSAFDVNDPFLQAPVGVVSGNHIPGIPAHRLKLGADYAVTDDWKVGASFNYVGSQYLLHDETNVYPKVPSYWVVNVNTSYQVTKNVEVFGLIQNLFNQRYYSSGTVFNTGGFNTAGGGNAFAFNDPRSVVPGMPLAAYAGIRAKF

SEQ ID NO: 1035 - protein, 656 aa, Gramella forsetii
MRLKKRYLCTVLTLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRSIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 1036 - protein, 1086 aa, Gramella forsetii
MEIKSKFLCSRGVALAFAILLGGSPGVLLYANDSVEESLTVAQTGRTIKGFVTDVNGEPLIGCNVVVVGSNAGVITDIDGRFALNVPADAKQIKISYIGYVDQIITLHDRSDFKVVLKEDNNALDEVVVVGYGTQKKATLTGAVEQVSSKVLESRAITNVGAALQGATPGLVVTRSSSRPGNEGLNFQIRGATSVNGGKVLIIVDGVPTLNDASFQNLNPDDIESISVLKDGSASIYGAKAANGVILVTTKKGKGKVTVDYNFNMRFTTNGIMAFSPSMEEYATMWIEANKEQKTKDWWNWTSEENMLKMQQGISGIYHTNAKDWGYDLFIGDANRLEEMFARRFSYQHNLSLSGSNEKTDYRISLAYADNQANLATAYDGQKQLNLRLNYGIRLTDWFKLETSASMIKTDTESPSAGIDTSLYGNEPPFFPAKNPYGQWYANFGKVGDRQPVAATSDGGRDERMNLTTRVDVKAIVDIWKGISFEGMASFQNEEYRRDRYVIPVQTYDWFGNPADKVVSNTNQSLIYPTDVLNIKDIHNPAYLMQANNMQYQYYSALLKYKRTFAKVHNVEAMAGINAEKWVQKKMVTAREKMEDTGVYDLNLASGAQGNGGGKTHNGSYSYIMKLNYNYAEKYLIELIGRRDGNSKFAKGHKFKNFVSVSGGWVFTEENFLKAITPVVNFGKLRLSYGNSGNDAGLGDFDYLVAVTQGSTVFGYSPAAQVSTGLGNNGIISLDRTWERVEQKNVGIDLHFFNSRLTTSFDYFIKDNIGMLSEVTYPGVLGGKSPKTNSGHLNVKGWEFTIGWRDQIKDFSYYANFNIGDTKSKLEELTGADGYGAGVNKTVNGYPLNAFFLYRTDGYFKDQAEVDRYYALYAEQVGALNNVGKGTVAELRPGDTKRLDLNGDYKITDLGNADSDLQYIGDANPHFVYGLTVGASWKGIDVSAMFQGVAKQYIMRNDWMAYPFRTIYTNQNPTFLGQTWTEDHKDARYPRLTNNTNRSAWNYQNNDFMLQNSRYIRLKTLVVGYTLPQIWTRKVKLEKVRLYFSGNDLWEATSIRDGFDPEMGSASNTSGYPFARTWSFGLNVTL

SEQ ID NO: 1037 - protein, 537 aa, Gramella forsetii
MKNFLIASRNTLGVAIASSLCSVHATELNIIGVSDYAASGEQVTSITQFSDVVPTDWAYQALSNLIERYGCVAGYPNGTYRGNRAMTRFEAAALLNACLDRVTEVTDELKRLMKEFEKELAILKGRVDGLEARVGELKATQFTTTTKLEGLTTFVIGANIFGGDADATGEQPAANRKAANSDFGATTFNYDTQLTLNTSFTGKDNLITILRVGNFDGGENVFGGSFLPLSTLETAFQEGDLPNNVALDRLYYTVPIGDNFVLTFGGLVGQEDMLGLWPSVYPSDTVLDVTTLNGAPGAYNKNLGAGAGITWTDNGFSAAANYVAASANQSNPSEGGVGTAGAGSTGTVQIGYQQEQWGLAVIYSSIQNTNQKAEPNGLVAFGTQFVLNSYETPGTTSAFGISGYWQPQDSGWIPSISTGWGYNTTSYESNRLTDSEQSNLVTASQSWTIALEWNDVVLKGNNAGMAVGQPIFATEIKNGDTPRDGNYVWEWWYQFQVTDNISVTPAVFYLSRPFGQQTPINQSFNQLGGLVKTSFRF

SEQ ID NO: 1038 - protein, 1095 aa, Gramella forsetii
MKKLFLISLLVLFIQTTFGQTKTITGNVKGKADGIPIPGVTVLIQGTSNGTTTDFDGNYSISVAPGRSLVFSYMGFETSVVKVEGQQKINVALSESTSKLDEVVVMGFASQKKTNLTGAVASIDVAKTIGSRPLTDVSKALQGTTPGVNVSFNSGNMNRTATINIRGAGTINGSDAPLILVDGVPTDLSLINPNDIATMSVLKDAASASIYGARAAFGVVLITTKGGKTGEGKVRFSYSANTAFTNPISTLKFLDPTEEIPGLIAAGTRTDGAVPEIFGANYNTLLAGIKNWKEKYANNRTSNEMVYGEDWEIKNGTPYFYRVWDANKELYASNALQTTHNLSAQGNLGEKSSFFASIALTNQEGMLRVNQEQRQRTNINLGFTTKLADWLTGDFKVMTINSTYDQPFNYYGGSGTDDTSYGGYFGYALRWGQYFPNFGTYRGYNFRTAGGYISNASRNENIKRNNRLSAKFTADITKDFNVIAEVKVMYEFYNRKQNGGKFLAWDSWSAMPYDATTIQTATPATLEAGNDYVAQSKSESTTNVVNIYGNYKKQLGGHNFKVLGGFNSEWQDFSRNYARRNTLLDKTKPEFNLAVGEQFVSGSANTSLNPAETTYSIAGFFARLNYDYNGIYLLELNARYDGSSKFPTNEQWGFFPSASVGYKIVNEKFMEGTRSWLNDLKLRASIGSIGNQNVGNNAFLSILNSTNPSWVNSGSTLPPSTGLPTNVDPALTWEKVYTKDVGIDIKIFDMLGASFDWYQRDTKGMLAPGITLPGSFGQSAAQTNSGNMRTKGWELSLNFNKQLSETASVFVDVALSDYKSVITKWNNTSKLLGLVTPTTYPYYDGYEIGQIWGLTSDRLLQADDVITNNGKTVNGVDYSKTMVGNFKYGAGDVHYLDLDGDGVISRGAGTADDHGDLKKIGNTTPRYKYGITLGGKYRGFDVSGFFQGVGKRDYWAASDAVLPFFRAPQQMYANQADYWTPENTDAYWPNPYYGNEANTLGSGTSGSNNFVTSTRYLLNMSYLRLKNVTLGYSLPKELVQRARLEKVRIYASGENLVTWADKRLPVDPEIDETEVFWGRAYPYTKTVSFGVELSF

SEQ ID NO: 1039 - protein, 798 aa, Gramella forsetii
MKVKKSQVFKKSTLCLALSSALALPVNSYAEESAADGIERIQVTASRRASTVQEAPLNITALDGDVMKDQNITQLSDVARWVPGLSVADQGGRTGSPIIVRGLNTNSSGPDSDAGTVATYIGEIPLVVDMKLIDVERVEVLIGPQGTLYGAGTLGGAIRYLPNKPILDETSGSLYGDFFTLSESDDTGGEAGFVFNTPLIDDELAVRFAVNYLDEPGYIDYNYVVREGGVSLPDPDWSDTDAVDSNLRQVADANFEQTTTAKAMIRWQPNDIFDATLSYFYQKQEIGGRSIVHHNSLSETNPLSTVIGEYESGYRYQEPREKEDTLLSLEMTVDLGFAELTSATGYSEFEALGQRDQTDLLIRLDYSYEEFPGFSAFTREVDEAENFTQEIRLVSTGDSAFSWIVGAYYNKFESFNDSREFTPGFDQYAVDNFGAEQLRPDSLEYVSVDKAEITESALFGEITYSVTDKLTLMLGARFYQYDVVAQSDADLPLLNTIYDASYDPTFIDIELMESKADDDGSLFKVNASYQFSDDVMGYATISEGFRIGGSNGIAACDEDIGQQQSVCAQPDELLYEPDTTTNYELGFKSTWFSNQLHFNAALFMVEWDNAQIEGATEVGQQPYTSNAGEAEASGVEISSRAMLTDSLIAYATYAYTKAELTSDDVPDIGFSGDRLPGSPEQQFSLGATYSTEVFGGTGLDVNYGLTYQSDVYSKVGLRNNGEALPGYALSNMSARFSEDAWSVTLYVDNMFDKYAYSSVRRDVGDITTANDPAIQRNYGHYLITPRKVGVRFDYLFDL

SEQ ID NO: 1040 - protein, 1015 aa, Gramella forsetii
MNKKLITIAIQTAIMGGALSLAPQVYAADDTEIAKPKLEATADEQGKEPEIQEKITVTGSRLRRDSFSITTPLAVLGRDDIEDTGLGSLAEILVEELPQISEGSSNSNSQSSVQNTGLSTIDLRELGTNRTLTLIDGRRVVSNSYSGNYVSLSTIPSGMVERVEVITGGASAAYGSDAIAGVVNIITQQDKEGFSFKARGGESTEGGAKEFTLDLDYGTEFADDRGYLFFSSTYDKQYGLSYWDRDRAQQQESWRYNTAEMCNAMYSEDNTSSKGTCMRDMTQADWRNLSDSIAGGVFDEKSSYKPDSGFWYDENGLRDDWHEEKYGRDFNQFVMLKVPDEAISAAIKVDFELTDDIQSYFQVQYSENRSINQKSPESEDEFDGIVVIDPVTGESSQIGAGRIPKNNPYMPQEIYDQASSKGVKWDRGFDEVGNIINDNTRKTIRSWAGLQGTIFDGNWDWDLSVGYGKFTQEQTRYNELYIANLTHALNAEKLDDGTIQCADADARAAGCVPINLFGEGSITPEAADYIRATPTISTDVQQTTVLGYIAGDLFEMPAGPVASAFGFEYRKDEQSVDTNVPLGGVSFNYVPTFSGDVSVYEVFGEAAFPLLKDVAGAKSLTAEVSARLADYSWSGTGLIQSYKTGVTWQPVEGYAIRANWARAQRAPSITELLSPPRGDYDSFDDICEGTTLTSTDAGHDNCRLEPGIAAVIADGSEFEDDNNGYSPNVGNSELKEETADTYTLGITLAPEFAEGLRIAVDYYDITISDAISSFSNEDIIDYCYNSSLDFGDDNNFCNDIQRDAEGQITTVNQRVYNVDEIKTNGFDFAAEYRYELDKYGSLKFKADWTHVIGYEQTVQSPEGPATTNYEGDLSQDIFEDKVTASLSWYYDDAWRVRWSTRFKSAVVASRSVYDDWEKAITKNNEYCADGSDKCVLEPEALDDSFYNLPSYITHNLSVSYTLDLANDGELRFFGGVNNIFDDRGPFMAIGGRGNFDSNYGGGKGRFAYAGAEFKF

SEQ ID NO: 1041 - protein, 824 aa, Gramella forsetii
MRTKTKMTGHAALLCGAALCALLATAAQAAETPATATPAASPDTDPNSVEQVIITSTRETRSAVAMEAQQIQRVLPGASPLKAIQFLPGVIYRTADPWGNNEQNLSLFVHGFSTQQLGYTMDGVPLGDQQYGNYNGLSVSRAVTSENVSRVTLSSGAGSLGVPSTSNLGGAIETFSRDPGAERSLTVNQTFGSYEASRTFLRAESGEMAGGFKGYLSYLRQDAKAWDFDGRQRGHQVNLKLVREGEKGDLTFYANWQMKVEPNEDATAMGNQQTAAAQNFKPYSRAFIYPDLAGCTANLTGGPGTPPPAQGNNFSNCFSAAQREDILTYISYAWKPTETLTWTNQAYYHYNFGRGIVSGPVNTAGLPGLFATYYPNLVVGTTTSPTTLTNIVNLFGGSGYAVRTTEYRINRPGLISTVEWTLGDHQIKGGLWFEHNEPAQQRAWYPMTKANNNLSPYDVPRGNKVLTQYANAFFINNLQLHLQDQWRVTPKLLVQAGFKSSLQDATGKFPVNQKNLPTVAVPVQFPTGSIESNKWFLPQAGLLWDATENDQVFVNVQQNMRQFIPYGAGSGFYGFSAWSLGTQAAFELFKKTVKPETSWTYEAGLRSRREVAWGPITGIEGQINAYNVKFSNRLLNIAPFNFINPAPAILANVGGVTTKGVDLAGTIKFGPRFQIYNAVSFNESKYDSDYQSGTTLVNGVSTPVTVATGGKFVPLTPRWMNKTIARVNLGKFDAQISGDYIGKRPVTYLNDLSVKAMMLVDLQAGYSFDIADGGMLKGLRLTANVTNLFDKKGVSTAGVTSNSGGYVAFPQPPRMGFVTVSAEF

SEQ ID NO: 1042 - protein, 774 aa, Gramella forsetii
MKQIICILALLLMSVTTTKAQTSPATPSIRGKILTEEKQPIEFANIALLSEDSTFIQGTCSRSDGSFELLPPTPGNYLLQVSSIGYKALCQPCPTGSTHNWILQTDAVLLAETVITAARPVFRLKGGKLETSVRQTLLASLNDANDVLKHIPGLRSSDEGYTVFGKGTPVIYIDNRLLQDNSELQRLSAADIEKVELITNPGAEYDATVKAVVRIRTVRNKRDSFGGNFRAGITQRRRNSHYGQVNLNYQKKGLSLLGMLYTNYENRKRHQEVRYQIPSEIQWDVNNRVHLYNKGLLAGGKASASYDFTPQHSLGASYEFHRTPDYHSSDHSAYTVRANEELADHTIHSSQNLQQTNRHQLNAYYQGSIKQLHINFNTDLVYGKSYNHQEAQEESQTEGNRDISSFNHADNRLYAAKLILTHPLWKGELKTGADYTFIRRNDNFLNRQHILPDTDSRIDESKSAVFAEYSLTLGKISLLAGLRFEHAVSDYWEQEKYVSGQSRTYNDWCPNLSVDFPLGKAQANLSYTAKSNRPSFFQLRSTLSYNNRFIYEGGNPLLTPETNHDLQFTALYKWVQFGLNYQYRRNAIAFMTKEYEDNPDVVIFTTGNFKRMQYLTASAHLSPTVGIWKPELGIYFAQPFFKVTNQGSSKNMNRGSIYLFLQNSLQLPDEWTLSLDADYQSEGNFGAMLQRSYWGIDAGIRKTFFNKRLTLGLQANDLWNSRYGSFMLFGPRLTYTKKANPDSRSFSLNLSYRFNAAGKAYKGKHVSEQDLKRL

SEQ ID NO: 1043 - protein, 1105 aa, Gramella forsetii
MNRNKSIRVAILCLSLAMAGSLPIDAQKVTFHEGSISLKQAFEKLESSSAYKIAYNDSQLDVSRKVSMDQKDMEVLQVLSQLLKNTGYTYKINGNYVIIVPEEVKTVKGKKQVSGVIVDTNGDPVIGANVVEKGTTNGTITDLDGKFTLEVNDNSVLQVSYIGYNTQEVSANGKTSFSIKLGENTQTLDEVVVVGYGTMKKSDLTGSVTNVKAEKLLSKPVVNVGQALAGKASGVEIFENGGTPDGKVRVRIRGNNSINSSNEPLYVVDGVIGVSNINLLNPSEIESLEVLKDASATAIYGARGANGVIMITTKRGIKNEKAQISYDGYVSIGKMAKKLDLMNASEWWQNYNTTMDNGQKYDPEGYAQGKYKKVTPADLPNLFDANGNPLYDTDWQDEAYQTAINHNHQVSIRGGADKTLYSVHLGYMHKDALMRNGFLDRYSGRINLDSQLRDWLKMGANMSFNYNKGNDNYKSYGVKRLVQEAIPLIPVKYPDGSWGSNRDFPGAVQDTPSRYLEEMVNETSNIQTIADLYLDFKITDDLNFKSTFAVDASNRKRNYYSGKDLIQFSKTAGGIATIETLKEMYWQNENYFNYNKEFNKNNRMNVMLGLSWQQRVAESVEATSQNFSDDFYQWHNLGAGTVTIPSKSDDYAWSINSYFARINYTLKDRYLFTATGRYDGSSKFGKNNKYAFFPSFAFAWRASEESFLKGVNWLSNLKVRTSIGETGNQEIGNYAFFQKLGSENTIFDNDYYTALYRSTFGNPDLKWEKTLQWDAGVDVSVLNQRIDLSLDYYYKKTSDLLLEAPIPGTSGLNTIMRNIGSVQNQGFELTLNTHNIQTDNFNWMSTVLFNVNRNKILNLGENDEDIYPKPRHAQGDMLILRVGEPVGSLWGLRRLGTWGEDEAAEAAKYNRLPGDVKYEDLNGDGKINSEDNTIIGCTSPDWTMTISNTFVYRNFDFSFDLRFVFGNDVVNCATHNAEDRSGVANGFKSNLNAWTPQNQHTMVAQRRPMKSYYDSYPDSHWMQNGSFVRGQNFVLGYTFSKSLLLKIKLQDLRIYASAQNLFCITKYKGYDPEVTTYEDDAFGQGIDDFSEPKARTFTFGLNVKF

SEQ ID NO: 1044 - protein, 1120 aa, Gramella forsetii
MNLKKHFALLTLLFFSVVLSAQVKEKMITISFSKIPLSEAMARIEKTSGYTFFYDATQVNVKQEVSLNVKQVPVSKAVGEMLKGIDLSFEVTSTQIALFPKKSTPAQTGKATTIIGKVVDENGEPIIGANVLVAGTTTGVITDIDGNYKLEAPFGSSLQISYIGYTTQTVKAGQKSIIKMKEDSKTLEEVVVVGYGVMKKKDLTGAVASLKASDLEKEQPKTVQDMLRTGVAGLSVGIETDTKGNTSMMVRGKNNLRATSTDKSSLEPLIVLDGVIYSGQMTDINPNDIEQIDVLKDASSTAVYGAKAANGVVLITTKKGTSSTKPIINFSGTWGLSMVNSLPEVYEGEDFINFRRDVEVSKNPSKAATGYFDNPAHMSNADLANWMGNDKGDPTSIWLTRLEFTNTEVNNYLAGRLVDWRDVIYQDVALRQDYTVSVAGKKDEMSYYSSINYLKNESNVRGGGYSAIRARINLENKIQSFLTYGVNAQFTSRDEGYISSSSGNYTTLSPFGSLYEDDGVTLKQYPTGNNNQSNPLLAPAFQNKRNDIENLNAALYLKITLPLGFSIQTTYSPRFEWTNYLFHKAAASPDSGSQNGRVERTHTKDFYWQWDNMLKWNKTFGKHAFDFTFLANWEKFQRWHDEMTNENFLPTDELGYGGIGFGTSPNVSSDDVYRTGDAFMGRLHYVYDQRYLITATVRRDGYSAFGLANPRATFPAIALGWVFSEEKFLHRPDWFEYGKLRLSWGKNGNRAVGTYAAFMQLAPRKYIYVDPATGSLVTANTFYASTMANPNLKWESTTSWNIGTDLTFLKGRLSANLDVYKKITTDLLVSRELPSLIGYSSVMSNIGEVQNTGVELSLNSTNIRMDKLTWRTSFSLAYNKNKITHLYGIMEDVKDADGNVIGQREADDIKNKRFIGHDIDEIWDYKVVGIWQEEEREEAAKYGQQPGDVHLLDKDMNYKYDNTDKEFQGTTMPRLRWSMRNDFTLFKNFNISFNMYSYIGHKKTLGRFTNDNALLNVTNQIKRDYWTPENRNNEYPRLANKKPAGVSYAIYKNASFLRFDNISIGYTFPKKLIEPLRIQNLNVNATMKNAGYISGWPGYDPENSDANTPRVIYFGINLTL

SEQ ID NO: 1045 - protein, 788 aa, Gramella forsetii
MKNRSRSLALTITTALLCTISPLQAQSTSNKTLDTLIVTGTRMSDRTAAESSSPIDIISQESLEATGTTELATALSRMVPSLNFPRPAVSDGSDAVRPAQLRGLSPDQVLVLVNGKRYHTTALVNLNEIQGRGSAPADLNTIPIAAIERIEVLRDGASAQYGSDAIAGVINIVLKGAGKGGSITGHYGEYKVKDGKQYELSGDTGLSFASTGKVHFAAQGGHEDQTNRAVPYNDGIIRQRYGDPKINQGAFSYNGSYSPAEGVTFYSLGMVSRRKVLSNGFYRWADDARNRPEIYPEGFLPQIYNVANDTSWVSGMKASTAWGLNIDLSYNYGNNQLTFDVRNSLNNSLGLSSPTAFYAGGLEITQHVLNADFNKSLDWGHLAYPLNLAFGVEWRGETFNEYQGDEASYMNGGVRSSAGTLLPGAQVFSGFKPSDSGGFDRNSHSMYIDLEGNLTEKFSAGVAGRYEHYSDFGNTRTGKVSLRYAFTPQVAVRATTSNGFRAPSLQQQFFQSIATDFIAGMPYEIGTFRTDNAAAVALGAEPLKAEKSKNYSLGLVVQPVDDLHLTIDAYRININDRIVLSENLTSTAVRHYLQANGYAGIGGGRYFTNGVDTKTTGLDAISSYHWALSNSSMDFTLGYNYNKTEVKRVADNPVRLTAIDPSAVRISQTELTRITSGAPRDKAFLSGVWNIGHWSFTATGTRWGEFTVYNTPTAVPVQQTFAPKWTLDLAASYKLQHWNFTIGGDNVTNTYPERDLIGQGTQAYLPYSRSSPFGFNGAFAYANISYNW

SEQ ID NO: 1046 - protein, 980 aa, Gramella forsetii
MKNSYARTTLSCALSTALLGMASTCAFAQSTDAGAAATTAQTPPTTAGSGDAVTQLDTVTVSGYRRSIQFSTDAKRDSVGFADTVFAEDIGKFPDMNIAESLNRIPGVQLSRDVNGEGLNIAIRGLGTSFTKTTLNGASIATASIGLNAQNQNREVDLNLFPTEFFTQLTVSKTPTASMLEGGVSGVVDMRSARPFDRPGVHVTYQAQADWNSTSEKTTPRGAVMGSWTNEQGTFGALFGVASVRSKLGVEGFESVGWTNPGLTYTQCGLTPPAGTPATNQPTACNVNGGGNWRIPDRVPATAGSGLTTGETIDAAWLLARNPGLSIDQISDALIPRLGRSVYMTGDRDRDASVMSLEWRPSDSMHFYLDTLYSEAKRTTERISMNLIGRNGNMIPLGMQLDQNNVVTSATFANAQYFLEARPYREEVKFWSVNPGAELLFGENQDIKLNVQANATRSWLARESPSILVTSPFTTVDYRNEGGDRPSISSPLDLNDPNLGWGWAGGRVNIQNEKRVTQTRGARADLQFGEDKRNIKIGTSYDQAERTIRGFDNSTAWEQVICRGGGGNVCNGGPGSAIPNTALSSYLRPGPGGFITADFNRFLGDTNYYALRDSAPETNSANTGASAGGIREKNLGFYIETNAETEVWNRTLRLNTGVRYVTTDQTITGPVTINGIRQVQVLDSDYKETLPSFNVAWDVADNVVMRLSSSRTLTRPDPSAMLPNTNFSDPSAQTATQGNPNLAPYLSTNVDFGGEWYTGGEGYVGLTLFNKRISGFTVNGVRRIPFNDLGVPYESLLPIQQAGLDQRGGPNAATVDVQTQVNADGVLNIRGTEAIWVQPLDKLVDGLGFSVNYTHVTQSSEGEGVPAVAVGVAPNLWNGTVYWEKNAASVRLSYTWNDDMVISGANQNGIPYARLNADARGQLDLSASYALDWLPSKPQITLNVTNLTDEPLRTTYAWPNATYDLYQPGRTVMLGIRGTF

SEQ ID NO: 1047 - protein, 264 aa, Gramella forsetii
MKYFSNLLSLTAAALVTSSVAYAADLPAPVFVEEPELPQIQIGGGWYLRGDIGYKVYKDPKVNFADIEFSNEKLDPTGVVGVGVGYRFNDYIRTDVTLDYEWDSDFEANVPCLSDCVGVTTDSLERAKIDVWTILWNGYADLGYFNGFTPYVGAGIGASYVRVKNVNYFNPNGRAGKYPHGNKWNLSWALMAGTAYDIDENWRIDAGYRYLHIGEVQTKSFDSNGHITGIKYDNLAAHEVRVGLRYEFGGGSDGGYDEPIVTKY

SEQ ID NO: 1048 - protein, 1056 aa, Gramella forsetii
MKNFTRKYYLLLILFLCVGHVYAQDIQVSGTVIDGASGLSLPGVNVIEASSKESGAINGVATDANGKYSITVPSDAVLVFSFLGYESQEISVNGRTSIEVTLGEDESQLDEVVVVGYGTQEKSEVTGAVSVVKMDENVQIPATNVKNLLAGNASGLLTNQNPGLPGADNSDLSIRGFGSPLVIVDGIESYLDRLDPNDIETITVLKDASAAIYGARAGNGVILVTTKRGKAGVTDVNYHGYIGFQQATVFPEQSNAAEYLEMSRAGAFNRQYDPTDPSKEINYGEFTEEFLEEYRNGTRQSYDWVKDLIRTGGSKIASHNVSARGGSEKVRYYVSAGVLNQDGIFNGDYDYKKFNITNNLDADISKDLVLSITTSYINETRDYAADGTGAIWTALRTAQPFFQTELPDPDRVPYSGFTERSPRAGTQKKFSGYNLTKLETIAAAFELKYNVPFVPGLTLGGKVNARFRKLYNERLNKPYDVFQYVPETDEYIFRGNVSDNNFRKEYYGDPQRRILSRVYLDYQKIFNEKHKIGFLAFAEKEQNEDNTLFAQRRNLLSPNIPQISAGDDALTTTGGNGVPVEYSRISFAGRLNYAFDEKYLLQATLRADASSKFSPEVRWGYFPSISAGWNMHQENFLMNNSFIDQLKWRVSYSQTGIDSNVGNTAFEYLSGFSELNTVYYFAQGIPTTPIQTVGLPNELITWEETTLYNTGIDFAFLRGQVYGSFEGFYRKREGLLRIPLEGLPSTFGANLPQQNLDSRSDRGFEFNLGYKTQVGKVKFDIAGNFTYARQKYEKYQEDIDVTDPNQVRIDQNSGNFVNRTFGYVTDGLINSQQELETYISSHSFETLNGSPQVGDIRYVDVSGPDGNPDGVINRFDIQQIGYGALPEINFGLNLSVAYEGFSLRTLWQGGSRFNVNVNGFYRNPFDNQAVSLKIHNQYSWVQDPSNPGIGSNPNAELPAFNDNGSRPWNNYLSDFWYKDATYIRLKSAVLNYSFNKALLNKIKVKSLDLYVSGDNLLSFNKLGIYKKIIDPEQSDSLGSFTLPVLRTYTFGVRIGI

SEQ ID NO: 1049 - protein, 262 aa, Gramella forsetii
MKNSIKYAALPLAALAFAAVPAAAQSEAGPYVGVSGGVSLPSDSSNEGEFEAEVPATDDFGSIPNGTDLAWDTDFDTGYTISGQVGYAFENGFRLEAEAAYSEYDVSGHSELLVGGANIDGVDSAVLTRGDASGANPTVGEVLADGQGDVSNFGLFANVYYDIQTGSGFKPYVGAGLGYQWVDVDYRPSGVAVGEDDDSGFAYQLMAGAGYEVSPGVELFGQYTFRDMTEDAEIPLTLLPATLEVESQQSLLTAGVRVKFGG

SEQ ID NO: 1050 - protein, 670 aa, Gramella forsetii
MRNTLFFPILAAATICAAPAGAADLARKAPEAPRAVFDWSGFYIGAHFSAVAGHSNWSSTPAGGSGSIDLFDAFQLFKGTGSYVIGLQAGYNWMLPSRWLIGIEADLNSPNTLGGNTGNTLPSGTVGGHDHQALLGGTVRGRVGYAFDGWLPYVTAGFAWSYDRLRWPPDPSLAQQETALLWRLGWAAGAGVDVPLSPAWSARAEYLATGFGSGTVSFPIAGQSVSSDVLTHAVRLGLNYRLGDDLTKSDVFTKGIDALELERFAVHGQSTFTWQYAPGFRSPYSGANSLAPNQARETFDATLYIGAKLWDGAEFWVNPEINQGFGLSGTFGIASFPSAESYKVGANYPYARVPRYFVRQTLDLGGAVETVQGGPNQFAGKQSAERIVITAGKFSVGDIFDVNKYAHDPRVDFLNWGLADALTFDYAADAWAFTYGTAVEWYTGAWTVRGGVFDLPQTPNSTDLDSSFGQFQLVGELEHRHELWGLAGKVLVTGFLNRARLGNFTDAVRAAQATGATPNIADVRRYTSKTGLSASLEQQLTADIGMFARAGFSSPNLETNAFTDSDRTVSAGLSLSGRMWGRADDTVGIGGLLNHISASRIAYLDAGGLTAIIGDGRLPNPGDEKVFEAYYSLPVYSWRLTADYQFVANPAFNRDRGPVHLIATRLRTQF

SEQ ID NO: 1051 - protein, 669 aa, Gramella forsetii
MNKILLAAGVAGLALAAAQTASAQSIDYGSLQALFNEPVTTSATGSPQRSTRVPVDMDIISAEDIERSGAVDLPTILSRVAGVDVLAWSADTADVGVRGYNQAMSARLLVLINGRQSYLDHYGFTNWATLPVRLEEIRQIEVVKGPNAALFGFNAVGGVVNIITYNPKFDDTDFITVRGGTEDYAEASVGQTVKLGEQFSARVTGGYSRQDQWRNSVGVADRLIPNPERATLNVDTVTQLADKVELRVEGGWTHNRQAGFISTYSYGPSKYLTESLKAALTWESKAGLIQATAYQNNLTAKSEIASIDTRWENKIQVFNVQDLFKVGANHTFRVAGEYRRNETPTTPGHTAKIKYDVLSASGMWNWQVTEKFALTTAIRHDKLSLEREGDLAPGLPNQNAALWDRTIKETTYNVGAVFTPTDADTFRATYARGVQLPTLVDLGALQLIIPAAPGVNIAYVGNPGLAPTVVTNFGVGYDRDLPQIRGRAGIRFFVQKSEDIKGQPNSAQLDIMPTATSLPGFSYRNIGDSKLKGVEVLASGKYANGMHWNANYTYTDVEDDTLAAFDAATRYAAYELSTPKHRANLNVGWTNETWTVDGFVRYEGSKDLYYAAAVRPVDSFVSLAGRVAREFDGGVTVAVSGQNLLSERQQQTSGLKAERRLFLSVAKAW

SEQ ID NO: 1052 - protein, 419 aa, Gramella forsetii
MNEITTKKANPILLGVLGVFVSNISHASALEQSGQSILPFLENGNYAEANLFAVDSSVSGVVNDRADLVRDHQSRDTGDIAESTQFYTAAIKLKLTDRLGFGVLYDQPFSADIKYPARSNNSYFDNDISYEGTSVKADTQNLSLLFGYSPYQLFQIYGGPVYQTVKANVALRGNAYTQAFNGYNAKFKQQGEVGWLLGGSYQLPDIALKAAITYRSKIKYKFQVEEDIFGEPLKLVENEKTKLETPASLNIDFQTGISEKSLVYMNLRWVNWKEFETRPPQYGALSEIIMKEVTGGAYTQGFKLDSYQNDQYSATVGLAHQFKEKWGASTDVSWDSGTGDPASTMGPIKGSWSLGLGVQFNPAKNYFITGSLKYFWLGDTKTEDGTYYLPIEGIKPYAEQANFKNNHAIAYGLKFGYWF

SEQ ID NO: 1053 - protein, 1075 aa, Gramella forsetii
MKTKLNGILTLLLALIVQITFAQEQKVSGMVSDESGSLPGVSVVIKGTTTGTETDFDGKYTIMAKRGAILSFSYIGYKTVEKTVGISNVLDVTLSQDSNTLDEIVVIGYGTTTKKSFTGTASVVSTENIDAKAVSNIAQALIGEASGVTVTRTDGRPGASATIRIRGFSSIEGNRDPLYVVDGVPFTGDINSINPNDIASTTILKDASATAIYGSRGANGVVVLTTKRGEVGKDVIEFDIQTSFNQRTLPRYNLVNNEERYMGLVYDGLKNTGEFTGEADPAQYALDNLFADKGVAPLYNMWNVADGNELIDPATGSVRPGVTRKFTPTDWFDAGYRTGVRNEMNFKTSGGNDKTRHYFSLGKLSDEGFIQESQYDRYSARLNVTTKPIDRVKIGTNLDYSYSEYNDATGYGGGNVTYMLDFIPTIYPLYLRDTNGDIVVNPNTNNQMYDFGDNSAGNARDFSATYNGVGESIYNINRTKRHSINGNVNLVLDIAKGLTFESTYGVNIYSSNLDNTRNSIQGSAGVALGGTLFKSNETYTSQNLNQILRYNKTFGQDHNFDILAAHESFEATTEDFNLSKKGIVNLNPNAAGVPENYLDQNGVSSGSKTDTSLESYFTQANYNYAGKYYISTTLRRDGSSRFFKNKWGTFWSVGTGWIISEENFLKSSDVVNFLKLKASYGYLGDQGNAAFAGQLGFNIENLLGATSLVPRAVVDPNITWETSNQFQTGVELELFNGAIEADLDYYIKTTSNLYVNKRLSPSTGDAIILTNDGELVNRGFEFNVTGNIVRNEDFRLSLTVNGEMFNNEITRMPIENATGKPKAVNIDGRYGQSKGRSIYDFYIREWAGVNAENGDAQWIEHWVDANNDGEYTSGEGILDMLVYTAANPDKTIQERITNTYADATRKYVDKSLIPTVRGAFRVNTSYKSFSLSTQFGYSLGGYGYDSNYAVLMSNGKVGASSYHVDMENRWMNPGDITDVPRLYSNENIRVNGTSSRFITSTDYLALNNVRLGYNVPSRYLAKIALSSVNLWVSGDNLFLLSARDGFNPTTSVTATSDRYTYNPISNYTLGVRIKF

SEQ ID NO: 1054 - protein, 974 aa, Gramella forsetii
MTIRIPALGLAIRRALAITATTTLAVPALAQQAPEATTLDRIEITGSRIRQVDLETAQPVLTVSRADIERQGFNSVADILQNLTATGSPALSRASPLSAGEAAGGSYVNMRGLGAQRTLVLVNGKRLGMTTSGFQDISSIPAAAVERMEVLKDGASAIYGSDAMAGVVNIITRRNVQGVTANVYHGQYSEGDGARTQYDVVAGWSNDRASISVAAEHVEEKGVWARDRGFSAYTYTDGHADDGWTTVGQWGRITGFKGPGCSNSRGCSYSLDRGSQPGGPDSFHLSDNTPFTGDVSNSNEQMHLQTPIKRDSIFVDARVELNDQVRFNTQLAYNRRTTTRQIAGYPFQSGPAGITPMSADSWFNPFGSHHGYDTPSDVHWNRRTWEIPRVSTSDLTTWQAVAALEGNFEFGGRDFDWEAGYQYNRSELTQRATGNLHKQRVADATGPSFYNPATGKVECGTPDAPIAGCKPWNPLVPYGQDDPYGLTGNTELQDWLFPEELTRGRTTTRNLFANLSGSLASLPAGELGFAVGAESRREDGRFIPDALAQTGATTNLAAGPTGGGYRVDEAYLELSVPVLRDLAGARELTLSAATRYSDYSTFGGTLNSKFGFTWKPIDQLLVRGTWAQGFRAPTIANLYGGGSETFTTGFRDPCDTVHGAAASSAEVRARCAADIANADTYRQLGQGNEPITGSSGQTPLPFTNGSNPDLQPETSTSRTLGLVWSPTFAEGLHIALDWWKIRIDNTIVSDHPNDILRDCYELGIAERCSSFTRDPELGIVNKLNFGNRNSGFRQAEGYDLEIGHKVETRWGRLSADWKSTYVVNAEEKTTNEAGVPAIPSNGIATNGGIGFRVRSNASLGWEHGNLGLTWGLRYFSAVKERCLGAEDYPNECSHPDQRAPWFSGTRDYNRRGSVTFHDVQARYSLPWDATVSIGANNVFGRQGPAMYSQPSANFSYYGGFDIGRFIYMKYQQRF

SEQ ID NO: 1055 - protein, 1077 aa, Gramella forsetii
MRTLFVALRLCSSLFFAGLISAQTPSATLVGRVTDASRASVVEASIRVRDAGTNEIRTARTSGEGEYTVSSLAPGIYEVTVEKPGFKMTRETALELAVGQTARLDVVLQIGAVTDSVEVQATVPLLNTETSSRGDVIAPREITEMPLNGRDFNDLAFMVPGVQTAEEGGKGSPYVVNGARADASNVTVDGFNNQNPRDAGAQARPPLESLQEFKLQTSGYSAEYGRLAGGVVTMALKSGGNSFHGSVFEYVRNDVFDARNFFDAGKSKLRRNQFGASVSGPVVLPKLYDGHDKTFFLISWESFRGIAGSSSLGVIPTDLERAGNFSKSLDATGKVIPLKDPLASGSCTATVATACFPGNIIPANRFNSAAQQLLSIYPSPNFSGVNNYLSNANSPDNWDSFVFKVDQKLGARDNVSVRALERWETSNNPFSGSPLGTFGASTDNGQALYGVSETRVFSPMLINEFRMGLTRTTNNETSDHAGTNWAAQYGIPGTTTDPSLAGFPKFSITGYETFGDSTTNPIRYVVNNFNWNDVVTWNKGRHTIRLGGDVLHVQYYQPTNSNFNGTFTFSGKNSGNGFADFLLGYTSSTSRKIGTVTNHIYSTNYGAFIQDDYKIHPNLTLNLGLRYELQSMPYEKYGQMSNYVPSLRKVILASAMTVPNLDATVASAGLTGLVGLAADNGIPKSLVNNNYDNFAPRIGFAWRPFGNNRTVVRSGFGIFYTGNRLSAMRTDLTGGFPFSLSQSFTGATNAPANLTLTNPFPASLAKLSGITTSNGYEVNAPSPYLASWNFTIERDLGRGVGIETGYSASKGTHLGRKYDINQEVRTPSATTRPYPGYGDVEYYTFGGNSSYQAGTLTVRKRFEHGLFFRANYTFGKSIDTASGLNYAGNGGYQGAQDSLNLKSERGRSDFDIRHVFSMNFAWQLPFQRNLFVRGWQFAGTGTVYSGQPLTPQLSGPSNDLAQATRPDRLSNGALDNPTANLWFNPAAFAIVPDSAFRYGNSGRNILDGPGSANINLSLSKWFQLAERAKAQFRWETFNTTNHTNFSLPAVNLDKSNAGTITKAKAARVMQLGLRLEF

SEQ ID NO: 1056 - protein, 739 aa, Gramella forsetii
MNRQFIVLLLSGCGFTTAAFAQETTGNDAGVTRLDQIIITAGRNESSIAAVAQSVQVIDREQVEEAMRISPNASDLISRLVPGFAPSNQTISGASETFRGRSVLIMVDGVPRNTPLRDLSRILSMIDLNSVERIEVVNGASSLYGAGGTGGTINFITKRGTSDKPTVTVRTGLSGYTENLGKSTAPETSISIEGRKDKLDYYFSGTGDWTRRTYDGHGNEMPSDAMLGQGGGDRTVNGNFFGIVGYESGPRRFEVSFDWTYAKQKPEWFTNYTTNPVSPRFGSAYTGEPLREDSKYLTAKYTDQDFALGNLEVKAFYNKIFKQSPFTELSAVNTQVYYSGNPRQPTAWFNQSKYDFDRTGVNMTITTPMDFITNGSKLTWGVDYAYDKVAQTLLNDEDAIAPMTQNSIAAFAQAEVPVTERFRLQGGARFDQFYLDVNDFTRPTAVAWPARSLANIYPAISVLGGSFDYNAWTFNAGAVYDVTEEVQAFGNFSQGYSLTDIGAFTRRAGVNSLAEICDAYGSIAAIYGCRGTPDYTISYADIAPKPQLVNTYEVGLRGDWGDLRSTVSSYISTSKDGVNYDIAANRVSQQKERIWGVEARADYDINSMFTIGGLVAYQEGKYDANRDGSIGSDEYLPNNRIPTTWKGLAYTTVSFEGGYKVRGEVEYFSGRDRIKGQQIDDATLVNMAFSKTFENGSEASLAVRNVFDTYYINPTATATRNAPVAGLGRSVFLSYKVTF

SEQ ID NO: 1057 - protein, 859 aa, Gramella forsetii
MPSNAFARPAFGPALAVTVFSSLAPPLFAADTQLQTVTVQASSQADDDALPTRPPTSVYGGTETKVLDTPRSITQVNAEQLANDPIRSADDLVKYAPGITRGGGQNAGIAPQFRAQGSEVFQDGQRAYGVRHPANFNAYEGADIVAGPSSVTYGSVSGSGGYVNYLSKKPDFSGFKTRLSGELGAWVPDGQSRDSRKFSIDNTGPLSDQLAYRVSITQQRQQDYYDNVDNNFDAFYGALAWRNDNLRVDWNASYDNYYDYNITHGWNRATQQLVDSGQYYAGRATPIIQNGNTLWSPVLASGAANAPTLGWVQRQRNAQGQYSVVDGSFQAASPNTQASPGTLRGWVYDPSLAGNGLTSLSPQAGQRGEDQSSSRRFTTQLRIEGDLSPSVTLANSTFYQRSRDLTDAVGAFQVQSRDNLLDNRFELRSGNETRIGGLALRDDSNSGLIYRREFNQSIAANNHFGSTINAYDLTLDPSGKNPGDLLGLTGSNPAGGNGAWIGQPGVPQYSNYYGWLNLAAMYPAGHGLYAESLAPYTAESTWTTKTLFSQHNLRLGERVGLNIGASRSWIDARIDNPFVLAGGSDRRDSHNYRLFAFQVSPYVKPTENSTLYYTFDRSLAVNTGFFSNGLGWGSGSGANQLNPLAFQSLSVLHELGLKVEAIPDQLFMTLATFKQARDQSPDSNNNIARLIIKGTEATLRYQPDPHLRSGLNLSRLSAYNEFTSQAGFASAGFIPDNGTVFGDNNSLNQRPSGRFDAVQIPEYTASGYLDYRFDSGFGAELSGWWTSSWYLNLSKTVKVPDEYNLDLALYYRQPQWSTTLRVLNLTNELNFVSGLAGSTNTFLQPMPGRTVLAQVDYRF

SEQ ID NO: 1058 - protein, 1028 aa, Gramella forsetii
MKLKTSIIAFLAIFQFATLLAQENSVSGLITGSEDGEPLNGVNVLIKGTNRGTITDFDGNYRIDIEPGEVLVFSSVGFETQEISYTGQSTLDVTLVADLESLDEVVVTSFGIEQEKKSLGYAIQEIDSEEITKTKQQNLVSALQGQAAGVQITNSGGAPGMSARIIIRGVNSLDPNADNQPLFVIDGVPIDNSTVESVGTPRGLSNRAADINPNDIESMSILKGAAATALYGVRAANGAVIITTKKGKAGRIKINLNSSVGFEEINRFPEFQETYGQGFSGVYDPDSFWPNWGPSMAEINEIDPDVVFNDIWRDAMQTGIQIDNTLSISGGSENVTFYGSLGNLDQEGIIPFSDWGRTSAKLSGEIKFSEKFRFSGNVNYTISGGNRVPHDRFMERLVYWAPNHDVEDYINPDGTMKTYGNTNPIYDARFSTFEDEVNRTVGNFRFSYSPWKFLDVTYLIGTDYYSDRRTEITPGPLGIDGENPLDSEGFIRETRINSRDINSNIFLTFKNDWTEKFKTTLRVGNDIFERDYERVDAEGEDFVIPRFYDLSYTSRVSTSQDKRKRRLVGVYGDLMLNYDETLFLNITARNDWTSTLPIGNNSFFYPSVNLGYVFTESFEQPGWFTFGKLRGSWAQVGKDTNPYAIGQTYNSPDVYPLNGQVGFTRFSQFGDLELKPEKTTAIEFGTDLRFFENRLGLDITWYKSNSKDQIIPVPVSESAGFSTFITNAGEIENQGWEFIIRGTPIKNEEFRWDITLNAAYNKNEVKSIREGIEEIEVGSQFGYAGSRVTIKLLEGEAYGNLFGTSYGRFGSDPEDIFLNESLPIIIGADGFPTRNSDQLILGNSTPKWIGGLSNNFAYKGFDFSFLIDFRAGVQQYNQFDNFFSAFGIAEYTLNRNETIVFDGVLEDGSPNTQPVFLGQGEGPDGRDYGAGFYRNRYRGVSENFVQDAAFIKLRNITLGYNLQENMLERLPFTSVRASVAANNIILYTPWDGFDPESFSVGAGGNATGLTGLGYPGVRSLFFTLNLGI

SEQ ID NO: 1059 - protein, 994 aa, Gramella forsetii
MKNFYKRSMLIIMFLLAIALLVLLAMGEAKAATPSSPTYFYQQEITGKVSGPEGEPLEGVTVFIKNKRFGEVTTSEGTYAIKANPEDTLIFSFIGFKSREIAVGNQSSINVVLKEDIASLNEVLINAGYYTVKRRERTGNISRVTAEEIENQPVVSPLQALQGRMAGVEITSGGINPGTASSIRIRGRNSLRDEGNFPLYIIDGVPISSVPTESNSLVGSAGIDPLNNLNPNNIKSIEVLKDADATAIYGSRGANGVVLITTKTGKKTGTNLEARFYTGVSTVPRRLDLLNTAEYLEVRRQAFQNDEAEPTENNAYDLILWDQERNTDWQDFLFGGQAKTTSANLYFTGGSDLTSFRMGGSYFKQGTVYPTDYNYHKITGNFSLNHYSDNRKFKLGASINYGLDKNELAGNISLGPSVYLLPPNAPTIFNPDGSLNWEDWSNAGIDNPLEGYFNFSDIQTKSLIANINLSYEVLKGLHLKTSLGFTNYLTDESRKLPSRSYNPAENTINRSADLATQRNSWIIEPQLNYTTNLGKLETNFILGGTLQTENFTRQSLEGIGYASEALIGNLAAAESIVNAQTSNTEYRYAALFSRLGLNWDAKYYLNLTGRRDGSSRFGPNNRFANFGAIGTAWIFSEESFVQGFLPFLSFGKLRGSYGTTGNDQIGDYGYLDAYEATRGPGGLYPTSLANPDYSWEVNKKLEAGLELGFLDDRLNLGLSWYRNRSSNQLVGYPLPVTTGFGVVQANLPATVENRGFEIELTSYNINSDSFSWNTSFNLSIPKNELIRYPDIDQSSYANVYKVGYPLNITFNYNYTGLDPESGLYTFQDVNEDGRLNIEDKTLLEDRNRTFYGGLRNDFTYKGLNLQFLLEFVKQPGRLSFLNAGRPRNILTSYLNNSNYQRPTQSNEGSLAYSNAINSSVFNQDASFIRLKTISASYNLKNLASKLKLEQFQLFLNGQNLFTLTSYEGLDPESPFGGASINNLRTISGGLQLNF

SEQ ID NO: 1060 - protein, 372 aa, Gramella forsetii
MTKVVVLSAVAAAVMMAGAANAAEIYNKDGNKLDLYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYDNGDRAEAWTGGVKYDANNIYLAANYTRTYDMTYMGDTLGGFAHKTDNWEMVGQYQFDNGLRPSLAFLQSRANDVDGLGSFDLVKYIDVGSYYYFNKNMSAYVDYKINLLKDGNPSNPNTDNTVALGLVYEF

SEQ ID NO: 1061 - protein, 762 aa, Gramella forsetii
MKRIVMMAIALSGAGFAVHAQTSAKADSLKVVNLQEVQVVSTRATAKTPVAFTNVRKEQISKQNFGQDIPFLLSTTPSVLTTSDAGAGVGYTTIRVRGTDATRINVTANGIPMNDAESHAIFWVNTPDFASSLEDMQIQRGAGTSTNGSGAFGASINMRTQSISSQPYAEVSGSYGSFNTHKETVKVGTGLINKYWAFDARLSNIQSDGYRDRASSDLKSYFVQGGYFGESTTIKFITFGGKEKTYHAWDGISKEQLENDRTYNPNGVILDDNKGKGNPIGFYDDQTDNYRQTHYQLLFNHIFSPAWNLNIAFHYTNGFGYYQEYKNGRTLKEYGLKPFYLPDNSEPQKKTNLVRQKLVDSDFGGGIFSLNYQNERLNASLGGGLNRYSNDHYGKVLWVKNYTEQLDPEHEYYRNNGGKTDGNVYLKANYQLTGSLSAYADLQYRYIRYTIDGDNDKWDFTATPERLQRLDVREHFSFFNPKAGLFWQINPNHSTYASFSVAQKEPTRNNYTDGMFDEHPTAEKLLDYELGYTYRSEWFTAGVNLYYMDYTDQLVLNGKTNDIGEAMAENVKDSYRMGVELSLGAKFNDWLRWDLNGTWSKNRIKNYVGYVYDESLVNGEIVDDLYTQTAIEGGNTPIAFSPSFIGNSLITLGSNGLEIALQSQYVSRQYLDNFGTKENSLDAYFVNHLSASYSFKTRHTKRITIGATVYNLFNTKYETNGYSQSVALYENGDKTKTYAIKHDPRFYPMAGTNILAHLTLRF

SEQ ID NO: 1062 - protein, 319 aa, Gramella forsetii
MKLKTLAVAVALMASGSQVVASELYNQDGTSLEMGGRAEARLSMMDGKAKDRTRIRLNFLGKQEINENLYGVGFWEGEFETKEEGAVDNNSDLETRYAYAGLGGKYGEVTYGKNDGALFVLTDFTDIMAYHGNTAALKLPVSDRTDNMLSYKGQFEQLAVRASYRFADRTTDAKGFTDNEEDGFSLSGIYAFANTGIELGAGYADQNDSDEFMLAAAYSVGDFYFAGNYTGADVDVAGESADYKGYELAASYTMGQTVFTSTFNKGELEDADTVENLAVDVTYYFKPNFRGYASYNFDLMDNEGADEKDELALGLRYDF

SEQ ID NO: 1063 - protein, 725 aa, Gramella forsetii
MKVKLLLTAITLSCLAIDVLAQVSISGKIVSADTNEPVVGANIRIDQSLSGCTTNGKGEFNINNLPDGKHVLRITHVSYTPKSVTTKGGEKNLLIKLQDSFTNIGQVVVTGTGTHHRMTDSPVPVSVITAKDLSNASVTSLDEALQKLTPSFSSMTNGMGTTLSLNGLPDDYFIFLENGKRLYGDDTYARINVAKIKRIEILNGASSALYGTNAIGGVINIITDDAKNAINVSSDTRYASKGRFTQSVNADVNTGKFGSYTSYRRQQAEGWQLNPYEENSKTHELEETGKVASTGFYANTVNQKFTFDATDKLSFYARGGYYDNKTRRPYEAYDYNILHETFNYGIGTQYMISKGNYITADYYADHFSSSYCFFKDNKTYNGKAGEEQVRKRTRNHNLSIKGIFKLGGRHKLSVGTEYIVDVLKSQTDNIAKEDAYTLALFAQDEIKLLRNLQALIGVRYIYHENFKNHATPNVALMYKPGKFNFRASYAAGFRTPTLSELYATDIAKKNDRLTIGNLDLKPEKNDYFSLSAEYVHERFSVSVNAFYNNIRDMIDYNTIATGDKAMEQYGHKEVRQRDNIAEAKVYGINVSANAYLGAGFNLSGGYTHLNTQDVELEQPIDKSIKNAYNINAQWAHSWKIYRLNINLNGRINSKRFSKSYGYAPDYQLWDLNTRHSFNLKSVIIEPGCGIENLFDYTDDRPYNSNYATLTPGRSFYISLSLKFKS

SEQ ID NO: 1064 - protein, 452 aa, Gramella forsetii
MKAKAILLASVLLVGCQSTGNVQQHAQSLSAAGQGEAAKFTSQARWMDDGTSIAPDGDLWAFIGDELKMGIPENDRIREQKQKYLRNKSYLHDVTLRAEPYMYWIAGQVKKRNMPMELVLLPIVESAFDPHATSGANAAGIWQIIPSTGRNYGLKQTRNYDARRDVVASTTAALNMMQRLNKMFDGDWLLTVAAYNSGEGRVMKAIKTNKARGKSTDFWSLPLPQETKQYVPKMLALSDILKNSKRYGVRLPTTDESRALARVHLSSPVEMAKVADMAGISVSKLKTFNAGVKGSTLGASGPQYVMVPKKHADQLRESLASGEIAAVQSTLVADNTPLNSRVYTVRSGDTLSSIASRLGVSTKDLQQWNKLRGSKLKPGQSLTIGAGSSAQRLANNSDSITYRVRKGDSLSSIAKRHGVNIKDVMRWNSDTANLQPGDKLTLFVKNNNMPDS

SEQ ID NO: 1065 - protein, 1072 aa, Gramella forsetii
MKAKFSSILTLLLAFVVQITFAQEQTITGMVTDSDGLPLPGVNVLVKGTSTGVQTDFDGNYSINANVGDVLAFSFVGLKTAEYTVANNTEIDVVLEADAAQLDEVVVTALGIKREKKSLGYATQSVEGSEVSDVPTTNFMNSLSGKVAGLNIKSSGTPGGSSNIVIRGNSSLTGNNQALFVVDGTPISNSNSNTSDQTRGRGGYDYGNAAMDINPNDIASINVLKGAAASALYGARAANGVVIIETKKGSKGKGIGISINSTVTTTHVDDTTLPVYQDQYGAGYGQYYPSDDGYFLLYDIDGDGNLDETTPFTEDASFGAPFDPNRLIYQWNSIYPQLEGTFQQAQPWTAGATTPSSIWNMGVTTINSVALDGGTDKSSFRVSGTHLDQKGALPNSSIKRNTLKFSGTHDFNDKFSAAANITYTRTDGKGRYGTGYDAENVMQSARQWWQRNVDFQEQRDAYFATGENITWNPNGPDNLSPIYFDNPYFTRYENFQTDNRNRYFGNVNLTYEINDVFSVLSRFTFDTFEELREERRNVGSTGVSGYSRINNRDSEFNYDLILNFNTDIADGLNLDGNLGMNLRRNYREFIDASTNGGLNAPGFYALSNSASALQPPNEYEATRMLDGFYARASLGYLDTYFVDATIRRDRSSTLPKENNTFYYPSISGNVIVSNLLDANWLNFAKLRANYAEVGNDTDPYRVFNTYTISTPFAGNGIASNNSQLANINLKPERTKSYEVGIETNILDRRIGIDASYYNIQTEDQITPVPVSNATGFNTVLLNAGTIENKGLEVSLTLNPVRTEDFNWNITANWAKNESEVIELREGIENLELASLQGGVSINATPGVAYGAIRGTDYVYDDAGNRVVNSRGYYQVTSNSNNIIGNIQPDWTGGIQNSLQYKDFTLSFLIDMQKGGDIFSLDTWYGFATGLYDQTVGTNDLGNPMRNPLSQGGGIILPGVTADGQPNNTRVDFSNFGNPYGYARDANKGHVYDAGFVKLREASLTYNFSENLIDQLPLTNASLSIIGRNLWIIDKNVPYSDPEAGLSSGNIQGYQSGAYPNFREIGASVKLNF

SEQ ID NO: 1066 - protein, 243 aa, Gramella forsetii
MKRKLAITGAATLAFAFAGGTAHAQSAGDFYVSTGWLHLAPQDSSDPLFVYRVGGTPINQSIPNTGAGINDADTLGLAAGYFVTDHISTELVMGIPPKFDITGKGRFENFGVLGRAYQWSPALLLRYHFNDANAKFRPYLGVGATYVWFTGAKITNSSFENGVLGGPTSATTSNQWAPVLNAGFTYNFTKHWFGGLSISYIPVSVTATFTTARRTPVGTLTETSKAKISLNPIVTYLNVGYRF

SEQ ID NO: 1067 - protein, 696 aa, Gramella forsetii
MILKKYCFLVFVLFVFQNIEAQKKGSKTIDSLKTEKLKEVVISSLHINNSLLNTPASIGILSKKDLLQNNTTDITTVINTIPGVFMQSSNFTTSRISIRGIGARTTYGTNKIRAFYGSIPLTSGNSETVIDDIDLENLNQIEIIKGPLSSVYGAGLGGAILISPQLSNNGNQSAGISTVFGSFGLLKNSLNFGLDEKSGSLNISYHNLKTDGWRENSSYNREGITLAGELFRKENSKLTYFSNYTYLKAFIPSSISKEVFNTNPKAGAPTWVASKGYKEYKSVLGGLAYDFNINENLKNSTSVFINYKDSNEPRPFDILRQYTFATGARTQFSGNFKIGRVENQFIAGAEYFTDTYSGNTFQNLYQQNNGLGSLQGNQLTETDQKRHFYNIFSQLRTLLSDQLEIQAGLNYNKTRFDLNNYTENINEEYSYDGIFSPQISFLYKPHSLKTLYFSVSRGFSLPATEETLTSEGKINPDIKPENGYNFEVGGKFYFFNKRLYTEISLYRMEIKDLLVAKRVGDDQYVGANAGKTFHEGIEITLNHNWPINRFLVLNSYLAGSIGNYKFKEFIDSGNDFSGNKLTGVAPQKINAGITLNTNIGVYFSTDYQFVGEIQLNDANTAYSDSYTILNLKTGYRFEILRGLTSHISAGVNNVTNEKYASLILPNAVPTGNSSPRYYYPGLPVNYYGAVSLNYLF

SEQ ID NO: 1068 - protein, 277 aa, Gramella forsetii
MKNVKTLALAATAVAAMSSSAFAADRSDLYATDYKWMQFNAMYSVDELPSSGESGHNYLEMEFGGRKGIVDLYGYVDVFNLGNEKAGDKAQGSGASKMFMKFNPRFSLDAITGKDLSFGPVQELYFSTLFNWGGGAIGEDVNATFWGIGADVNVPWLGKTGMNLYAHYDLNKKEWNGYQFSANWFKPFYFFENKSFLSFQGYVDWQFGGDEDMGNEFVPMSDNGGAAFFGLYWHSDKYALGYGLKGYKDVYLLKDGAGIVGLETTGWGHYFTATYKF

SEQ ID NO: 1069 - protein, 286 aa, Gramella forsetii
MYIKKHWIALSILLIPCIGNAQEIKIDESWLHQSLNVIGRTDSRFGPRLTNDLYPEYTVAGRKDWFDFYGYVDLPKFFGVGSHYDVGIWDEGSPLFTEIEPRFSIDKLTGLNLAFGPFKEWFIANNYVYDMGDNQSSRQSTWYMGLGTDIDTGLPIKLSANIYAKYQWQNYGAANENEWDGYRFKIKYSIPLTNLFGGRLVYNSFTNFDFGSDLADKSHNNKRTSNAIASSHILSLLYEHWKFAFTLRYFHNGGQWNAGEKVNFGDGPFELKNTGWGTYTTIGYQF

SEQ ID NO: 1070 - protein, 348 aa, Gramella forsetii
MRKLLLIPALLLGTAVVAQEYNYEITPVIGTMIPEGNLKLDNQFLTGVELQYNGFDALIKPELSFLFTNNADYKNSNITTDIYRIALNGVYEYKSNSLFTPLAKVGVGYEALENNFAGNRDSVFFDAGVGAKVALAENIALKLEAVYMLKNNNARWDNNLALLAGVNFAFGPKAQPVVAPEPVAAPAPKPVPAPAVVPAPAPKPVDGDDDKDGVLNSIDKCPKTPIGHKVDKDGCSVLVDLHINFDTASYKVDNASMPKVKEFAEFLKDMPNYNAKIVGHTDSVGSDKDNQKLSENRANSVKTLIVKEGIDTKRITTEGKGEKSPIATNDTKEGKAQNRRIEAELIKK

SEQ ID NO: 1071 - protein, 797 aa, Gramella forsetii
MRLGIIALAVSSTLAIPAVQAEEQQPGFEKIEIIGSRIALRTATDSVAPVDIITAEQLESTGMTETAKALQFAAPSYSFPFSSVTDGSDAVRPASLRGLSPDHTLVLVNGKRRHGSALVHLSGTVGKGSSNVDLNAIPMTAIKRIEILRDGASAQYGSDAIAGVINVVLKDSDQGGSISAQAGQTYIGDGEQWRVGVNHGISLSDDGFVNVSLEAHHKDSTNRAGLDPRQQYEKLPDGSADPREATFNRKSHQVGDAEYDNLGLFINAAQPLTKDGKLYAFGGISQRETKSGAFYRRALDARNLTEIYPDGFLPKINPKIIDASLVLGYEFSLGEWNIDTSAGHGENSFNYNIVNTLNASLGPDSPNEFDAGTLTTRETNLNIDASRYFAFANDSEILFATGVSWRQNGYQIEAGETGSYINGGYDNRAAGSQGFTGFTPESQVDETRDNTGVYMELENQLTNEFYWAAALRYENYSDFGGNTSWKLAGRYDFTDNLALRGTINTGFRAPSVQQLYFSNISTLFNPDPVTGQLVPIESGTFNTLSPVTKALGINELDPELSQSFSLGLVYTNDTGLALTLDAYQISIDDRIILSSSVTPNDSPAVAAALAGTNAESARFFINAVDTRTRGVDLVVSQDFDIGSWGDLRANLAYAYNKTEIQDIHFPQILDGLGKKLFDSIEQTRMTSATPHNTGNLGLTHELGDFKTNIRLSYFGDYTVGYATGDVNYSDQWVMDLSVRYAATDALSFTAGVQNLFDVYPEKTPAINSNNGIFVYPLTNTPFGFNGGYYFLEAKYTY

SEQ ID NO: 1072 - protein, 420 aa, Gramella forsetii
MKNAEPYFSLRYSPVMVLALAGLLPTAQAGFFEDARGTLSLRNYYMNRNMVDRATQGKREEWAQGFILDLQSGYTEGPLGFGVDVRGLWAIKLDGGKGTAGNEMLPIHDDGRPADDFGRVAVAGKLRFSGSELKIGEWSPALPILNANDARVLPQTFQGGLLTVREIPGVTFHAGQMRANSPRDDASLQNMSLHGSSSGATSDRYNFAGVEFRFNDSRTTLGAWFGQLEDIYKQRYFEIRHLQPLGKNWSLSSRLGLFSGEEDGRGEAGDLDNKTLTGLFALKAGANTFTFAFQRLSGDDRWLRLNGTIGSMLPNDVFTTSFDNAREESWQLRHDYDFAALGLPGLIFMSRYVSGKNVHTATVSDGEEWSRENELAYVVQSGRLKNLSLRWRNASRRADWGSNTSYDENRLIVNYPISLF

SEQ ID NO: 1073 - protein, 821 aa, Gramella forsetii
MKYLFTLTLLAFTTLVFAQRPEGGRPDVTITGKVLEAETNVPLEYATVSFTNSEGKVVTGGITDPNGNYSIEVAAGVYDVKFEFISFETKVLPGQKLFKSTTLPTQALAIDSQSLDEVIVRAETTEVQVRLDKKIYNIGKDLTTSGATVSDALSNVPSVTVDVDGAIALRGNENVRILINGRPSAIAGFGSVDALSQLPADAIERVEVITSPSARYDAEGTAGILNIILRKEKTLGLNGSIQTNVGDPERYGITGNINLRTDKFNIFNTTGYSKRTSPGNAFFENRFLSDDVTNPLIEETREFDRNRGGFNTNLGIEYFLTEKTSVTASGFLRLSDNSSGTDNFTDEFDTNGDLAISRTRLEREIEDDKTYQLSLNSITKFDESGHELTSAFQYAVNEETELSTITEFNTFPTDVTLPAEDITQIEDQTEYLAQVDYVRPIGENAQFEFGYRGNFEETVTDYTLLEQEEAGGAFIRDDGLSNIFTYKEDVHAIYTQYGNKFGDFSFLAGLRYENTRQQGAVDAVVEDSDLGTNLDFDNKTDGLFPTLNLTYEFNDRENLTLGYNRRINRPRGRFINPFPSRSSEANIFQGNPDLVPSFASAYDIGYLKRWDKVTLTSSIYYQYETDSFERIQEDTGLVTANGIPIIRTLPINLSTNQRYGAEMGVLYNPKKWLRLNFSANAFLFETEGEFNGVDYGASNFSFFTRGSAKVTLPYKIDWQTNVFYRGPRNNAQTETKGFLFTNLAFSKDILNDNATIAFNVSDVFNSSKRQSLTQTDSFVSDSEFQFRVRSFNLAFTYRFNQKKQRSRGNRGGGDDDGDFEG

SEQ ID NO: 1074 - protein, 1048 aa, Gramella forsetii
MLKNFKPVSLILCAGALCFSGSMYANIAPVEQGASISQQNGKVTGTVEDDFGPVTGASVVVKGTTNGTITDMDGNFTLEGVKNGDVIQISFIGYSTMEITYTGQPVGVIKLAEDTQKLDEVVVTALGMKRSEKSLGYAMQELKGDALLDSRESNIANALSGKVSGLQVVRSSGSVGGSSKIVLRGANSLTGSNQPLVVVDGTPMDNFTGGVDDAWGNSGTDMGNGLSDINPEDIESMSVLKGASAAALYGSRAGNGVILITTKSGKKNDGLGINVNFGVTADTPFMLPELQSSFGQGSVGAYNDQTNLSWGPRIEGQTITTYDGRQVPMAAYDNIGAFFGTGTSFNEGVSFQQDVNGTSMFFSFNRQDDSGVTPEQSLNKTNLTLRATSFLDEAKKWKVDAKVNYVNQNAHNRPIIGINPSNAFSTVYNLPRSLNVLDFENCVDDQGKMVWYDKSNSPQENPYWVTQYRQNDDTRNRILGNASLKYAPTDWFDIELRGGTDYYTTTTTQKLYSGGNTKPEGSYSEGSETFYENNFSFLATARKDDLISKLGGFVTFGGNIMQQKRTKMNASAGTLLVPDLFDVNNGVDKPSITSSLTQRKMNSLYGSLQLNWDGWLFLDVTARNDWSSTMSKENRSYFYPSVSLSAVISDMVQKNGGSMPDWFSFAKVRASFAEVGNDLDPYQLYNVYTISKDANGNSMASAGSTLFDSSVKSELIKSWEVGADLRFFNNRFGIDAAWYKTNATNQLLNIPMDAFSGYESRKVNAGNIQNQGFELSLNGAIMQTASGFNWDAQAHFSLNRSKILELTEGVTVYDIKTVDVLQIAATEGGKYGDIYGQKFVRHNGQVVVGEDGLPLITTDKELIGNQNPDWMLGLTNNFSYKGFDLSFLIDFRIGGEIYSATTSSLHKNGNAAGTVVNGDRADFVVPNSIMKKGDEYVKNDVAVTPQRYWERIASSGNYGLPEVFTYDATNIRLRNITLGYTFNKNLLKKTPFQKLRLSATCNNVWMIVSHLPGIDPESVAATNTNAVGFENGGAPTNRSYTFNLTVGF

SEQ ID NO: 1075 - protein, 443 aa, Gramella forsetii
MRKFSLISFMMLIVSTSTFAGGLLTNTNQHAAFLRMLSRGATTEIDGALSNPAGLAFLPNDGFHMSLSIQSAFQTRNIDASCEGLGLNKYYEGKASAPVIPSLFAAYKMGDWTISGFFGITGGGGKASFDDGLPMFDAMVIGGLGAQKIPSNAYSLKSYMDGKQYIYSVQLGLTYKITEWLSAFAGGRMNYFTGGYQGALKASAAVDLPSPAGGTIPVGTELIGIDLDCDQTGWGFTPVIGLDAKWGKLNIGAKYEFMTNLNIENSTKANSLRMIGAAETELADYKHGVNTPNDIPSMLSIAASYEFLPVLRASVEYHFFDDKSAGMAGGKQEFLTKGTNEYLAGIEWDVTKHLTLSCGGQITDYGLSDNYQSDTSFSCDSYTLGFGAKLNLTERAALNVGYMWTTYDDYTKKSQNYNNTGLSGTNIYSRTNKVFGASINYRF

SEQ ID NO: 1076 - protein, 322 aa, Gramella forsetii
MLIISNGTVASESKGEQSHVYLGGQVGVSHFLGACSSNAIECKNYVTGGGLYGGYQFNSWFALEGSWHDYGSPKTFYGVGDGYYSNATGVDLSVKLSLPVTDNLDLYAKGGAAYNYLSVSGNDNVHLGMFESDSSLDDIWEIGAEYALAPNWSLRLGTSVIDGIGNAKTGKSDLYFTSLGLTYKFKAKPEPKPETIVKLVPEATYYPEQVTLHFEFGESRFVVESKQWHSWNELALSVKQGQGKVSITGYTDAKGTDSANDIESLRRATYAADMLIKAGVDEERILINSKGSADPLVNEDLMRNESALNRRVVIQFNRRVGS

SEQ ID NO: 1077 - protein, 719 aa, Gramella forsetii
MKFIAGTGGVYIAVTILAISSGMQTVWAQSSTGQSASDNSAVLPAINVSTDSIKPTDGYVTKESFSATRTDTPLRDVPQSITVITQDMIRDQSIQSITEAVRYVPGIVPSQGEGHRDAVIIRGSSTTGDFFVDGLRDDVQYYRDLYNIDRVEVLKGSNGMIFGRGGAGGVINRVTKEADWQPVRAATAEFGSYNHKRFTADIGQPINEIAAARLNGVFEHSDSFRDNVDLKRWGINPTVTLLPTDKTKIVLSGEYFYDRRVVDRGIPSFGTMANVINSGRPADIDRSTFFGNPDDSHARVDAWSFNSLIEHSFNNNIKLRNRTRYADYDKFYQNVYAGGQATAEDATGTVNLSAYNNATRRKNLFTQTDLLFKLNTWGVDHEFMTGVEYGHQVTDNFRNTGLFNNVSKVSFLNPMSFVPVTFEQSVTDADNHGVVEAVGVYAQDQITIIPQLKAVLGIRYDNFDTTVHNNRNGDKVHSNDGLISPRVGLIYKPIEPLSIYGNYSLAYVPRAGDQLSSLSVTNEALKPEKFMNLELGAKWDIRPDLALTAALYQLDRSNVIAADPNDLSRTILVDGQRTRGAEIGLMGRITPHWSVMGGYGYTDAEITKNIAGADKGAAVAQVPKHTVAVWNRYDFTSYLGLGLGVIHRGSIYAAVDNTVLLPSYTRLDAAVFVQPHKNIRIQANVENLANIEYATSAHNNNNIMPGAPRIFRLTAMVNF

SEQ ID NO: 1078 - protein, 196 aa, Wolbachia endosymbiont of Encarsia inaron
DEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYVGVGVGTAYISTPLATAVSSQNGKFAFAGQARAGVSYDVTPEVKLYAGARYFGSYGANFDKTDKDGKGELKVLYSTVGAEAGVAFNF

SEQ ID NO: 1079 - protein, 144 aa, Wolbachia endosymbiont of Asobara rufescens
DSGGEDGAFPAFTAYFDPFASASAVTLGEKLARPRLHLGGEIGTEGEADTIYGGVNWTFDLNPKIFVDLGFGGLWHDGRLKNGPGETGAEFGCHLLFHEYAAIGYRFNSNWNISTQIEHASHANLCDGPNDGLTRVGLMVGYKF

SEQ ID NO: 1080 - protein, 185 aa, Wolbachia endosymbiont of Leptopilina victoriae
  misc_feature (10)..(10): Xaa can be any naturally occurring amino acid
ISDEETSYYXRLQYNGEVLPFKTRIDGIEYKKGAEVHDPLKASFMAGGAAFGYKMDDIRVDVEGLYSQLNKNDVSGATFTPTTVANSVAAFSGLVNVYYDIAIEDMPITPYVGVGVGAAYISNPSEADAVKDQKGFGFAYQAKAGVSYDVTPEIKLYAGARYFGSYGASFNKEAVSATKEINVLY

SEQ ID NO: 1081 - protein, 783 aa, Pasteurella multocida
MKKTINFLFLFASILVNAQSYQLSGKVVDQNNEPLANATVYAKNLQRGTTTKADGSYLLNLPKGEHFIQVTYLGYKSYLQGIVITNENVTANFTLQYENTVLDEVLVNAVRVNADIPVTFSNLSKKEIAKRNLGQDIPILLNYLPSVISSSDAGAGVGYTYMNVRGSNGERINVTVNGIPYNDAESHGTFWVNLGDFASSTENLQLQRGVGTSTNGSGAFGASLNILTDAVSEEAYGEISNSFGSFGTRKHTVKFSTGKINDHIEFAGRLSDIYSDGYVDRAFTDLKSYYLQGSYSDDNTLIKAITFGGEERTYQSWFGLDATQLAQDRRQNPYTYENEVDDYGQNHYQLHWNEQLNEKWSTTLGLNYTKGSGFFEQYKPGESAADFNNLIADGSDVIVRRWLDNDFYVANFNTNYKTEKLNLITGISYSNYTGDHFGEVIWGSDLAPNTEIRDRYYFSDATKNDFSLFAKANFYISEKLSGYADLQGRFVSYQTQGLTSDRAPIDVDANFDFFNPKFGLTYNVNANNNLYASFAVANREPNRNDFENGVSTPETLNDLEVGWRLNNGKVKLNTNVYYMDYKNQLVLTGALDDVGAPVRETSGSSYRLGLEIDADIRFSDKFSWKPNAAFSTNKNRDFFITRDGNTTPELLGNTDISFSPNVIVGNMFIYNPTDNLQLTLLSKYVGEQFLSNLSSAISTNDVLESYFTSDINIVYTITPNKIFDSITLTALINNIFDTEYVDRGYYFTYDDDFSVPGTVTTVDGAGYYPQATRNFLIGATLRF

SEQ ID NO: 1082 - protein, 343 aa, Pasteurella multocida
MKKTIVALAVAAVAATSANAATVYNQDGTKVDVNGSVRLILKKEKNERGDLVDNGSRVSFKASHDLGEGLSALAYTELRFSKNVTVQVKDPQTQAVVREYEVEKLGNNVHVKRLYAGFAYEGLGTLTFGNQLTIGDDVVVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVEGKKRALEVGLNYDINDKAKVYTDLIWAKEGPKGATTRDRSIILGAGYKLHKQVETFVEGGWGREKDANGVTTKDNKVGVGLRVHF

SEQ ID NO: 1083 - protein, 339 aa, Pasteurella multocida
MKKTIVALAVAAVAATSANAATVYNQDGTKVDVNGSVRLILKKEKNERGDLVDNGSRVSFKASHDLGEGLSALAYTELRFSKNVTVQVKDPQGKVVREYDVEKLGNNVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKAFMVGTELSYAGLALGVDYAQSKVTNVEGKKRALEVGLNYDINDKAKVYTDLIWAKEGPKGATTRDRAIILGAGYKLHKQVETFVEGGWGREKDANGVTTKDNKVGVGLRVHF

SEQ ID NO: 1084 - protein, 343 aa, Pasteurella multocida
MKKTIVALAVAAVAATSANAATVYNQDGTKVDVNGSVRLILKKEKNERGDLVDNGSRVSFKASHDLGEGLSALAYAELRFSKNEKVEVKDAQNQQVVRKYEVERIGNDVHVKRLYAGFAYEGLGTLTFGNQLTIGDDVGVSDYTYFLGGINNLLFSGEKAINFKSAEFNGFTFGGAYVFSADADKQAPRDGRGFVVAGLYNRKMGDVGFALEAGYSQKYVTAAAKQEKEKAFMVGTELSYTGLALGVDYAQSKVTNVEGKKRALEVGLKYDLNDKAKVYTDLIWAKEGPKGATTRDRSVILGAGYKLHKQVETFVEGGWGREKDANGVTTKNNVVGVGLRVHF

SEQ ID NO: 1085 - protein, 344 aa, Pasteurella multocida
MKKTIVALAVAAVAATSANAATVYNQDGTKVDVNGSVRLILKKEKNERGDLVDNGSRVSFKASHDLGEGLSALAYAELRFSKNEKVEVKDTQNQQQVVRNYEVEKIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVDGKKRALEVGLNYDINDKAKVYTDLIWAKKGPKGATTRDRSIILGAGYKLHKQVETFVEGGWGREKDANGVTTKDNVVGVGLRVHF

SEQ ID NO: 1086 - protein, 341 aa, Pasteurella multocida
MKKTIVALAVAAVAATSANAATVYNQDGTKVDVNGSVRLILKKEKDKRGDLVDNGSRVSFKASHDLGEGLSALAYAELRFSTKEEVEVTQNQKVVRKYKVERIGNDVHAKRLYAGFAYEGLGTLTFGNQLTIGDDVGVSDYTYFLGGINNLLSSGEKAINFKSAEFNGFTFGGAYVFSAGADKQAARDGRGFVVAGLYNRKMGDVGLALEAGYSQEYVTETAKQEKEKAFMVGTELSYAGLALGVDYAQSKVTNVDGKKRALEVGLNYDLNDKAKVYTDLIWAKKGPKGATTRDRAIILGAGYKLHKQVETFVEGGWGRTKKAAGVTTKDNKVGVGLRVHF

SEQ ID NO: 1087 - protein, 342 aa, Pasteurella multocida
MKKTIVALAVAAVAATSANAATVYNQDGTKVDVNGSVRLILKKEKNERGDLVDNGSRVSFKASHDLGEGLSALAYAELRFSTKEKVEVKDTNQQVVRKYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKERAFMVGTELSYAGLALGVDYAQPNVTKVEGKKRALEVGLNYDLNDKAKVYTDLIWAKKGPKGATTRDRSIILGAGYKLHKQVETFVEGGWGREKDANGVTTKDNVVGVGLRVHF

SEQ ID NO: 1088 - protein, 342 aa, Pasteurella multocida
MKKTIVALAVAAVAATSANAATVYNQDGTKVDVNGSVRLILKKEKNERGDLVDNGSRVSFKASHDLGEGLSALAYAELRFSKNEKVEVKDAQNQQVVRKYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVVKQQKEKASMVGTELSYAGLALGVDYAQSKVTNVEGKKRALEVGLNYDINDKAKVYTDLIWAKEGPKGATTRDRAIFLGAGYKLHKQVETFVEGGWGREKDANGVTTKDNKVGVGLRVHF

SEQ ID NO: 1089 - protein, 343 aa, Pasteurella multocida
MKKTIVALAVAAVAATSANAATVYNQDGTKVDVNGSVRLILKKEKNERGDLVDNGSRVSFKASHDLGEGLSALAYAELRFSKNEKVEVKDAQNQQVVRKYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVEGKKRALEVGLNYDINDKAKVYTDLIWAKEGPKGATTRDRSIILGAGYKLHKQVETFVEGGWGREKDANGVTTKDNKVGVGLRVHF

SEQ ID NO: 1090 - protein, 361 aa, Pasteurella multocida
MKKTIVALAVAAVAATSANAATVYNQDGTKVDVNGSLRLILKKEKNERGDLVDNGSRVSFKASHDLGEGLSALAYTELRFSKNVPVQVKDQQGEVVREYEVEKLGNNVHVKRLYAGFAYEGLGTLTFGNQLTIGDDVGLSDYTYFNSGINNLLFTSGEKAINFKSAEFNGFTFGGAYVFSADADKQALRDGRGFVVAGLYNRKMGDVGFAFEAGYSQKYVKQEVEQAQAPKVFLPPGQVERFKDEKEKAFMVGAELSYAGLALGVDYAQSKVTNVDGKKRALEVGLNYDLNDRAKVYTDFIWEKEGPKGDVTRNRTVAVGFGYKLHKQVETFVEAAWGREKDSDGVTTKNNVVGTGLRVHF

SEQ ID NO: 1091 - protein, 335 aa, Pasteurella multocida
MKKTIVALAVAAVAATSANAATVYNQDGTKVDVNGSVRLILKKEKNERGDLVDNGSRVSFKASHDLGEGLSALAYAELRFSTKVKKTVKEGPSQVERIGNDVLVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKEKAFMVGTELSYAGLALGVDYAQSKVTNVEGKKRALEVGLNYDINDKAKVYTDLIWAKGGPKGATTRDRSIILGAGYKLHKQVETFVEGGWGREKDANGVTTKGNVVGVGLRVHF

SEQ ID NO: 1092 - protein, 321 aa, Pasteurella multocida
ATVYNQDGTKVDVNGSVRLILKKEKDKRGDLVDNGSRVSFKASHDLGEGLSALAYAELRFSTKEEVEVTQNQQVVRKYKVERIGNDVHVKRLYAGFAYEGLGTLTFGNQLTIGDDVGVSDYTYFLGGINNLLSSGEKAINFKSAEFNGFTFGGAYVFSADADKQAARDGRGFVVAGLYNRKMGDVGFALEAGYSQKYVTETAKQEKEKAFMVGTELSYAGLALGVDYAQSKVTNVDGKKRALEVGLNYDLNDKAKVYTDLIWAKKGPKGATTRDRAIILGAGYKLHKQVETFVEGGWGRTKNAAGVTTKDNKVGVGLRVHF

SEQ ID NO: 1093 - protein, 387 aa, Pasteurella multocida
MKKTIVAAATLGMFGTAAHAQSSVTLYGLIDAGVTYSNKVATTGGHGKLVKYGDGVASGSRWGIRGTEDLGGGLKALFVLENGFSSGDGSIGQGGALFGRQAFVGLSKNGIGSLTFGRQYSFSTDYIGANYTMGSQTPAGNYAYHINDLDQLTSSRINNAVKFQSANFAGLTFGAMYGFSNSTQFAGTPTTTGTNGAQGASSAYSFGANYAQGPFGIGAAYTNIRFPNGATPAFGVSIANINTFGLRDLETVGVGARYAIAAGLVWANWTHTKFTPLSGESSKLNNYEIGGRYAFSPALSGGLGYTFSKLDGRYDGKWHQVNAAVDYALSKRTDVYVSAAYQKASGSNTINGRVVPVQAEIGSSPSFVGSAGANTQFVTRIGLRHKF

SEQ ID NO: 1094 - protein, 357 aa, Pasteurella multocida
MKKTIVALAVAAVAATSANAATVYNQDGTKVDVNGSLRLILKKEKNERGDLVDNGSRVSFKASHDLGEGLSALAYTELRFSKNVPVQVKDQQGEVVREYEVEKLGNNVHVAKRLYAGFAYEGLGTLTFGNQLTIGDDVGLSDYTYFNSGINGVLITSGQKAINFKSAEFNGFTFGGAYVFSGDANKDALRDGRGFVVAGLYNRKMGDVGFAFEAGYSQKYVKQEVEQAQAQAQAPKVFKDEKEKAFMVGAELSYAGLALGVDYAQSKVTNVDGKKRALEVGLNYDLNDRAKVYTDFIWEKEGPKGDVTRNRTVAVGFGYKLHKQVETFVEAAWGREKDSDGVTTKNNVVGTGLRVHF

SEQ ID NO: 1095 - protein, 176 aa, Wolbachia endosymbiont of Pityogenes chalcographus
GPISDEETSYYVRLQYNGEILPLYTKVDGIRNATGKEKDSPLTRSFIAGGGAFGYKMDDIRVDVEGLYSQLTKDVNVVNDINAADDVTAFSGLVNVYYDIAIEDMPITPYIGVGVGAAYLSNPSKADGVKDQRGLGFAGQVKAGVSYDVTPEIKLYAGARYFGSYGASFKKATAST

SEQ ID NO: 1096 - protein, 215 aa, Moraxella catarrhalis
MKKLILATVLAGLSTAAAANVLVNNGYYVQADLGYSNLEAKYNDNRPNDNKLEDKGLGYGISFGKDTDLARYALDYKNYGKINSSYTYQPQTNTSITSSGELKAQSLGLSAIYDFDTVSGFTPYAGARVGINQIKSTVSTVTTTAAAQSRTTHSQKQENKVGFGVLAGAQYAINPQLSVDAGVEYNYLGKYDKLDTDSKLKAHQYGAKVGLRYNF

SEQ ID NO: 1097 - protein, 215 aa, Moraxella catarrhalis
MKKLILATVLAGLSTAAAANVLVNNGYYVQADLGYSNLEAKYNDNRPNDNKLEDKGLGYGISFGKDTDLARYALDYKNYGKINSSYTYQPQTNTSITSSGELKAQSLGLSAIYDFDTVSGFTPYAGARVDINQIKSTVSTVTTTAAAQSRTTHSQKQENKVGFGVLAGAQYAINPQLSVDAGVEYNYLGKYDKLDTDSKLKAHQYGAKVGLRHNF

SEQ ID NO: 1098 - protein, 319 aa, Moraxella catarrhalis
MKKLILASAIAALAANSATAATIYEDKGLTFKMKGDWQIQLRDDHKKANDVDVEFDDLEIKNTVIYDLGNDMKAFGQLDFGFKDAAEDKQSGSDLEEAYLGLQIHNVKVKVGKQNLAGDEFGVEGAYETTLEEDQFDAVSSSGDDVIRVEADFEAANIVFSHELEADNNDSDNGESTDLFVGGDFGPVAVGAAYQAHTKTSNEEIDTWGLSAEFDAGFATIGADYSSSDSNTAGNDQDVTNLVATFKASKTTKFAVGYVNLDAEAANGDADTFYANVSYKFPSQKNVKLFAEVSSTDYDNAATDATTEIDVLAGMQIKF

SEQ ID NO: 1099 - protein, 217 aa, Moraxella catarrhalis
MKKLILATVLAGLSTAAAANVLVNNGYYVQADLGYSNLEAKYNDNRPNDNKLEDKGLGYGISFGKDTDLARYALDYTNYGKINSSYTYQPQTNTNTSITSSGELKAQSLGLSAIYDFDTVSGFTPYAGARVGINQIKSTVSTVTTTAAAQSRTTHSQKQENKVGFGVLAGAQYAINPQLSVDAGVEYNYLGKYDKLDTDSKLKAHQYGAKVGLRHNF

SEQ ID NO: 1100 - protein, 368 aa, Moraxella catarrhalis
MKKLLLAAAVATLSVNAVQAAPTLYGKLNVSMNQVDNKNFDGKSDVTEVNSNSSRIGVKGEEKLTDKLSAVYLAEWAISTDGSGSDTDLSARNRFIGLKTEGVGTLKVGKYDSYFKTSAGSNQDIFNDDTRLDITNIMYGENRLDNVVGFELDPKLLAGLTFNIMAQTGESTSDSKKGETGKDSKNDSFDSVSTSLGYENKDLGLAIAAAGDFGIKGKYAAYGLKDVYTDAYRVTGSYDIAKSGFVVGALWQHAEPTDDLTAYGQTYKSDGSIDKAGKAYRGLEEEAYAVTAAYKIPNTKIKVKAEYASAETQVSGQADRKIDLYGLGLDYQINKQARFYGIVAQQKRDWLNDDDKQTVVGTGIEYNF

SEQ ID NO: 1101 - protein, 179 aa, Neisseria gonorrhoeae
GLKGGFGTIRAGSLNSPLKNTKDNVNAWESGKFTGDVLEISGMAEREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFG

SEQ ID NO: 1102 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGARRANSHNSQTEVAATTAYRFG

SEQ ID NO: 1103 - protein, 179 aa, Neisseria gonorrhoeae
GLKGGFGTIRAGSLNSPLKNTKDNVNAWESGKFTGNVLEISGMAQREHRYLSVRYDSPEFAGFSGSVQYAPKDNSGSNGESYHVGLNYQNSGFFAQYAGLFQRYGEGTKKIEYDSQAYSMPSLFVEKLQVHRLVGGYDNNALYVSVAAQQQDAKLYGATRVNSHNSQTEVAATAAYRFG

SEQ ID NO: 1104 - protein, 179 aa, Neisseria gonorrhoeae
GLKGGFGTIRAGSLNSPLKNTKDNVNAWESGKFTGDVLEISGMAKQEHRYLSVRYDSPEFAGFSGSVQYAPKDNSGSNGESYHVGLNYRNGGFFAQYAGLFQRYGEGTKKIEYDNQLYSVPSLSVEKLQVHRLVGGYDNNALYASVAAQQQDAKLYGTWRANSHNSQTEVAATAAYRFG

SEQ ID NO: 1105 - protein, 177 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEGYQYNSPSLFVEKLQVHRLVGGYDNNALYASVAAQQQDAKLYGTWRANSHNSQTEVAATVAYRFG

SEQ ID NO: 1106 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLSVEKLQVHRLVGGYDNNALYASVAAQQQDAKLYGTWRANSHNSQTEVAATAAYRFG

SEQ ID NO: 1107 - protein, 178 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYGQVYSIPSLFVEKLQVHRLVGGYDNNALYVSVAAQQQDAKLYGARRASSHNSQTEVAATAAYRFG

SEQ ID NO: 1108 - protein, 179 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTRRANSHNSQTEVAATAAYRFG

SEQ ID NO: 1109 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSMPSLFVEKLQVHRLVGGYDNNALYVSVAAQQQDAKLYGAMSGNSHNSQTEVAATAAYRFG

SEQ ID NO: 1110 - protein, 179 aa, Neisseria gonorrhoeae
GLKGGFGTIRAGSLNSPLKNTDANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQMVRDNSHNSQTEVAATVAYRFG

SEQ ID NO: 1111 - protein, 179 aa, Neisseria gonorrhoeae
GLKGGFGTIRAGSLNSPLKNTGSKVNAWESGKYTGEFLEISKMAEREHRYLSARYDSPEFAGFSGSVQYAPKDNSGSNGESYHVGLNYRNNGFFAQYAGLFQRYGEGTKKMEGYLYNIPSLFVEKLQVHRLVGGYDNNALYASVAVQQQDAKLYQNQLVRDNSHNSQTEVAATAAYRFG

SEQ ID NO: 1112 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYNNQFYSVPSLSVEKLQVHRLVGGYDNNALYASVAAQQQDAKLYGTWRANSHNSQTEVAATAAYRFG

SEQ ID NO: 1113 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQDYSMPSLFVEKLQVHRLVGGYDNNALYVSVAAQQQDAKLYRAMSGNSHNSQTEVAATAAYRFG

SEQ ID NO: 1114 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGLNGESYHVGLNYRNGGFFAQYAGLFQRYGEGTKKIEYDNQFYSVPSLSVEKLQVHRLVGGYDNNALYASVAAQQQDAKLYGTWRANSHNSQTEVAATAAYRFG

SEQ ID NO: 1115 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKVEYDNQFYSVPSLFVEKLQVHRLVGGYDNNALYASVAAQQQDAKLYGTWRANSHNSQTEVAATAAYRFG

SEQ ID NO: 1116 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLLVEKLQVHRLVGGYDNNALYASVAAQQQDAKLYGTWRANSHNSQTEVAATAAYRFG

SEQ ID NO: 1117 - protein, 179 aa, Neisseria gonorrhoeae
GLKGGFGTIRAGSLNSPLKNTKGNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFG

SEQ ID NO: 1118 - protein, 179 aa, Neisseria gonorrhoeae
GLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKVEGYAYNIPSLFVEKLQVHRLVGGYDNNALYASVAAQQQDAKLYQNQIVRDNSHNSQTEVAATVAYRFG

SEQ ID NO: 1119 - protein, 165 aa, Wolbachia endosymbiont of Hypolimnas bolina
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYVSTPLATAVSSQNGKFAFAGQARAGVSYDITPEIKLYAGARYFGSFGA

SEQ ID NO: 1120 - protein, 386 aa, Labrenzia aggregata IAM 12614
MKLKSLMLGAAAAAAATTAQAADLPVAPEPVDYVRVCDAYGARFYYIPGTETCLRVGGRVRTQVIVNNTLDNGAWGNRDSDGYSWLSRGYLYLDARTATEFGTLRAYVSMYSTVTNAVGSATLDNAYIQWGGLTAGLLTSNFDIFTGQAFMGVVSRNWSDQTVNQIAYTAAFGNGFSATIALEDRSHREVGTYGGTRAPDLVAALGVSQGWGSAQLSGALHQVYPDRANAHQTGATNNGADDSFGWAIGGGVAINLPMASPGSNIFFQGFYADGALSYIGASSTVGGVAVSDYGPTSGTSTGYSLSAGAYIQATSTIGLALDGSYMDIDQPTGATDLTRWAIDGSVQWEPVSGFVMGADVGYANTDPSNASDVDELLFGVRMQRTF

SEQ ID NO: 1121 - protein, 403 aa, Labrenzia aggregata IAM 12614
MKLKSALLVSAAAVASPGMVFGLGIRIPDQDAFASSRGNAFVATADNPSAIYYNPAGISQLEDQNVRAGFYGIYLKDKYSGPTGSFDTKDKFQAVPQIYYSAHLKDTPLTLGLGVYSPYGLGLEWPDNTSFRTLATRGDLTYFSINPVLSWKVCDSFSIAAGPTINYGNVDLRRGFLPFPGNEFRFRGDDVTPGFTAGAMWKPIEELSFGASYRSQTTMGFHGTSSTAGGEPFVPSFTQPAGAEFKFPQNVVVGLSYRPTPDWNLEFDADWTDWNRLQTVNLQQQFSGTLPLVFNWASSWFYEFGATRYFGEGWRVSGGYIFSENSVPTATFSPAIPDSDRHVFSIGVGKTYSKFSWDASYQFAYGPTRTVTGSAPSFPFGQSADGKYEYISHALLVSLGYHF

SEQ ID NO: 1122 - protein, 716 aa, Labrenzia aggregata IAM 12614
MTGEIHMNRIDRCRAARPVTLHRLVLALAGAFPLATIAQQNNDNTAVLPPIVVTANPLGSDLLDLVSPTSVLAGKELFRRRASTLGETLNGLPGVASSDFGPNASRPVIRGLDENRIRLLQNGVGTLDVSALSPDHAVPVDPLVVDRIEVVRGAAALMYGGSAVGGVVNSIDNRVPTAAIEGFTGRAEARLGGAANERSGAVVLEGGDGRLALHVDGYRRITDDLSIPGYARSDRLREQSPQEDEPRDKLPNSDSTSNGGAVGASVTLDHGYAGLSYSGFNTDYGTVAEEDVRIRMKSNRWDLASEFSDLGSVISKVRVRAAYTDYQHREIEGGEVGTIFNNKGWEASVEATHGAIGPLTGVIGLQLARNDFNALGEEALLPDIRTRSQAGYVYEEMPAGKLKLTFGGRIENVDIDSAGGGPDDVNAPGTPRFGDPQRRSFTPASGAFGGLYDLGGGFSASANLSHTERAPTYNELFSNGPHVATGQYEVGDPNLSRERSNGIDAQLRWKQDKHSASISAYYTRFANYIALYNTGSTRGSDGELNPVDADGDGIADASGAEILPEAQQRGVRARFAGLEAQGMYRAYEGRNGVIDLRAMADYIRASNVDTGEPLPRISPMHLGVGADYGFGRWGASVDVKYGAAQRRVAANELPTDDYTVVNAVFSYALPVHGATLSAFLKLNNLFDAEVREHSSVLKDIAPQGGRSAMLGMQGTF

SEQ ID NO: 1123 - protein, 386 aa, Labrenzia aggregata IAM 12614
MKLKSLMLGAAAAAAATTAQAADLPVAPEPVDYVRVCDAYGARFYYIPGTETCLRVGGRVRTQVTVNNTLDNGAWGNRDSDGYSWLSRGYLYLDARTATEFGTLRAYVSMYSTVTNAAGSATLDNAYIQWGGLTAGLLTSNFDIFTGQTFMGVVSRNWSDQTVNQIAYTAAFGNGFSATIALEDRSHREVGTYGGTRAPDLVAALGVSQGWGSAQLSGALHQVYPDRANAHQTGATNNGADDSLGWAIGGGVAINLPMLNSGSNIFFQGFYADGALSYIGAGSTVGGVAVSDYGPTSGTSTGYSLSAGAYIQATSTIGLALDGSYMDIDQPNGATDLSRWAIDGSVQWEPVSGFVMGADVGYANTDPDNASDVDELLFGVRMQRTF

SEQ ID NO: 1124 - protein, 1629 aa, Labrenzia aggregata IAM 12614
MAQKPNFLKKLISAGLVTASTATIVASFAGSAMGALLATNGNTALNAPANWNPAQAPATGDTLRIANNGDRVTLDSVGFNVAALIIDTGGNVEAVTLSKSLNIGSIVGVAGADLANITVNQAGQVLTLTGTQGLGAAANQVNIYSGLGAIDFTNLAFTLNFNPADTTNGIILGANAKIANAANAGAVLNVTNAGSGIGNQAKGLEVQDNSFVAVKTLNVNDGSLLRFNSNSDGAGNVNLTLQNGGNVINLQGSGTLHLLAKAGGNGNAANFFVLNGTTLGGGAGDGGDNNGIIHFDTTAVAGTFGTTAPGLTAVVGINNANRAQQFIVTAVGGNNATITNQIFAKNVTVNGGTSTFQQQVDVGNGGSTTFKAASTTTMTISSTLGAVDFGNTASQIIVGAANAPTLTGNFTGDASNAGNTAGVITFLGAGTLNSADANTPVTNKITAIEASAAGIVNLSGTHTAELRLGNAGSIFKLADGTVITGNVNQTVLIGDALAGGAIQLDGSATITGDIGNGGGNAVLQGITLADDASKTLTLGGANIIGANVGGMIDFQANGGTIKLTSTQNNILVGFNLAINTDQTGVVDASSLTNTQTLTIRGGIGTIGANNKTLGQFNIGSSKTVLNGGDVAINELVIGNNGSVQFAHNTYLITKTTNAANQGKIIFNPVVANSTTLAAGTKLGSTAKPLAEINFAPAIDTILNVGQGVNLYATNITTAAANMGSFSFKAGGTNIVRGTVGGQQGNKLNTVTLDNGTTAKFLGNATFNGETKIENNSTLQIGGNYTADFVASADGTGIVEFVNTGPITVTLNKQAVPVNALKQITFSGPGNIVINEIGNAGNEHGVVTDTISFENASLGAVLFLPSGIPFNDAGNTVPLTIKSTVGNGPAGDFNVPVVFVSGVDSVIADGQVIGDQNNIVGLGLGSDNGIAVNATTLYAVIRTTKNNQGTIILSGGIPNTPGTIYGLGIENGTLKLKQVTFTTNYNNLGSIIATNATINDGVTVTTGGIAGTDFDGKITLGSINGNANVRFADGTFSDSTSMIVTTKANSGTVTYLGDAYVGSIGASDTPVASVKFTGNDNGAGLQGNIYSQVTDFGTYNLGVLNSNVILGGGTTAINGEIDLDTNILTFASGTSTWGSNTSIETTLTVANGNIGHIVIAEDAQVNTTTTGTTTINVQDNANANFSGTQTYTLIQGGARFSGTLGGPNFAVTGNNRFVKYGLIRDANQDYVITRTNNAANVVINDIAGSQFAGAPGVGQNVTTFVNATNTAAYNNLLLAKNSADSANFVGAIVTGTSAAVTNVQLDVAKDIQAQLGNRLGALRYLGTAEMAGPEAEPAAVAAGDKAVDNVAYGIWTKSFYTDVHQSKKGGLAGYKAKTTGVVIGLDTLANDNLMIGAAIGITKTDIKHQDYKKGDKTNVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETSTTVANKQVNSKFSDRTDLIVGAKVAGGTMNITDLAVYPEAHAFVVHKVNGRLSKTQSVLDGQVTPFISQPDRTAKTSYNLGLSASIRPDAKMEYGIGYDAQIASKYTAHQGALK

SEQ ID NO: 1125 - protein, 288 aa, Labrenzia aggregata IAM 12614
MFWLMLLIISAKMAHSLWRYISFSAEYTAVSQPVNKPSRVDAKTFDKNDVQLISQQNWFGKYQPVAAQVKQPEPVPVAETRLNVVLRGIAFGARPGAVIEEGGKQQVYLQGETLGSHNAVIEEINRDHVMLRYQGKIERLSLAEEERSTVAVTNKKAVSDEAKQAVAEPAVSVPVEIPAAVRQALAKDPQKIFNYIQLTPVRKEGIVGYAAKPGADRSLFDASGFKEGDIAIALNQQDFTDPRAMIALMRQLPSMDSIQLTVLRKGARHDISIALRYRLFCPPYWKKS

SEQ ID NO: 1126 - protein, 1066 aa, Labrenzia aggregata IAM 12614
MWQQGHTRCYRLAQSVVLTALLGIGTVQAGQPFITTSLSTQIHSVAMEQQTGNISIKGHVVDNKGEILIGVTVMVKGTNNGVITDMNGNFTITAKNGQTLVLSYIGYKDVEVKVQQSNLNITMQEDAQALDEVVVIGYGTAKKKDLTGAISNIRPTDLKAEMPRNMHDLLRANAAGLNISVNNEAKGGGDFLIRGKGTLKAGSQPLLVVDGVIYNGELSELNPNDIISIDVLKDASSAAVYGAKAANGVIAITTQKGIAGSKPVINVNTSWGLVTPIKSRKLRNAEQFLDFRQAYEIGRQTDEYLEQYPGMYTDPRKLNGIDKVDWYNYDQKDKVTSVSEEELITKWLSRLDLSTPEINNYFNGKLTNWQDLMLNNAVQQNYNVSISKKGEDYQYYWSIGYMDNEGIKDGDAFSRFTTRLNLESNVSKYITVGLNMNFSSRDESAIAVDTKALTWFSPYCSNDVNNPESANQHYPNGSNTIANPFYDRKYTDKKQVYMNLDGTIYGRLNLPFGFSYQMNFTPRLAWNESFEHKSAKNDAWAGEGGSSFRQHNKAFNWQVDNVFNWKYEFFDKHKVEATFLVNAEKSQSWMTKSTNKGYNPSDALGYHGIHLGNNPTALSTDQYTTGDALMGRLFYSFSNKYMLTASVRRDGYSAFGMMNPRATFPAVALAWVFTEEKFMKKTSSWLSYGKLRFSWGENGNRDIGIYAALAELTSNPTCWIDGSGKFYTTTYTLNQKMPNSKLKWERAKSYNIGLDFGLFGDILSGSIEVYKKMTNDLLMDRAIPPITGFSKVLSNMGQLQNTGFELTLNANIMRRKNFEWSATGNFSLNRRKIKHLYGNMKNILDADGNIIGQVEDDDITNKWFIGEDPDRIWDYIGDGVWQQDEAEEAAKYGCQPGDFKYLDLNENGKLDQDDKRHQKYTTPRFRWTLRNNFQLFNDLDVSFMLYSLWGHHGSYADAANNNLDASISCSYDQPYWTPENPINDYARIGSKNLGTHYVNKSFIRLDNITVSYRLPQKWTKVVGIQDLRFNASIHNVAVFAPHYDGWDPESNSPMGRTFNFGINFTL

SEQ ID NO: 1127 - protein, 589 aa, Labrenzia aggregata IAM 12614
MRLKFCNIVIFPLVLGMGWVLSIAHSSKAEKQVSSQDIEQAAHILEKMQEYNPLNQPPPKSQPLANWKEESTTIVKETNEGILGQIEQYNQLDQHTEISAPLEKVNSVNQLSDILPVDWAYSALQGLAERYDCLLTSPNATFSGNRAISRYEFAVNLNECLQVIQNLIEEFDETYITQEDLAKSQRLQEDFAIEIADIKSRLNGLETRTDILEANQFSTTTLLKGEVVLALYDAFGNDGEEDATASADDSQIGFGHNLTLNFDTSFTGRDFLRTRLRAGDLPGVNTDTAMTNLNNGSPPNDITRLTEIYYIFPLNKEMSIYIGAAGLDFDLIAPALNPKLISGNTGSLALFPAYSPTIYIQVGGAGLGYSYQINDNLRLDVAYLGGAPGGGTGKVNDPREGGGIFNGTNSAYAQLTVSPNLDLDFSFAYVRAYYTADLVNVAGFTGSRNAQKPFGKVPTSADHFGFQSSYRWAPFTISGWVGYSNAEAEAGDREGDEADIWHWAVTVAINDLVFENGSLGLSVGQQPKLTDIDNGEDDPDTSIQFQLFYNYRISNNIDITSGFFVETQPEHDDRNDPIWVFVTRSTLRF

SEQ ID NO: 1128 - protein, 699 aa, Labrenzia aggregata IAM 12614
MTRHVVTAILGLSAVITPAKADEENQKRTEPYMLGAIVVTGRTPGRTESGPHSVSDGIVTGQVSNQATVENATTVTDKQIAQKGARSLDEAVRAVPGVVVTSGGQSIPRIMIRGLPPRQTQIFLNGVPLNSAVDGQFDPSLIPTENIDQIKIIQGPSSVLYGPGTIAGVIDIITKKGANGIHGDVGTEVGGGGARRGYGTVSGGFENYDFFVSGSHTDRDAFLLPDGSYRSNSDNEQSNLFANFGTHVGDWRLGATLSYLKGYQGLAPNTIASGSGNPFTPGQNFERFDSIEGQSAQFDAAYEPDGPFALRFTGYLNQLDIRDRRFDDATYTTMSNPSVKTFDEMIRTKVSGGQTELRYDLGAFGNLTSNVAIRREADDLSGMIRDVVLPKKGNGSGGGSGGGSGGGGGGGGGGSGAGGGNTFGWRTLDESHELTTTSAATEYRVDPLPRLHLTMGYSQHWFQRPDATNTGAQWMTSLSYDLTPDLLAFGTYARKVRFPTIDQLFNPQQGNTALRPEQSDNYEAGLAWTIAPRAQLRASAFHNDVHNFILNDQINQVFVNRDVVISGVQVSGVYSPLSTLTFRPGYTYLDMRYPSSGLPVDYRPRHVVDMLVAYEPYPGLQVSSDLSYFMDQSVGSKSNAAVRQALPDYAVVNARIRQSFGHGISGYVRATNLFNSKYDYAVGFPAAGRTVYAGLEYHF

SEQ ID NO: 1129 - protein, 707 aa, Labrenzia aggregata IAM 12614
METDMKQTVRLSLLASASLLVLASAAAAQSTADLMYLGELDLESGYDPSAPVPGYVATTAQTATKTGTPILETQQSVSVITGEQIEDQGATTLGDTLGFTAGVLAQPFGTDPRFDSPSIRGFSANNAQYLNGLRILRDFGAPSFEIYSLERIEVLRGPSSVLYGSGNPGGIINQVQKRAQRLSFGEVGVGVGDPKATEGFVDFNHVFSDKFSARLTTVVRDSQEDIAELETTRKYLGLATRWDVTDATVLQFLGSWQKDDPITPAGVPFDLTLTEQGKDLREFYAGDPNDDRSDRETLNLGFELRHEFSNDWALDAGFRYQKFDWDYSGFYVDNAVPDGDTITRGGINQVEDSTTLNLDTRITGSAQTGAVTHDLLVGVDLRHYDIEDSTEFMFADPISFDTPVYNGANLTAPWFIQSNDLELEQMGIYAQDEMSLGNWRGSLALRHDWADQSGTTFTNFAGASPVDQSDEATTYRLGLSYVTDQGVAPYLSYATSFDPEIGVDIAGNTLDPTEGKQWEVGVKYQPLGFNGFFSIALFDLEQTNLSTTVTEGGITGIRQIGTVRSQGLEIEGTVDLENGWSLRGAYTYNEAEQRRGDNPGNDLPNAPQHNASLWVSYEFANTSALDGLQLGGGVRYIGERFGDAANLFKSEDVTLLDLRAAYEITENTHFSVNVTNLTDEVYVANCGGFGCFYGDGRTVQARLTYKW

SEQ ID NO: 1130 - protein, 437 aa, Labrenzia aggregata IAM 12614
MGGTVRAAMLAATAVILGAGQVQAGAFGIREQSTEAQGLAFAGAASGSGGVSSIFWNPATITMNPGFVAEQNFTYIGLSSEIRPAPGTNPGFARLGGSGELGQGAVVPAGATSYQLNDRLWLGLSTGAPFGLVTKPRDVWAGEVYGRSSRIFSLAINPVIGFKVNEWLSIAAGPNIEYFRLTLRQALPIPGILPTSYPSSFLKGESWGAGFTAGATLTPRDGTVLGIGYRSSVHHDIDGSIGVPLVALAPLAGQVRAKLNTPDKLSVGLTQAVSPVARVNLGFEWDNWSRLGTIGIVSKTIGLPVNNLPLNYKDGFTYAIGAEYDASPNLTLRTGFAYETSPIDFRNRSVRLPDGDRYNVSVGASYRWSQQLTLNLAYSHFFLDRSRILAGIGRDYNISNIAFAGVVDSSADIVSVGFRYVFGAPPAPAPAPLVRKY

SEQ ID NO: 1131 - protein, 361 aa, Labrenzia aggregata IAM 12614
MKTIRSLSLISVSALVAGSACAQSNVTLYGIVDTGVQYYNNATASGGSVVGMPSLSGKLPSRFGLRGVEDLGGGYKAFFVLENGFAVNNGALGYGGRIFGRAANVGIDSRFGTLTLGRQMNMTLYALTDADVIGPSNHSLAVFDTYLPNARSDNAVGYMGKWHGFTIGATYSFGRDAAGPAGPSATNCAGQVPGDFVACRQYTVMLAYASETLGVTASYDVMRGGTGASAPLSSSANTDTRTIVDGYAKYGNLKLGAGWIRRNTSSTTHSQSDIFFAGGTYLLTPAFAVDAQAVRYILRTRSDATLFVGRVSYFLSKRTSIYSSAGYMINSPTSAVPVSAGGTVGIGKNQVGFMVGMQQRF

SEQ ID NO: 1132 - protein, 1091 aa, Labrenzia aggregata IAM 12614
MKRLAIAIIAALPFCSAQAVESYEVRNHSGQTVFKLNFYAPPDGSYFTDEDGPQRSSWTLDAGQKAQVISAAQRWADIIKPKPGELPGVINIGTFDEQNAGALSPDVSEAPFSLTQLQAVLQGQDAGELDSGAHAFVSIGKLNFTPVQAAPAQVPTDSRFDLEVTLFHELAHALGISTSAGVPDDGVTQFGPTQGSWTSHLFDDNGNPARPGQAILCKGCEGPDDPSGFDVRKDQGYFAGSHVKEVLAGAMPGVPVRILFEDGSLDDDYMSHSELDRSLMSHQDYRNYTSMMEAELAVLQDMGYDIDRRNFFGRSVYGSGLDVVNQLGYFARNAAGTAYLDGQANTAARGVGLHIYGSNNRVEQRGDLLADGVAAAGIRVDGAGNTLTIAPGTRVQANGDYGTGLLVAYGDNHRIIQRGSLEATGKEGVAARLDFGNNLLGNESEYRGSYIWLVGGTDQSEDMAGPLVSSFDITGSLKGAKAAIYQSVNALAGAINVMRGADIQGDIISDYAQWDENNQARLTRLTFGLQPDGLGQVTALADSGFDFTYNGNIRGKDNLALVAEGGKTTLNGEHQVYSVDIEPGAQLAGNSRYALSDAGLFTNNGLLTTGSPFGQVAIIGDYQQGPQGRLQLMFDSLGRGDQVSISGTSSLDGALTLMPVKGWYASDWQLNSASLLQLGQVSGEFDQVSVQTQSPTLSFSTAPLAAGEYQISAIRGASAYSQYAQSANERNIGLALARAAATAGNDMRPLLTALDFSTPDGKQVSGALAQLEPSAYNSLIQASFDRERQLTRALTAPERNLTLSPTGDEQDWISFALPYGGGTWQHNAGNITGYNASRYGVLFGAEKRNVLVPGLTTGFHAAVGGQTVNAKSADRARAHSTSFDVGLQFSFAQDPMAGPFAYGLGRVGAEDNHMKRQFDVAGVSGTSKSDWTSWNGSLALGGGYHFALTESFSFGPLAALDYTASRHRTIKESGSGTLPMQIKGHYADSLQSTLGVEALYQGPQALSATLRLGWQHELLSNNVTQRAQFVGYDASAFDSKSTLAGRDGLAAQAGVQYQLNKDVSLGAGLSSELFRQGSNSLEGNMSVTWRF

SEQ ID NO: 1133 - protein, 1033 aa, Labrenzia aggregata IAM 12614
MKTISAHCILPRLSARLRLSTALCAATLLVALPHVASAATFTVTAATDDGSGTVAGSLSWAIASAGASGDVIEIDPAVSTITVSGTLPAFAQDVTVRANAAVEITGSPLAASGTSLVLSGVSSTNALASALLGTLAGEAGASGVSGPASVSGTAGDAGASALSGSGFSLTLSGSVTGGNGGAGGKGGDVDPFAPLLESPGNGGDGGNGAAAFSGSDFKLENQGAITGGSGSNGGGGGFAIYEDGGRGGNGGAGGAGIAGTGLVIENSGMIAGGAGGHGGGGGRSFNHSTGSAGSVGVGAAGITGSDLTIVNKGTISGGLSGGGVRANAIEFSSGTNILELRAGSTIIGNVVAGGTSDTLVLGGDTSPAASFDAGEIGTKYTGFEVLSKTGNSTWTLTGTSTHTVNTTVEAGTLQAGSAGAFAANTVYTVNGGTLDLNGYDLAMSALSGTGGTVSLGSAGLTVNQSGTTTYGGAISGTGSLIKSGAGTLTLTGANTHTGGTTVSGGRLVVNGRIGATTLNGGTVGGSGTLGNVTANSGSTIAPGNSIGTLNVAGNVSFAAGSTYDVEVDSAGNSDKIAATGTVTIDSGAAVKILAENGTDDGSSYAPSTTYTIITAGTAVTGTFGTVNENFAFLDAELSYGATSVTLDLIRNDISFADVARTANQRAVAGSLSGLASTSDLYRAVAGLNETQARRAYDSLSGEIHASLPSLFLNDSARLRDTVTSRIHDAFAGFSEVPEIAFNGPVGPRGPGLGTGSGFNLTTWGSAYGAYGKLDGDGNAATLSRSTGGALVGLEATAWPQARFGLLAGLGQSQASVSARASSADANSYTLGAYGGVRLSDLGLTFGAAYSWHDVTSERAVAVGSLKDTLSADYWSRTAQVFGEASYALETPWLLVSPFAGLALLHQQTDAFQEQGSAALALTGDGSSQLLGSSTLGLRMSKTLATTDGVSVALTGAFGWRHAIGDLTPDQRMALSGLDPFTVQGVPLDRDTALVEAGLALTITDRTTLGLSYQGAFGENASDQGANARVNISF

SEQ ID NO: 1134 - protein, 459 aa, Labrenzia aggregata IAM 12614
MLSSVAFVQAKTTSKRMMKKIAILLFSALLLLSIKSNAQAQDATIAELQKQLDELKREVKRLDASYEEDNAFLDKLKKLKISGFIQSQYQVGESAGGFSTYAGGNFDEGTRDRFLVRRGRLRLDYSSSWSTYAFHIDVTQGGVVIKDVFLTVKEPWVKSFSLTAGSFKWPFGYQILYPAHQRPAPEWSRVFETILPAARDLGAMLTYSPESGCLSFLTVNAGLFNGTGNTTTENDRNKDFVGQIKFALPFKKQHFTVDGGVSLYAGKVTSNTRYIYDDVRNAQFSIDSSAGNIGKCFQRTYYGGDLQVYYEVPGLGQAALKGEFATGKQPSTGASAKFYKSTSSSDALYMRNFTGWCVDYIQNIGSKNQLVLRYDEFDPNTDADKNDIGAPGANFTAADIKYATVGLGWVYFWDECLKFTVYYDMVTNEKVNAAATGSLASYTKDIHDNVLTVRSQFKF

SEQ ID NO: 1135 - protein, 653 aa, Labrenzia aggregata IAM 12614
MLVAVPALASVPAQEPAPPQKPKAPPAVPRTTATSAPQSTPDAVTATVPETVTVTANRIPQDISKVGSQVTVVTQRDIELLQRRDLADLLAREPGLNMVRTGGPGGTGSIFMRGVNSNEVKVRLDGMDINDPSTPAGAFDTAQFLTDGLARVEILRGPQSGLYGADAMGGVIDMTTKQGQGPLHGFVRLEGGSYSTKNETAGFSGSLHRFHYMVEVSHNHVGDYQAVPKAIRAQVQGHDVASNRNDNRTANVRLGYDVTDNFDLGFTAHLTQADYEYVADDYSSYPTLPSAQQNESDLKQAILRGTAHLKSFKGVFEQTLGVGYITYDRHDITAGDPDISSNRGDRLKVDWQGLTHLGHNGSFLVGYDYIRERIMTPVSAQTTTNAAWGQLEGHWHDILFGSANIRYDNNSRYGNYVTWRVAPAVKIPGTGLTLKASGGSGFHGPSLNQLFVSYPTYYFLANPNLRAERLLGFDAGFEERLLDGKLTFGADYYGNHVRNLINTALSGYNYTYVNVARAQTHGVEAFVDYRIIKSVDLRGTYTWTDATNRSTGAALVRRPRHKATASVIWTPTKRLSITPSLLYVSGWHDLDRYTSMSTIGHDYVTVNIAAEYKLADFVTLFARGDNLGNRYYENPVGYLQPGRSFYGGVTFGL

SEQ ID NO: 1136 - protein, 820 aa, Labrenzia aggregata IAM 12614
MKIKILILITLLNFTFVKAQNSVPETKNSGSISGKVIDKKTNEVIPYASITIKDGTKIISGAITKENGIFSITNLALQELTVEVQFIGYKKQVNNITLTTQNKNITLKTIALEEEATQLNEVSIVKERSSIEQKIDRKIVTVGKDLIASGTTASEIMNNIPTVSIDPQTKELSLRGNTNVKVLVDGKPTNISATQLLQQIPSSSIKQIELITNPSAKYSPEGMSGIINIILHKNANTGFNGSINSGVTFGKTPKLNTALNLNYKIGKVNIYTNYGLNHGKNKNHGYINSFRPMLENEQQFEFDNLNTSHLLKLGLDYYINDKNTFSIYTNQNITNGSGYGLTDINYINATNSDSSQLFKSKSDENTQTYDLDFKHDFTKKGENIEFQVNVSNTKDKENTNYDLTQFNPISSALKTNIIHGKTNYIQFNADYVNPLTETTKLEVGLETRIQNTENNFDESTNKPTTFNSTTTNNAFTFNRNITALYTNYSKQWEKWSGQVGIRIENYTIDGDFQRNENAINPTKKFNGNQTIKDNILSFYPSAFFTYAASEKNAFNFNYSRRVDRPSIEQISPIREWTTPLVESRGNPELKPQFTHSFEINYTRTTKIGSITSGVFYRQINSEISRSIYKNPSNNNQDILSYANFNSNNAYGIETSANLKFTKWWSANASADAYFKTVRGTVENAISGLQEKAAIDVISFNARLNQTFSATKNLKINLFGMYRGRDLGLQFERSPMYKADIGATYTVLKGKGSITGRLNDVFNTMHFQFDSSIPYKQTGAFYWESRTVYIGLNYMFGGGKNKALQRKQRDENETQSGGGLL

SEQ ID NO: 1137 - protein, 228 aa, Labrenzia aggregata IAM 12614
MLASSLLLALMSTAASATSINLRHEYMPDREGDQHRDRITVSHRFDNGIGFSVEAKWRHQDDEFLRGVKSGGHEVGVSYNYKVTDRFTLQPSYAADASSTGTTHKYNIRGITKITDNWSANLRLRYGDSRRTDGGTNRSYHQLNLVTDYKLSWGKVGVDLEYKDLESGAGGWKDKDSDHLVNFFGEYNQFESGWIPFMEVGILTHKSDDSAYKDEHALRYRFGVKYNF

SEQ ID NO: 1138 - protein, 685 aa, Labrenzia aggregata IAM 12614
MVSRYALALCSVASVLLTASPAFAQKSAAAATEADAQGDIIVTARQRAEPLQKVPDSITLLSADMIEKAGINSTADLGRFVPNLYFRDGHRGGASAITVRGLITPQGGEMPIALVVDGVQLSGNDYFLQDLLDVENIQVLQGPQGALYGQGAVAGAVIITTRQPTDEFQIYAKAGYGSGDNFTGVARISGPLVNDRLYFKLLGSFREADGVIKDANGVPRDYAHRYLVRGEIKYDHEATRATAALSYGRDRNGAIYQDYAPVVNGVVQPDDPGLGITSDIVGVDRVRRFSSSLRIEQDIGDGALALTTAYNTLDQVTRGDADWTAADRFSQYNLNDYRLFNGDLRYTSKSDQRLRYVFGAFYQKRRIEEAVQVAFLPGSGRTGFAVDTRDTQRSEAWALFGQLNYDVTSKLELTTALRYDDNNRKFFNIGTNVKMRAKFNKLQPKVSLAYKWTDGLMTYATYAQGFRSGGFNTAASLFAGPIIAAEKSNNYELGFKARLPLHSNLTASFYRIDVKDAQFYFASSIPPSQNTINIKSVKITGGEVQLSSNPIKPLRIDLGVGVSHSEIQDFNGTGFNDGNIFPTVPAYSIRGSISYAIPVGEDLTITPRVDTYERGRLFFDAANLVRSGPINLTDLRLNVETGPWEFSGFVTNVGNTRYGETVTPTSGLRTINAPRTYGFSVSFRH

SEQ ID NO: 1139 - protein, 847 aa, Labrenzia aggregata IAM 12614
MRLGAVAAMLCATSCPIVWLGVPAQAEAASVAAATRFDIPAQPLSKALNQLALQSNREILFSPRLTVGRRSLPLKGAFTAEEALARLLSGSGLTVRLEGRSFLIQQAPAPPPPQRLLSPPETAPAQDMPLESVVVTALKRDSELQKTPVSMTVLSGEKLSRLGMVDLEQAAPLLPGLKLISTAFGRRLVLRGVYGAGEATTGLYYDETPMTGPVGTTADPGVMSPELALVDIDRIELLRGPQGTLYGSGSMGGALRVLFRHPDLNETEGFVSANATSLAHGGQAGAVTAAFNAVLAPGVLAVRLTAYDLKTPGLIDNIRLGLSDVDSSEVKGARLGLRWQISDRLSLLLSGTSQDTHRDDISAWHDIAGPWRTRHAARAPFDGDIDLASATLHWEGDAVDVIATASRYRWRLTRRSDYSGVLLGERDSASGCKRYYVLSGTCDASQQQGYAGYVDSLYPAILYQPATLTSSIQEIRASSIRESPISWTVGVYNEVRNDHIDSQVPHVDPLTGAVQQPVILIGRRSIDNHLSQSAVFGEISYDPAPATRFTLGARRFDYIKRDSGEVQVPNVVSGTWADYMIDARTPERGWSFKALGSQQITPDILGYAQVSQGFRPGGVNVVPGLADNLAPYRSDHLTNYEVGLKTQSADRRFTANSAVYQIDWRDMQYSAQTQNRAFSFLTNIGASRIRGVESEFTARRLWGWDAAASATFTDARLTADQITNTAIGLGRKGDRLPVVPKFATAASIERQWPLTGTLEGRFRIDAAYTGTSRSAFNMGNADYLKMGGYATFGVSFGVEHANWRADLALDNLLDRAGRASAQRNTSGPIDYYGIPPRTLRITLERGF

SEQ ID NO: 1140 - protein, 1027 aa, Labrenzia aggregata IAM 12614
MKIKHILLFLMAWVSSMNLAYAQQTVVASGSVMDEKGELLIGVSISVKEVPSMGAITDIDGRFKIGGIKAGHTLVISYVGYDPQEIKMNKSDERMRVVLKESSNVMDEVVITASGKVQKKINVTGAITGVEVATLKTPATSISNMLGGRVPGIISVTRSGEPGKDFSEFWVRGISTFGAGQGALVLIDGIEGNLNTLDPEDIESFSILKDASSTAVYGVRGANGVVLVSTKKGKAGKLNLQVKANTGISYSPQMPKYVRAAEYAALANEAAVTRGRIPVYTDVDLALFRNHMDPDFHPDVDWRDVILKDYTWNQQYFLSASGGGEVARYYISAGFTTKDAIFKQDKGVNKYNTNVNYNKFNFRANVDVNVTPTTTLSLNEETVIVTQNYPGYGNDSKVLWQAQSNLTPVTVPLMYTTGQAPGYGTDKSNISPYVLLNMTGYRKFYSNDNKITMQLNQDLKMITPGLSIAGLVNINSIGARTQVREKMPAIYYAHGYKRDGTLDLEKISDAVEPYYTNWNDTERRIYWDFRLNYDQTFNKVHKVGALVKAEWSDYEASKYNQLLTAIPKRYNSYSSRFSYSYDDTYMAEFNMGYTGSEAFEKGKKFGWFPAVSIGWAPTQYRFWRNKDNFINYFKIRASYGIVGNDRLTWDDSVRFPYLTLIGHTGSGSWNNGSGLTETQVGSSNLRWEKAKKADIGIDTRFFHERFEMTVDFFQDIRSGIYQQRQSVPEEMGLPSLPWANVGEMKSWGMDGHISYTQPLGDNDKYLIIRANYTQSMNKITNFEEDLKKYDYQSAVGYQSGINRGLIALGLFKDQADIDNSPRQDFGNYLPGDIKYKDVNGDGIVNWDDIVPLKYSYVPQIQYGFATEFNWKNFNVSVLFEGVSRVTYFKGGNMYQPFSGSTAGNVITDFANPANRWISREISGDPATENPNAKYPRLYYGGSSNNSQSSSFWLSDGSYLRLKNVQVSYTLKNQFLKKFGLQKAVISVIGDNLAVWSKEKMLDPAQAGDNGTVYPVQRVYTLQLNLSF

SEQ ID NO: 1141 - protein, 621 aa, Labrenzia aggregata IAM 12614
MHLLKSSVLLVSASVLALPSTTLAQSLPNSADSVVLDTIVVTPLRRASSLQRSTSSVTVIDSADIERSAAPDLQSLLKSYSGISIKTNGGQGSSSDIYMRGMSSKQTVVLINGVRTASATTGATALANIPLSSIDRVEIAKGSHSAQYGADAMGGVINIITKQGGACGARSWCGSLSTGVSHPWGGYASGTIQGRSNDGVDYAFGAAITGTQGYDFTTSDAYGHEPDRDGFLQGSFNFALSKDFDWGKIYADGLLSRGRNQYDAKAPSPNQADSTAFTGKIGTRIDHTADWSSTLEFSTGIDNSRNFRKGVSGSDRFETKRYGVFASTEKSFDTGTVNHTVTAGVEAYREEINTTVAYDETSRDLAAVFGQYSLEYEALRFDGGLRYDHNGQFGDVVTYNLGTSYEVLPDLVLRSSYATGFRAPTFNELYYPGFANPDLQPEKSRSYEIGLNWQATASTSLDMAFYQTWLRDAIMSTAPTYLPYNVASARVTGFEATLAHRFDDRWGVKGSIDLKQPIDEDTEKDLPYRERFKAAAEVNFTPIEQLDLTARVIYGGSRYADAANSKKLGDYVTADFVAVYSIDKQSQLKFSVENIFDKDYQTSSGYIAPGRTINVGLTRNF

SEQ ID NO: 1142 - protein, 1012 aa, Labrenzia aggregata IAM 12614
MVFSGFSVLAQTKLTGKVTDESNQPFPGVVIQQLNTTNKTSTDVNGNYSITLRAEGGASLVFSYVGYNSVTLPYTTNAVLNVSLKPSTSDLNEVVVVGYTSQRKGSISGAVGTLNMEDGQKRRVADVSQMLQGQVSGVQVTQSTGAPGDPINIRIRGEGTIGDNSPLFVVDGTPTKDISFLNPSDIKTLTVLKDAASASIYGSRAAGGVVVITTKQGAVDRSSLELNYFNGIQQVTNLPTLLNTAQYLDKQERAWINGGNAGANPYTAAKSRTDLADTDWLDELFETGRSQSAQLTASGGSEKVQYLLSGAYYKQNGIVVYDNDQYERFNFRANINANLTDRFKMGTNFQMSSARQDWLSSKGDAPGIIRHALLRPPLLSVYKDPSDPTYKANDPFTDLPFYANNNSNGGWNPYFERSSNPIALAYYANDKRNNVKTFGNAYAQYAFLGDKSLTLRTNLGVDLNFLHNKRFLQNFGDDDGGGGSLDVGKGMGRQNRPNGLNEERGQELNLTWNNTLNYVKTIGKHSINALVGSEYIKNTSSAISASRARYDYTSGSFQYIDFGGTAADLWNGGNAGEWALFSLFGSVTYEYDARYMLTANLRADASSRFGENNQWGYFPSVSAGWVISQESFLKEASWISNLKLRASTGKLGNQQIPNYAYLSTMIKDGDGYSLNRYGNPDLKWETTSQHNIGLDFGFLNNNLSFSADYFIKNTSGILLQLSLPEMVGSVSPTYVNAGKVRNKGFEFSANYRNRIGDFNYSINGNMATLNNEVLQLHPNLPTLSGPFTRTVPGQPLNAFFGYRMEGIYQTAAEVSQHLYGTTNPNQVPGDIKFADLNGDGQINDNDRTFLGNPIPKVSYGMNLSGSYKGFDLSVFMQGVQGVDKYNDAKKITNFDTRPFNSSTMVLNSWTGPGTSNTMPRVSTTDTGTSRVSSLYVEDASYFRIKNVELGYSFGSMIKNKKLGLQDVRVYVSGQNLYTSTNYTGLDPESVDQIDMGTYPQSRAFLFGVNVKF

SEQ ID NO: 1143 - protein, 517 aa, Helicobacter pylori
MIKKNRTLFLSLALCASISYAEDDGGFFTVGYQLGQVMQDVQNPGGAKSDELARELNADVTNNILNNNTGGNVAGALSNAFSQYLYSLLGAYPTKLNSSDVSANALLSGAVGSGTCAAAGTAGGASLNTQSACTAAGYYWLPSLTDRILSTIGSQTNYGTNTNFPNMQQQLTYLNAGNVFFNAMNKALEKNGTTNGTSSTSGATGSDGQTYSQQAIQYLQGQQNILNNAANLLKQDELLLEAFNSAVAANIGNKEFNSAAFTGLVQGIIDQSQLVYNELTKNTISGSAVNSAGINPNQANAVQGRASQLPNALYNAQVTLDKINALNNQVRSMPYLPQFRAGNSRSTNILNGFYTKIGYKQFFGKKRNIGLRYYGFFSYNGASVGFRSTQNNVGLYTYGVGTDVLYNIFSRSYQNRSVDMGFFSGIQLAGETVQSTLRDDPNVKLHGKINNTHFQFLFDFGMRMNFGKLDGKSNRHNQHTVEFGVVVPTIYTYYKSAGTTVKYFRPYSVYWSYGYSF

SEQ ID NO: 1144 - protein, 525 aa, Helicobacter pylori
MKQNLKPFKMIKENLMTQSQKVRFLAPLSLALSLSFNQVGAEEDGGFMTFGYELGQVVQQVKNPGKIKAEELAGLLNSTTTNNTNINIAGTGGNVAGTLGNLFMNQLGNLIDLYPTLNTSNINQCNSGSNGSTTAATTSNSPCFQGNLNLYNKMVSSIKTLSQDLKNNIFQGNNNTTSANLSNQLSELNTASVYLTYMNSFLNANNQAGGIFQNNTNQAYGNGVTAQQIAYILKQASITMGPSGNGGAAGAFLDAALAQHVFNSANAGNDLSAKEFTSLVQNIVNTSNNALTLANNANISNSTGYQVSYGGNIDQARSTQLLNNTTNTLAKVAALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 1145 - protein, 517 aa, Helicobacter pylori
MIKKNRTLFLSLALCASISYAEDDGGFFTVGYQLGQVMQDVQNPGGTKRDELARELNADVTNNILNNNTGGNVAGALSNAFSQYLYSLLGAYPEKLNGNDVSANALLGGAVGSGTCAAAGTAGGNSLNTQSACTAAGYYWLPSLSNRVLSTIGSQTNYGTNTNFPNMQQQLTYLNAANVFFNAMNKALEAKNGTNGASGATGQNGQTYSQNAIKYLQGQQNILNNAANLLKQDELLLEAFNSAVAANIGNKEFNSAVFTGLVQGIIDQSQSVYSELNKNPISGSAFNNATNNQLTNQANAVQGRANQLSNALYNAQVTLDKINALNNQVRSMPYLPQFRAGNSRSTNILNGFYTKVGYKQFFGKKRNIGLRYYGFFSYNGASVGFRSTQNNVGLYTYGVGTDVLYNIFSRSYQNRSVDMGFFSGIQLAGETFQSALRDDPNVKWHGKVNNTHFQFLFDFGMRMNFGKLDGKSNRHNQHTVEFGVVVPTIYNTYYKSAGTTVKYFRPYSVYWSYGYSF

SEQ ID NO: 1146 - protein, 520 aa, Helicobacter pylori
MKHNPTKNRSKKSGVTAAICCAFTLPALAIAANAYADDSVTQPAPDASNAAPAAQTLSSPAQVTQAQPANKRRADQGGQLRNDQPDTTNAIVNAEASQTVLPPTPPSSQAASKGFIADSHLNLQFRNYADYFQAPPNTYRHAWVQGAQVNYESGFTQGLVGFGVDASLFGALKLDGGNGAGNMVHVGKSGGGSQQLAWAYPGMYDIKGRISETVVKYGLQDVTNPFLEPHDNRALPPTFLGVSLVSNDLAHTTLEAGSFTKVDARGHTNLSNLTTSYGGTRIDRVTYLGGTWHYAKNGEMALYVDQADDVWRQYYGSVAQSFGDPTTIKWSGLANIYSTHDTGASRQGHINSNAYSLSVSAQHGPHALLLGYQQVLGDQFFDYVNETNGIYLTNSMDVDYNAPHEQSLQLRYTFDGKYAGVPGLKAMLWGAYGWGADASAGAAENASPSAALHDLYWKNGQPVHGHHHEFGFIPSYTLQSGRFKDTKVTFIAMWHNGSNYYSDGNNMEYRLVVNVPVKVF

SEQ ID NO: 1147 - protein, 512 aa, Helicobacter pylori
MIKKNRTLFLSLALCASISYAEDDGGFFTVGYQLGQVMQDVQNPGGTKRDELARELNADVTNNILNNNTGGNVAGALSNAFSQYLYSLLGAYPEKLNGNDVSANALLGGAVGSGTCAAAGTAGSNSLNTQSACTAAGYYWLPSLSDRVLSTIGSQTNYGTNTNFPNMQQQLTYLNAANVFFNAMNKALEAKNGASGATGQNGQIYSPQAIQYLQDQQNILNNAANLLKQDELLLEAFNSAVAANIGNKEFNSAVFTGLVQGIIDQSQSVYNKLNTNPISGSAVNSVGIDSNQANAVQGRANQLSNALYNAQVTLDKINALNNQVRSMPYLPQFRAGNSRSTNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKVNNTHFQFLFDFGMRMNFGKLDGKSNRHNQHTVEFGVVVPTIYNTYYKSAGTTVKYFRPYSVYWSYGYSF

SEQ ID NO: 1148 - protein, 529 aa, Helicobacter pylori
MKQNLKPFKMIKENLMTQSQKVRFLAPLSLALSLSFNQVGAEEDGGFMTFGYELGQVVQQVKNPGKIKAEELAGLLNSTTTNNTNINIAGTGGNVAGTLGNLFMNQLGNLIDLYPTLNTNNIHQCGATNSGSAGTTTAATNNSNSTCFQGNLALYNEMVNSIKTLSQDLKNNIFQGNNNTTSANLSNQLSELNTASVYLTYMNSFLNANNQAVGIFQKHTNQAYGNGVTAQQIAYVLKQASITMGPSGNGGAAGAFLDAALAQHVFNSANAGNDLSAKEFTSLVQNIVNTSQNALTLANNANISNSTGYQVSYGGNIDQAHSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSGSLNAGFFGGIQLAGDTYISTLRNSPQLASRPTATKFQFWFDVGLRMNFGILKKDLKSHNQHSMEIGVQIPTIYNTYYKAGGAEVKYFRPYSVYWVYGYAF

SEQ ID NO: 1149 - protein, 517 aa, Helicobacter pylori
MIKKNRTLFLSLALCASISYAEDDGGFFTVGYQLGQVMQDVQNPGGTKRDELARELNADVTNNILNNNTGGNVAGALSNAFSQYLYSLLGAYPEKLNGNDVSANALLGGAVGSGTCAAAGTAGGNSLNTQSACTAAGYYWLPSLSNRVLSTIGSQTNYGTNTNFPNMQQQLTYLNAANVFFNAMNKALEAKNGASGTSDATGQNGQTYSQSAIQYLQGQQNILNNAANLLKQDELLLEAFNSAVAANIGNKEFNSAVFTGLVQGIIDQSQSVYNKLNKNPISGSAFNSATGSQLTNQANAVQGRANQLSNALYNAQVTLDKINALNNQVRSMPYLPQFRAGNSRSTNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKVNNTHFQFLFDFGMRMNFGKLDGKSNRHNQHTVEFGVVVPTIYNTYYKSAGTTVKYFRPYSVYWSYGYSF

SEQ ID NO: 1150 - protein, 526 aa, Helicobacter pylori
MKQNLKPFKMIKENLMTQSQKVRFLAPLSLALSLSFNQVGAEEDGGFMTFGYELGQVVQQVKNPGKIKAEELAGLLNSTTTNNANTSIAGTGGNVAGTLGNLFMNQLGNLIDLYPTLNTSSIHQCNSGSANGTTAAATTSNSPCFQGNLSLYNEMVSSIKTLSQDLKNNIFQGNNNTTSANLSNQLSNLNTASVYLAYMNSFLNANNQAGGIFQNNTNQAYGSGVTAQQIAYVLKQASITMGPSGNSGAAGAFLDAALAQHVFNSANAGNDLSAKEFTSLVQNIVDTSQNALTLANNANISNSTGYQVSYGGNIDQARSTQLLNNTTNTLAKVSALNNELKANQWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLKNSPQLASRPTATKFQFLFDVGLRMNFGILKKDLKSHNQHSIEIGVQIPTIYNTYYKAGGAEVKYFRPYSVYWVYGYAF

SEQ ID NO: 1151 - protein, 214 aa, Helicobacter pylori
MMKKNIVSGLVAALLSAGFASSVAAHQAGDIIVRAGAVVVAPNESSEQVATFGEFQVSNNTQLGLNFGYMLTDNIGIELLAATPFSHDVSLAGVGKIAETKQLPPTLVAQYYFGSANSKLRPYIGAGVNFTNFFDNEFTNDLDGALTDLSLSNSWGLAAQVGIDYQVNKNWLVNASVWYAQIDTDVKFNLGDAPVTIQTDIDPWVYMVSVGYTF

SEQ ID NO: 1152 - protein, 527 aa, Helicobacter pylori
MKQNLKPFKMIKENLMTQSQKVRFLAPLSLALSLSFNQVGAEEDGGFMTFGYELGQVVQQVKNPGKIKAEELAGLLNSTTTNNTNINIAGTGGNVAGTLGNLFMNQLGNLIDLYPTLNTNSIHQCGSTSSTTAAATSSSTSNSPCFQGNLSLYNEMVSSIKTLSQNLKNNIFQGDNNTTSANLSNQLSELNTASVYLTYMNSFLNANNQAGGIFQNNTNQAYGNGVTAQQIAYVLKQASITMGPSGNGGAAGAFLDAALAQHVFNSANAGNDLSAKEFTSLVQNIVNTSNNALTLANNANISNSTGYQVSYGGNIDQARSTQLLNNTTNTLAKVAALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 1153 - protein, 517 aa, Helicobacter pylori
MIKKNRTLFLSLALCASISYAEDDGGFFTVGYQLGQVMQDVQNPGGTKRDELARELNADVTNNILNNNTGGNVAGALSNAFSQYLYSLLGAYPEKLNGNDVSANALLGGAVGSGTCAAAGTASGNSLNTQSACTAAGYYWLPSLSNRVLSTIGSQTNYGTNTNFPNMQQQLTYLNAANVFFNAMNKALEAKNGASGTSGATGQNGQTYSQQAIQYLQGQQNILNNAANLLKQDELLLEAFNSAVAANIGNKEFNSAVFTGLVQGIIDQSQSVYNELSKNPISGSAFNNATLSKLTDQANAVQGRANQLPNALYNAQVTLDKINALNNQVKSMPYLPQFRAGNSRATNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 1154 - protein, 528 aa, Helicobacter pylori
MKQNLKPFKMIKENLMTQSQKVRFLAPLSLALSLSFNQVGAEEDGGFMTFGYELGQVVQQVKNPGKIKAEELAGLLNSTTTNNTNINIAGTGGNVAGTLGNLFMNQLGNLIDLYPTLNTNNIHQCGATTSGSSVGATAAATTSSPCFQGNLNLYNKMVSSIKTLSQDLKNNIFPGNKHTTSANLSNQLSELNTASVYLTYMNSFLNANNQAGGNFQNNTNQAYGNGVTAQQIAYVLKQASITMGPSGNGGAAGAFLDAALAQHVFNSANAGNDLSAKEFTSLVQNIVDTSQNALTLANNANISNSTGYQVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSGSLNAGFFGGIQLAGDTYISTLRNSPQLASRPTATKFQFLFDVGLRMNFGILKKDLKSHNQHSIEIGVQVPTIYNTYYKTGGAEVKYFRPYSVYWVYGYAF

SEQ ID NO: 1155 - protein, 518 aa, Helicobacter pylori
MIKKNRTLFLSLALCASISYAEDDGGFFTVGYQLGQVMQDVQNPGGAKSDELARELNADVTNNILNNNTGGNVAGALSNAFSQYLYSLLGAYPTKLNGNDVSANALLQGAVGSGTCAAAGTANSSSLDNSQSACTAAGYYWLPSLTDKILSTIGSQTNYGTNTNFPNMQQQLTYLNAGNVFFNAMNKALAAKNGTATSGTSGATGSDGQTYSQQAIQYLQDQQNILNNAANLLKQDELLLEAFNSTVAANIGNKEFNSAAFTGLVQGIIDQSQAVYNELTKNTISGNAVNSAGINSNQANAVQGRASQLPNALYNAQVTLNKINALNNQVRSMPYLPQFRAGNSRSTNIMNGFYTKIGYKQFFGKKRNIGLRYYGFFSYNGASVGFRSTQNSVGLYTYGVGTDVLYNIFSRSYQNRSVDMGFFSGIQLAGETVQSTLRDDPNVKLHGKINNTHFQFLFDFGMRMNFGKLDGKSNRHNQHTVEFGVVVPTIYNTYYKSAGTTVKYSSTYSVYWAYGYSF

SEQ ID NO: 1156 - protein, 532 aa, Helicobacter pylori
MKQNLKPFKMIKENLMTQSQKVRFLAPLSLALSLSFNPVGAEEDGGFMTFGYELGQVVQQVKNPGKIKAEELAGLLNSNTTNNTNINIAGTGGNVAGTLGNLFMNQLGNLIDLYPTLNTSNIHQCGVTNSGSSSGSGATTAAATSSTNPCFQGNLALYNEMVGSIKTLSQNISKNIFQGNNNTTSQNLSNQLSELNTASVYLTYMNSFLNANNQAGGIFQNYTNQAYGNGVTAQQIAYILKQASITMGPSGDSGAAAAFLDAALAQHVFNSANAGNDLSAKEFTSLVQNIVNNSQNALTLANNANISNSTGYQVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 1157 - protein, 518 aa, Helicobacter pylori
MIKKNRTLFLSLALCASISYAEDDGGFFTVGYQLGQVMQDVQNPGGAKSDELARELNADVTNNILNNNTGGNIAGALSNAFSQYLYSLLGAYPTKLNGSDVSANALLSGAVGSGTCAAAGTAGGTSLNTQSTCTVAGYYWLPSLTDRILSTIGSQTNYGTNTNFPNMQQQLTYLNAGNVFFNAMNKALENKNGTSSASGTSGATGSDGQTYSTQAIQYLQGQQNILNNAANLLKQDELLLEAFNSAVAANIGNKEFNSAAFTGLVQGIIDQSQAVYNELTKNTISGSAVISAGINSNQANAVQGRASQLPNALYNAQVTLDKINALNNQVRSMPYLPQFRAGNSRSTNILNGFYTKIGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 1158 - protein, 736 aa, Helicobacter pylori
MLIDFIFMLRISISSPQIKGSFPLSLLSLMILNIQGANAEELIDSSSKAAATMPTIKIEAMSELDPIKSYIDYDKANVTRNGLDKKDIPQTVDTIDVQKYKIYGSNDLSVMLQGTPGVSTSYDMRGDGITIRGFGADTGDIYRDGIRESGQVRRSTANIERIEILKGPASVLYGRSAGGGVVNMVSKFANFDSKSSVGAYAGSYDNYGTTADINQVLNDNLAVRLTGEYGEAGSFRSGIENKIEMFSPSFTYKNDDGKLTWTTQYTYDKLGRVPDRGPTRDNLPAGTSIKMGFAQDDDYVDDILQVVRTDVNYEYAPDWNFHWAASYRQAEQNFDHFYFGNYCGLDGKNSKNEACTKKGYIDQIYYWQQTSNKTTTNTFDIKGKFKTGQLEHQIMVGTDWTYEQREPRLANKTQNGSAIYGYVNPITGEREYSRGNGPLKISQHNYNEGTTYGVFIQDLIGLNDQLKLMMGLRYDYFDFSTTNKIKNEHRNVKDSTFSPNVGLVWQPVPEHSFYTSYSKSFAPFGGQMGVNQVTGSTDVAKMDKEPQYNEQYEVGVKSEWFDNRLNTQFSVFDIRKNNIRYKPNPDSEPEVWATAGQHQSRGLEFSFIGRVLDNVFVRGGYGYTDAKVKEDNQNPEREGNYLANTSKNTGNLFVRYLPTEQWYTEVGVTYVGSYYPNINNQVKMEGFNRVDAAIGYSADPWNVTLAVNNLTNKEYWRSDSMPGTPRNVLLRLNYQF

SEQ ID NO: 1159 - protein, 517 aa, Helicobacter pylori
MIKKNRTLFLSLALCASISYAEDDGGFFTVGYQLGQVMQDVQNPGGAKSDELARELNADVTNNILNNNTGGNVAGALSNAFSQYLYSLLGAYPTKLNSNDVSANALLSGAVGSGTCAAAGTAGGTSLNTQSACTAAGYYWLPSLTDRILSTIGSQTNYGTNTNFPNMQQQLTYLNAGNVFFNAMNKALEKNRTATTSGTNGATGSDGQTYSQQAIQYLQGQQNILNNAANLLKQDELLLEAFNSAVAANIGNKEFNSAAFTGLVQGIIDQSQAVYNELTKNTISGSAVSSADINSNQANAVQGRASQLPNALYNAQVTLDKINALNNQVRSMPYLPQFRAGNSRSTNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 1160 - protein, 529 aa, Helicobacter pylori
MKQNLKPFKMIKENLMTQSQKVRFLAPLSLALSLSFNPVGAEEDGGFMTFGYELGQVVQQVKNPGKIKAEELAGLLNSNTTNNTNTNIAGTGGNVAGTLGNLFMNQLGNLIDLYPILNTKNIHQCGTTNNGSSSATTAAATTNNGLCFQGNLDLYNEMVGSIKTLSQNISKNIFQGNNNTTSQNLSNQLSELNTASVYLTYMNSFLNANNQAGGIFQNNTNQAYGNGVTAQQIAYILKQASITMGPSGDSGAAAAFLDAALAQHVFNSANAGNDLSAKEFTSLVQNIVNNSQNALTLANNANISNSTGYQVSYGGHIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLANRPTATKFQFLFDVGLRMNFGILKKDLKSHNQHSIEIGVQIPTIYNTYYKAGGAEVKYFRPYSVYWVYGYAF

SEQ ID NO: 1161 - protein, 392 aa, Francisella tularensis
MRLKSIVIATTVLLGSATASIAAGSDNIDTSANTNSATTQSSGFAANNFIAPFANTYSALTNKDNTWGPQDRIGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDIKFAYDKATLNAKGKKAIASFVNFIKDSNISSVTVKGYASQGQTGSEFDIYNQKLSEKRAQAVADYMKQLGLDSEKIITKGFGYNDTLSGIHKSDPRNQRVEASVSAPLKEAN

SEQ ID NO: 1162 - protein, 424 aa, Pelobacter propionicus
MRVSLLSASHRRSWTRAAASAVALTIGSTGLAYAADAAAKPPEPPPPGICDAQPSITTSIAIPVAGDIKKYLCDHGINFQVNYIGEVFGNPTGGIKQGARYEQRVELGLDADLDKLAGLKGLTFHVNGYSIAGQSVTTYNLLNYSAISNIAAHPALLLFELWAEQKLFDDKVAIRIGQLAADSEFFISEFGGLYTNSTFGWPNPMAVNLPSGGPAYPFATPAVRIKYNPIDSVTLMGAVFNGDPTGAGFTGEVYQNDPSGTDFRLKDSPFVIGEGAYAYNQEKEGTGLAGTLKLGGWYHFGNFDSQHFDTNNVSLASPDSNGIAKQIRGDWGLYGILDQMVWRLPGDDPKKGVGVFARVTGAPNFQNTMNFYVDGGVNFMGLWSARPDDSFGLAVAYSEISPSARAFDQETAVFSGTYMPSPQL

SEQ ID NO: 1163 - protein, 216 aa, Campylobacter fetus
MKKIIAASVLSLAALSAHAAEQGAYLFGNLGYNFAKPKKLDTQGVEGLSASHSAAGASWELGGGYRFNDHFALEASYADFGKAKTSVAARTDDINGNVGVSLEATALRLAAVGILPVTSELELFGKVTLNQMYFNASANASASIPALGFETAGSGSEKQNRLRPGIGLGAAYKINKQLSLRGEYEYVSLPNWTLPNGASVMQNGMHIVKAGISYRF

SEQ ID NO: 1164 - protein, 760 aa, Campylobacter fetus
MKLSRIHLALVAAGMSHGMVMADQSVSDVGTIGVQGKATAGGGYMVQEESIKARSTVTKEALDKQAATGNAIDKLKYTPGLNISSEDATGLSGFRFTMRGLNSDQVGMSVDGMPINDSGNYALYSNLLGDPENIDQIFVTQGSAESDGPHIGSSGGNIGIVTIRPTKETGAFVKQVAGSNGTYKTFARLNTGEINGLSNWLSMSHTEGQKWRGDGAVRADKVEWNSFFDMGSGNTANLILKYHEQDNNSYSQLTKSQFQQGGRKFDPYPSTPALGSNGKLSSYYELAQNPFQTFTGVLNSQFKLADNLALSVIPYYFWGNGSGVNSSSYALNRGSNQNGVFDLSNLPTAAAYNADGSSTTGVYYRPSRTQTWRPGITTKLNWDVNDEHSVQVGYWYERARQLQTQPFIRLKSNGKPQSIWPDSDYMVDANGNEIQGRDRYTVTPAQKVWAQDTWYFAPDWTLIGGLAYMNVKREGTNHGSLTERPEERDQTYNKLLPNVGLKYQLDERDQLFYSLSRNMRVPQNYALYDQGAGFINSKPETSWNHELGWRFTDQDTTLAATLFYMQFKDRQVSSRDINGDFADINAGAVDNSGLELEWSGLLPHHFNYYTSFTYTRAKQKDDLTVFNNGAAIELPTSGKQFANVPKNMLAANIGYDDGSYYGTFGGKVTSKLYGDLTNDESIPGRTIFNLGAGIYLPVDKKIVKDATLRLNVDNLFDKDYLDGVYTTKTNAASYSGFRDGDPAYIVGVERTVTVSLEANF

SEQ ID NO: 1165 - protein, 1172 aa, Campylobacter fetus
MYKKFLLSYTAIATIILFNSSLSLQAKDLEVSDGKTVTAHEETYDTLHATNGSKIVGKHLTVIHPNAYAVTAEGANSAIELLDNTTIGKKDSEVHLGLEAKDGATIKMIGGSIIAGYTGASFTNSKSKENTLENVLITDANDSLDTYLGIVTKNSNLTLKGVTLHAFNALQADDHSQITISGGEFDGKLYGVSAKQGSIIDIKDNANILSDESALYADGPQSKITMTGGTVAGGTTLGTLRAENGGHIDVTDVIITSTFKGTFVTSIADMGTGIFAENEGSVIELHGTTIKDVSIGLDVHEGSTGKMTGGSITTSLIGAEYIESNSDENKLEDVVISGFKNNETPSSGVDVLKKSKLSLKNVTITQTYSGVDAFFNSQVTVSGGSVSASTLGVSAVSDSTITLKDNVIITQVDQGINAHDHSQVTVSGGLVSASTVGMYAESGSIITLKDKAEIISFNGGGLYATDPQTKITMTEGTVNAKEAALYAENGGHIDVTNVSVTGEIGGLQLASVLSTSLNESNDPKNYQNAEINLTNTKIHVDNGTGILIATFSDNTIKNITNLSIGTANLINSEIHADVLLGNGTWGNQEFLEAINAKAIPNGSFTLNADHSTLEGRANITKERNVRFNLKNGTQWFLKNSAQENDADGNLLDIAQRARSDVSVLNLNNSSVVFAEPIEDGYYHTLHIGSGKPDTRAVYNATGNAQISLNSQWSDGAPIADQKTDRLLINGDVSGNTSIYVTRRSGGNDVKENTSASANVRGLSLIQVSGNAREDSFKLVNGYTTRNGTPNKYTLRAYGPNSSHGKANIAQNLLDEKNENFWDFRLQPEFLNSNPGSGSHPGSPPDPEQNVQAVVPQTANYLLMPNALFYTGLIDMAKQNALLATMRTSVSGKQQEKQNGFFLYTYGGTGTLSSESAPRKYGYSGAHLRYAALQGGVNFAALEGQNTTTHFGLIGTYGQLSFTPKNMKDASKSTVDKWSLTAYGSIQHDNGFYLDTLLSYGILKGDISNAIIGKTAKVKNAKMLNISTTIGKKFATGIAGVTFEPQAQLAYQYLMFDTISDTDSFKVNMNKHHQWLIRVGGRVNKTVVTAENGRSVSFYGKINVIKTFGDDQAIYIDKAYQLDPMGSLLEGGLGISAQLSQNVSLHGDVSYQQKLQKTGISGASFSGGIRYQF

SEQ ID NO: 1166 - protein, 216 aa, Campylobacter fetus
MKRCFAALALVCALALSGVAKAEGTGMYLAPKFLMSIQNNYPTLEVGPDSASENYSQFTLGGALALGYDFYSQFGVPVRAEVEYALRGNSEKSWSYDALDVKGAWNASTLFLNLYYDFRNSTAFTPYVGAGLGMAFNYANYTFTTKGYNANFDEHHTTFAWNVGAGVAYDITDSFAVDLGYRYMNLGYYEMDLPAGAKVKNQPSNHEFMLGLRYTF

SEQ ID NO: 1167 - protein, 776 aa, Campylobacter fetus
MKKFVFAWVIVCISIIELQAQSMHVSSYCSNKIYGFIQYQNTKEPVAGALVFVQELNSYVLSNTEGVFEIDSLCEGVYRLHIDMVSCFHKDTTIIVPVKNSIVISMEQSSDEKEIIIIDPLHTNQPEISSKEILEKDELARLRGTSLGESLKSIPGVSAIQTGPTIFKPVIQGMYGSRVLILNNGIRQEGQQWGNEHAPEVDPFIASRITVIKGAQSIRYGSDAIGGVVLLEPEELNTFRGTKALLNLGGFSNNRAGVVSGIVEHGFKNMPGLAVRLQGTLRKGGNTKTPDYWLKNTGFQETNFSWAAVYQRNRWGVETFYSQFNTELGIFSGSHIGNVTDLINAINNDQPAVTSGFSYAIERPKQVVTHELWKNKAYYKFGQSRLVFEYARQYNKRQEYDSHKAYNPNLPDQAQLQFELTTQLIQSYVEHTIGRIKGVVGAAYINQSNTYEGRYFIPNFRSNAIGLYITESYQASLKTTIEAGLRYDYKTVQSYYYENNSLQTPDRSFQSPTVSVGVATVLNDYLNLQTTAGTAFRPPNVNELYSNGVHHGAAAYEIGNPDLTSEHSVNVSMTLNYVFKKCFGYFHTYGYYFNNYIYLKPAFPPTLTIRGAFPTFEYTQVNATYGGFDIAFNDSLSKHLIYSTRLSLVSAYDRTQHDWLIYIPPTRWQNGIKYLLPSKGRIIKPYLSLDGIWVAHKSNTPADGDYKSPPPGYFLLQAEIGTHITIAKQDMLVTLTGQNLLNTRYRDYLDRFRYYADAAGRNIILRLQIPLDFTKN

SEQ ID NO: 1168 - protein, 172 aa, Campylobacter fetus
MQKTILLSTAAALLIAGGASAQESKWNIGAGYTYFDASDVELDVINVRGGYDFTPYFGLEGELLVGLEDEDLSVAGVPAEVGLDYGLGIYAKAQYPLAEQVSVYGRLGYAYHEFDASVATVNLDDSSDAFAFGGGLEWTVSGPNAVRLDYTRYEYDGDGDADAFSINYVRRF

SEQ ID NO: 1169 - protein, 435 aa, Campylobacter fetus
MINLICNFRNSQLNKIDMKNFLISGMLLIFASASVYAGGYRVAAQGQRALAMGHAGVGVVNSAEIAFFNPSGMVYLEDKFTVSAGVTGVFSNVKWQNRSTGQFAETQQGAGTPFYLHAAYKVNEWISLGLSVTTPYGSSVEWEPDWAGSHLVNDINLAAIFIQPLVSIKLSEHFSIGGGPIFVTGNVNFNRNASRTLTDEQGNRSNITVDDTGVSNTGWSGSFMFTPVKELRIGFNYRSEILLNAEGGEAVFSNFPNSALTPQNGTTTFNATLPLPAELTIGFAYEPNEKWLFAFDYQRAFWDVYNSLDIEFGNPNVPTSINPRNYKNASIYRFGAQYKATDNVTLRAGYYFDESPVQAGFFAPETPRNDGNGYTAGLSFQVSEKLAIDASFLYLRFQEVDASYDSYLENGQSVPFSGTYKSNAFLPGLGVTYKL

SEQ ID NO: 1170 - protein, 200 aa, Campylobacter fetus
MLKKIMAISLGFSALSIATAHATTPGAYIEGQLGYAHTGTRFIKPFPSGKVDSKYQGGLAGRVAIGYQFNPNLAAEMGYLQLADQEAKLKSPVNQSITINQHAFDLVGKGILPLSDKFNLYAKAGVAYLVTDLSGDTINQHSIIKPVAKQSWAPEAGIGLTYNVTPNMFIDTAFTHIQPIGKNKPSNINMATIGLGFTFG

SEQ ID NO: 1171 - protein, 1008 aa, Campylobacter fetus
MKKSCSSQLLQIWRLLCYALAVCLYLALPNAFAQSSNATLRGQVSRAQTGAVVLVTNTATGLVRRSTLLSDGTYAMTGLPPGEYTISVGGVSRTVTLSVASSVSVNLDAGVPISGDAKTLDAVQVTGQAIREVKTSEIGNTIALRQIQQLPQATRNFLEFADTVPGMAFNIDPQGRTILRAGASNSSASNLYIDGVGQKSYVAKGGISGQNDSQGSPFPQLAIGEYKIITSNYKAEYGQIGGAAVTAATKSGTNEFHGETFYRYTNQNLRDRRPDEGETKVDSQTKEYGFALGGPIIRDRMHFFFAYEGKDNVVPRGVQADARAAPYVHFLPSYLSQQYGPVNLPFNEDLFFGKIDFEPSGDDRLELNVQYRDETQIDNIGGQNAADHGLNKINKDKRGSLRWQHSADAWFNELIFTRENASNNPNPMSIGNGFNYVYLDETDPNIGEYTFLSIGPDGGSSMQRRHQDGWSLQNDLTFTRVKWHGDHTIKMGVSYKNITLQSQDAASLNPQFSYAVSSSGVATTPYRVDFYSPYATPGQKPLVETRAKQYGLYLQDDWNVNEKLTLNLGMRWDYEDNPAYTNFVTSQAFVAALYADDPENPGHPWANRLLSSGINVADYISNGHNRHNFNKGWAPRFGFSYDIYGDEAAVMHGGAGRSYDRNLFEQMAYETSKAALSPVAVYFQDPATHTCYRSDRVCVPWDPKYLNGIDQLNAIAGVSGSGELFIFNNKLKTPYSDQYSIGISNKIGGWLTDVTFQRVLSNDGFAMSLVNRYPDGRYFDAEGNAPWDQSVPGHKNTILGMNGLKQRSSQVLLSVEKPYSKESGWGVNVAYTHTSARQNRTIDEPFAFDKATIYEYPFVKSDAVAAHRLVVSGSMDGLWGMTFGAKVVLATPTPINTIACYGQIDPDGANCQQVGVIPPSSGKFLVGGNIWGYRTVDFQASKEFTVFNDFKLSARVNLLNAFNFKNYASYVYNSFGSDGRLQPDITINRIGDINYVPRTVTFELGMKF

SEQ ID NO: 1172 - protein, 371 aa, Erwinia amylovora
MKRNILAILVPALLVATTSHAAEIYNKDGNKLDLYGKVKALHYFSDNNKSDGDKSYVRFGFKGATQITDQLTGYGQWEYNIAANYAESQETKDNKTRLAFAGLRYGKLGSIDYGRNYGVLYDIAAWTDMLPEFGNDSYTRTDNFMTGRTTGVATYRNTDFFGLVDGLKFSLQYQGKNGSETDNTNGRADATKQNGDGFGLSSSYEIGAGVSVGAAYASSNRTTAQKEGRFGKGDKADAWTTGLKYDDNGVYLGATYAETRNMTPISGTAVINNVSTSVSGFANKTQNVELVAQYLFDFGLKPSLAYIQSKGKDIEGIGDADLVKYVDIGAYYYFNKNMSTYVDYKINQLNDDNKLKLNTDNVLAVGLVYQF

SEQ ID NO: 1173 - protein, 435 aa, Rickettsia prowazekii
KPKEQITMRVMKWSMIALAVSAGTSQFAMASAQSDSKGFVEDSTFSINTRALYFSRDFRNNPSGPGSQSRAEETGLGFNALYQSGFTQGTIGVGVDVIGLLGVKLDSGKGRAGTGLFPTGSDGRSQDDYSKGGGAVKFRISDTVLKVGDQYTTAPVFASDDSRLLPELPQGISITSNEIKGLKLEGGHFTSSVAQNQTYHDSLGLTKTDFVGGVYSFTPEFTGSLYYAKTEDYFRKYYSNLNRTHALSDDQSFALDFNIYDTKSDGEGLQRAYKDNGLPFAERTKLDNRAFSLQGAYTIGAHTFTLAAQKVTGDGDYGYGVDGGGTVFLANSIARSDFNAEGEKSYQARYDINMATFGIPGLSFMTRYVTGSGANTATTSNGKEWERDIEAKYVIQSGPAKDLSLRLRQATYRCQVYSGSLDELRLIVQYPLNIL

SEQ ID NO: 1174 - protein, 280 aa, Rickettsia prowazekii
ATDSTTLYTSWGVGFKAGGFNNSGASQIVNFYLVENGGALVAPPDLIREETSSSFELGFRSGLLDGNLQLNGAVFHTEVDDMQFFEFFVGPFGLLRTAENIDEVTLQGFELSAAWAITDNLRFDAGYSMVDGEIDVNALRPYTAGNDVPNNPEFTANAAIQYSLPLGRFELFSRLEYSYQGDTWYHTVQDDVVPATLFGGPPANYGQDPETGQGGTQVDGYGLANLRVGLRGEKWSIMAFARNLTDEQFVAEVILAPEFGGGFVSPGTQRRAGVEVQYSF

SEQ ID NO: 1175 - protein, 151 aa, Rickettsia prowazekii
SAEDKEYGVLNNSKYIPTDGNTVGYTFKGIDGLVLGANYLLAQERHKYTAAAGGGARAVAGEVYPQKISNGVQVGAKYDANNIIAGIAYGRTNYREDLTIGAADNSNKKQQVNGALSTLGYHFSDLGLLVSLDSGYAKTKNYKDKHEKRYF

SEQ ID NO: 1176 - protein, 578 aa, Rickettsia prowazekii
IRYFTFGALETADLERVEVLKGPASILSGEAEPGGIINLVSKQPLRNPYYSLEGSAGSYRAVRVGADFSGALNSDKTALYRFNGYYKDAGSFRDFVSSEGAFLSPVVQLAFGKNTTLTLNATYRNERRTADDGFLAIGTGITDLPRSRFLGEPFQEFSVNDFSVGYLLTHQFNEQLTLRNAFRAQWVNPERYFPLRNSFDEATGDLELATYFAAGEYQTITTQTDLIARFSTGSVNHQLLVGVDYGRQRDKPKFAIGDPYRTINIFDPTYDGVEYPKEELYNFFRDDTINKLGIYVQDQVELASNLKLLIGGRYDSYTQNRSTEGFGEPRQEFEQRDSRLSPRFGIVYQPVPAISLYASYTTAFKANSGTNRNGDGSPFKPRNSQQLEAGIKADLARNLTATLAFYDLRKKNVTTDDPTSSDPNDQLQTGEQRSRGIEFDLVGEIVPGWKVIASYAHTNAFVSEDESGFQDKRLDNTPRNAANLWTTYELQRGSLKGLGVGFGMNFVGDRFGDLSNTYEIPSYVRTDAAIFYNQDKWRAAINFRNLFNTKYFTGSDESRLGVYVGEPFTVTGSLSVVF

SEQ ID NO: 1177 - protein, 861 aa, Janthinobacterium lividum
MMQSQRLTASPPGNPMHIDHRRGGRLALAIFVATHAPWLYAQAQSDAPAERTEPATLAALTVTAQKREEALQDVPIIVSVLPEQLLLDNGVHDIKDLQVLVPGLIVTSTQSAAQTTARIRGIGTVGDNAGLESSVGVVIDGVPRARNGVGFSDLGELERIEVLKGPQGTVFGKNTSAGVINVVTRRPSFTRSAEAELTAGNYGAFGLAAAFNDAVGETSALRVYAAKRRRDGFENVVTGAGPRTATDDGDQNLETGRIQLLWEPSHELAINIAADATNRNENCCVTVTTERGPTAAILNALTPGGQGTIGQADPSRRLAYSNRSTAQDIRDRGVSAQVDWTTPWLGAPVLTSITALRDWTSVNGLDFDFSAADVLYRAPQQDEMLTGFRTFSQELRLAGSSEQLDWMVGAFYADETVHRNESYRFGTAYEPYLSTALLGRINPALAARADAPRFLADATGLPTGSLFRGQGSQDRFRQDGRSVAVFTNNTWHATDALDVVVGLRYTYEHKALASSFENPDGSPACASYFAANGQLDPAAARRIGAALTARGVPAAAVPSIAPQVVGFSCLPWSNVAHDGRRTQQQLTEREWSGTAKLAYRWNDALMTYVSAARGYKAGGFNLDRVQSADGLSTGVQGIVPVDDTAFPGEFVDSYELGAKTTWLGGNLLLNAALFYQDFSDFQLNNFLGTSFVVRAIPTVISQGVDAEVLWQTGLPGLMLQGGLSYTDTAYGQDRLPDADLALLPGSRTSFAPRLSGNLALSYEHAIGSQLIGRANLGAKYSSDYNVGTDLDPQKLQPSYTIVNARLGIGASDKRWQLEAWAENLGNVTYRQVAIDAPLQAGSWNAFLGAPRTFGMTLRLRY

SEQ ID NO: 1178 - protein, 735 aa, Janthinobacterium lividum
MMNDIHSHLKPGRIHRMSRSQPHRLPRLVRAVPIPLVLVLACRAAYAAEAPDAPQAMQGVTIEAQRLKIATQSTTSSKTDTALIETPASVSVITRDQMDAQGIQSVGEALRYSAGVLASPSMAASQRYDRFDNVKIRGFDVGSNGMLRDGLRGTTVQAWPKVEPYGLEAVEVLRGPSSVLYGQNSPGGIVNQISKQPLFQPYRELQLQTGNFHRKQVQGDVSGPVGEGSDWAYRMTGLLRDSDSQFTGVPDDKVYIAPALSWRPSAATSLTLLADYTRDKFGPPAVVAPIQGTLLPNRHGRLPYNQMLNEKGLDNHRVQYSLAYLLEHRIDDVWSVHSKARYGRVNLITETIQGRLLADQRTLRRTPYFFDIDGESWSLDNNAKASWRSGGAEFETLVGLDYRHTKEDYVLNGGPAGAEIDMYQPVYLGHMLPTPERYASTVQSSDQYGLYAQQQIKLARQWVLSAGVRKDWSDTSTRDRLDGVTPPSQKDDALTWKAGAVYLAENGLAPYVSLMTSFNPVLGNDFYGKSYDPTKGKQAEVGVKYQPPGFDGFFTASVFDLRQENVQTLDPNNSLNRLQTGEIKSRGVELDALANLTRNFNVAANVTWNRLEVSKSNNVNEVGKRPVGMPETMASVWGKYKLVQGPLAGLGIGLGLRYTGATKADSANRIDVPSYLLTDLALDLDLLRLSPSLRGTQLALNVTNLSNKHYYDSCSSSNCSTGDARRLLLTVKHAW

SEQ ID NO: 1179 - protein, 376 aa, Janthinobacterium lividum
MMNAKSIAAAALAVAQAGLAHAQSSVTLYGALDAGVLWQNTSAASFSPTAPNTGAVVRFKDGGVYSSLWGIKGTEDLGGGYRVNFRLQGAFDGGTGKFGLSDAPGAVAAFNQIATLGVSGPFGTFNAGRQIVPMIYAMADTDVRAARFFGSVLTAWLGLNTAAGWPGNSTNAPIGALYDSDALVYQSPAFGGASLALEYAPGGVPGGVQRGARASIVLKYASNALNLAAVYYNGHDTNPAPGASATGLDNNRFVYVGAQYKLKDVAVSASYGNGRNPARGDRVNLDMFAFGLGYRVSPFFRVSSGVYYLKDRNRSANRSTSIVLGADYELSKHTTLYAQGGRVDNRGTMAQMLAYGQPVAPGLATTAAMLGMRHSF

SEQ ID NO: 1180 - protein, 644 aa, Janthinobacterium lividum
MSLFFRRTLGPATVVLVCLHSALAETELETVYSEVIPASATLPEFSVTQVQILTPDQFSDTAVSVADVIDQVPSVQVQQTGELGSLQSVTVRGAPSQQTQIYIDGVLQSSVGGEGNYLQQLSLTDIERIEVYPSSTPMQFNQATPGGAINIVRKRQHQTGLTLKAESGSFGRWGGQINARGRWLQTDMSAFLQGIRSDNDFTYVYDGGGTYGTDETELTRKNAGYHSVQGGLSLRRQGDNQSLNGNLEAFQNRKELPRTNNRDDGNAYYADRGVRLSLAYDLNQWVQNLDSSVRYQYLTEQGHLYDPDNQVGIQRNDSQDTLQSHLIQYHHLVSAGSVMLTGSQSLTWDQFSLEDEINGTTLDADAIQLSSSLGGEWFMGNNWTAIVTGRTLWIQNQQDGNRTDDSDWGLQAGLRHPLGPVELQWNIQRSHRQPNLLERYGAKGTFVGSPALESEQSVAADLSVTYKSPQLYAHGSAFIRQTDNAIAATYDSQGVGRYVNVANALYRGIEWQSQWRLKPVRLDVSGTLQTGIIDSGSASYDDGNQVPGYYPLSNDSRLSWQLTPKLMLYQRYLFETGLFYDRYNSSQPPTKHQWDAGVKWQNPRLSMSMDITNLLNRAHLDYSRKPLPGRAILFTIQITTGADS

SEQ ID NO: 1181 - protein, 339 aa, Alteromonadales bacterium TW-7
MIINKMRKSTIALSIFSALLVNTANAAKVFNDGESELNIHGRVQGMYYVSDDKEVDGDNSYLRVGLDGKSKINDDLYAFGLYELQLKSNSHRDESGREDDDLDVRKAYVGLGSDYGTVSYGRQYGAVTLVSDYTDIFPEFGNEAAGVSADLFGTGRSDSVFKVTTQVNDLTVHVSYQAENEEVSTDAKSYGIAADYAFPMGFKFAVGYNKGDSAEGGEDAELLITALSYQRDKFYAAVVYNTGENYAKGDGSESGTDYDGIEAVLTYNFTEDFLVLAGYNSLEQDKESKVDVVNYYSLGLEYNLSSNFKTLAEYKFNELDDSESQREDDVLALAIRYSF

SEQ ID NO: 1182 - protein, 354 aa, Alteromonadales bacterium TW-7
MKLKSLTIAIALAATSASAFAAEKTEGFYIGVFGDYYDASWKNLNMHQNLEVNESASWGAEVGYRFSDYWSARLEYADMDFNAFLKNPIPNGNRNDVDGERFGVDALYHFGGGPFYGLFGIKEVKVATDNTFLNAGVGYQHFITDGLFVNAETSVYQGLDRGYTDVNAKLGINYLFGQSSVAEEPVQPAPEPVIVEVAPVDSDNDNIPDADDQCPNTPMTDAVDGTGCTLYEDKEVTVSLLVTFPNNTSAVSTQYLNDIDKVAEFLKEYPDTTVLLEGHTSSVGKASYNKWLSKKRADAVAKKLVADGVAEDRITTVGLGEERLKNEANTKAAHEENRRVEAHIKTIKNVKVLR

SEQ ID NO: 1183 - protein, 788 aa, Alteromonadales bacterium TW-7
MVIYQANAQDCNYSFSGKITDFHDNSLIVGASIQIINLNKFTTSNLEGEFVFNNLCEGKLTLEIKHVACETKRLVINLTKNTFKEISLEHHLEELKEVVVKTNTKTEVTSIEKSLKKEVISNFTDKSLGDALNTLSGVSSLNTGNSIVKPMIHGLHSSRLLIINNSVRMFDQEWGDEHAPNIDISSSDRIDVIKGANSLRYGSDAVGGLILIRPKKYAIKDSLFGSTTTSINSNGFGGNVTSEIIKTFNSGYYTKLQANYKRFGDFKAPDYYLTNTGLENINASFRTGFNSYEKGFDAYYSFVNNKIGILRSSHIGNVNDLVEAINNREPRIVEDFSYDINFPRQNIFHHLAKVEAFKRFKNLGKLSLQLDAQLNRRKEFDLRRGDLRDRPVIDLQLFTASIQPNLEINKFDNLKINTGFLVRYQNNDAIVNTGANTLIPDYNKYEVGTYAILDVDINETSEFSAGIRYDYSRIKARKWYVESDWTALNYDVLFPEFDTGIVDGLELLTRPEFTFNNFSTNLGYSKRFGKDYSFLFNYGLAQRMPNPSELFSGGLHHSAARIEIGFLTINKETANKFILSLEKNNENFGFSISPYYKQIDGFIQLIPTGIRTTIRGAFPVWEYNQVDARIFGVDIDINKKLASHFDYKGSLSLLQGDDLTNDNPLIHMPSANFSNSIMYSNNDFHQLKIGVNQKTVLQQNRFPDYNFTTLDPVTQQQVFVDISSTPPSYTLFGFSSSAVFYPFKKGSMEVGFNVDNLFNVSYRENLNRLRYFADDLGRNLNLKIKINY

SEQ ID NO: 1184 - protein, 67 aa, Alteromonadales bacterium TW-7
MADKVYLKYTPSDYSFNLGKNASGIVFNQTAPPEEGAEEKTINSSRGRQHTDVYPALAGNTDTAMFH

SEQ ID NO: 1185 - protein, 785 aa, Alteromonadales bacterium TW-7
MLKKTRLSCAIAIAVGATTTMIAPVHAAMLEEVIVTATKRAESAQDIPITIQALGEETLENLGIGNFKDYIRAMPGVTAGGRGPGRNEVFIRGVSAGKGGLKVAGAAGSEPNVAFYLDETPISMGGRNIDPYMTDMNRVEVLPGPQGTLFGASSQAGTVRVITNKPEYNEFSAGFDAGTSFTTGGDPSNSVEAHVNIPLIDDTLAVRLAIFNASEGGYIDNVRSSKQISLNNPSLAGATPIRETVRNDAFVEDNFNDADYSGIRAGIKFSPNEDWDILLQHMQQSIETEGVWDYDPSLGELKSQSFTPDHGDDDFDLTSLTVTGRLGGLEMVYAGSFLDRTVEAISDYSGYSDNGPYMPYYICAPGYATCGTPDLFLDQYYNVERTTHEFRLSTDIDKPLRGIIGIFADDTETIERGNWNYVASIANGFVPNAPVAGSTASDPSVRNPGVTFFNDFTRNKEEMSFFGEVAYDVTDSVTASVGARRYDIELALAGSSNYGTTSVSTTSGNNVDARLLGRSPADFQDTIWKFNVQWNVNDEIMLYSTWSEGYRPGGFNRNGGAGASATSPGIPFFYESDEVTNLEFGWKTELMDGNLRFNGSVYQIDWEGMQVITLDFDISNTAFINNTADAEIQGIEIDSIWAATDNFTLFANVSYNETEMTRVPPNIVSINAEGTPLALAPELQYVFRGRYEWSLDNNAGAFAQLSYHYTDETISSVLADASYKQDSYTTVSATLGYSRDDWSITLFGENLTDELADLFISGEDNILKTTPNRPRTIGLRFSYDI

SEQ ID NO: 1186 - protein, 805 aa, Alteromonadales bacterium TW-7
MFKPSLLTLAISSTLSSVVLFSNTASAQEQVVTKNKSLEVIEVTATRRSGSVQAAPLNITALDADVMKDQNISELADVARWVPGLTITDQGGREGSPIIVRGLNTNSSGPASDGGTVATYINEIPVSVDMRLVDIERVEVLIGPQGTLYGAGTLGGAIRYMLKAPELDYTSGEIYGDVFQTQESDSVGGEGGFIFNLPIIEDTLAIRTSLNLYKDPGFVDYNYVVREPGVSLSDPDWSNTDAVNNNLKQVKDANGETTTTGRISVRYKASESFEGTLNYFYQKQDSEGRSIVHSNSLNANNGLSDIIGKYESAYRYEEPRVKEDQLLSLELKADLGFAELVSATGISSFEAEGQRDQTDLLIRLDYGYEEFPAFSTFTREIDEVDTFTQELRLVSQSDSDFSWIVGGFYNKKDTDASSREFTPGFDQFAVDNFGATQLRPDALEYLEITSSKVTESALFGEVGYQITDKLDITLGVRFYEYDVKSKAAFDFPLANTLYDGAGPNDIAINFEENAASDNGNLLKFNAKYQFNDTVMGYVTVSEGFRIGGSNGLVPCPDPLPDDQQTGCGKPDEMLFDADITTNYELGFKSTWFRSQLHFNAALFNVDWDNAQITGATAVGQLPYLSNAGSANAKGIEIATRAILSDSFSAYATYAYTKAELTSDAPFLFNADGTDGAADGDRLPGSPEHQFSLGINYQTDVFNDKTLDINYGLTAQSDVISKVGLRDNGEVLPGYSLSNISAKLTADAWSTTLYVDNMFNKYAVTSVRRSDADITSANGAEIQRNYGHYINRPLTVGIKFNYKFEI

SEQ ID NO: 1187 - protein, 318 aa, Alteromonadales bacterium TW-7
MKLKNIVIATSVLFGTATFSFAAGSDNMDMSADTNTPVTQSSSSNSFIAPFANTYSSLTNKNNTWGPQDRTGQWYFGVDANGLAGTPNSPSGAGANMTIGYNVNKYFAVQYNQLVGRVFAGLGEGVINFSNSTMITPYAAGGAGWANLAGQATGAWDVGGGLKFELSRDVQVSADYRYIQTMAPRGMSGAQGRAGTNMIGGGITWFFGGKDDTTNDTGNIQDNGATTAAETTAMPTIDETKYVLPQGIKQCEGNFNLTKEGVACYTVNGDDVTVYLDTKFAYDSANLNSKGKEAIASFVNFVKNSDINTVTVKGYASQ

SEQ ID NO: 1188 - protein, 671 aa, Alteromonadales bacterium TW-7
MKTQFLTTSISVLALSVGFSAAATAQSLDYTAMSDLFGEAVTAGATGAPQRASDVPATMVIITQADIERFPEYDIPGILRHYAGINHNRYGYGDGQISIRGAATPYSPRLLVLINGREVYLDSYGYTAWSTLPVQLEEIQQIEVVKGAQSALYGFNAVSGVVNIITRNPHHGDYATARVNVEADGGFDAAFVAARQFGDRAAFRVSYGNAETSEMPAGANAIQAATLALQDYHRETGAVEGRFSLTDNVSLTAEATFTNVDQSEMTSVYSSARALYELRSYKAELEADTDYGVITALAYRNESEIVYSFGPLSAELTTFRVQDLFKVGTNDTIRIGAEYRDGQTASFPDPGNGDFGYESMAISAMWNHKFSNTWDLTLAGRYDVVDWSRDSAPGAFYSFTQEDYSVSFEEFSYNAALVWRPTFGGTMRFMAGRGVQAPTSFDIGFTLQTVVGGNPLILSGNPDMVPSIVDSYEVAYDRAVTPTINMRAAIFLQDTSDVRGQIGLFPDLLPPAVTIPTLLFNNRGDTSTAGFELGFSGDPDGPVSWDANYTFQETEDDLTGIFGLNHLQDFENATPSHLFNAHVGWTGEKLSVDGYVNYVSETTTPLQPVFGLPTQVAIDDYVAISFRAGYRINDHIAVSLNAQNANFGDGEATTANAQSDSRVWFGLSSNF

SEQ ID NO: 1189 - protein, 611 aa, Alteromonadales bacterium TW-7
MKHYIYLCILVCLWTSPTVAQLDSIQKLEEVIVVDRQISRFSTGQRVQNISSSILQNTPGLLTDVLGQETTIFFKQNGYGMVSSPTFRGTTAQQTAVVWNGFNINSQFNGQTDFNTLLVDGFDELSVRPGGGSIIYGTGAIGGSIHLSNQLRFDGETSAVLSARTGSFSTFQNLLKASTSTDRWSLSLALSRFSSENDYDWPTTNRKNLNGDFEHYNANLSLSRKLGNGHRLTYHGMYFNGDRNFSLLFPSDPRSNYLNEDHRHMLEWEKEFSNLTSVLKMAYFGEDFQYTANINNPNPTGAGAQTAIARYSLFYTYNDFDFNALSEYNYSTADGDNVQADSRTIASFAFLAKHQWKQLTSEVSFRQEYSNVYDSPFLFSTGFNYVFSNYVEAKAKVSKNFRIPTFNDLYWEGSGQTDLQPETSNQLESSLIFSNAKKNHRFSLTGYYNDINNLIRWIPNVNNIWEPENVDEVETYGLEAQLESTFKFGEHLFQLNSLYGYTISENKQTGFQLTYVPKHKLTNGFTYSWNRFSVEIQNQYISEIFTRSNNSEGDILEDYLLWNSGLSYKFPKIQNLKLSFQVRNITDVAYQTIENRPMPGRHFFIQTLINF

SEQ ID NO: 1190 - protein, 821 aa, Alteromonadales bacterium TW-7
MQTRTAHTERNFIKPQTACHSWVGTLLLASTALVAIAPTTALAQSAPAVTQAGAIAFSIPAGPLSAALTQWATTSGMRVLFSSEITRDLKTSGVNGTMTADVALGRLLTGTGLGYSFTGPTTVAIRRNVDVLPATNISSEGTIVLDTIDVQGDGTFGYIATRSDAGTKTNTPLIETPRSVSVVTRQEMDDRGVQNLPEAVRYTAGVTTGAFGYDPRFDQIYIRGFAVTTLGDYRDGLRQYAGSYATFSTETYGLERVDVIKGPASVLYGQGTPGGLIDRISKTPTGQPIHEILGEVGTFGHLQAAFDLGGTAPDNKNFLYRIVGVGRTGDTNYDIADDELYLAPSFTWRNDTTSLTVLALAQKDETDANVAMINKNSHVTKVRASDPDYDYQKQTQYQVGYKFEHQFNDMFEFRQNLRYGQADLTGRYLTGGVTGGGFASAASPIYRRGSAAVEEDLSSFQVDNQLQINAATGPLGHTLLIGLDYGEMHSNFGSGTAAANAAYAINILAPYYGITGPTPAINTRTNTDFDQLGIYAQDQIAWGNWRFNISGRQDWTSRTQVNGYTGLVTGDREDNAFTWSTGLLYLFDNGWAPYVSYATSFQPTSNLGYEGQILAPATAEQYEAGLKYISPDDRISMTLAGYNLKEQNAPKYAGINPTSGLLYYQSIGEIQVRGFEFEGRLRLANGVEAIASYTYADAEILQSATAAEVGRVPAVTPRNVATAWLNYTVQDGPLFGLSGGAGLRYIGQTYGNNTNTVINSSYTMFDASLRYDLGKLNQKLTGYSLSVSATNIANVMPEICNSGTCYLGQGRTVVGTLKYKW

SEQ ID NO: 1191 - protein, 767 aa, Alteromonadales bacterium TW-7
MAKSRTRSPMLHSRAPSFTCAPPALARGRAADKALLPLMPLGALMLGACVGAMAQTATPDKTLAPVVVKERSDAPEGKDSLRASETRIGKGRQQLRDIPQSVTVVTERLIDDRNLDTVKEALKNTAGISFMAAEGGEEDIRLRGFALQSTGDMFIDGMRDPAFYDRDTFNLDRLELLRGSASMLFGRGSTGGAVNQVSKSPRLIDTHQVDLTLGSHQYRRMTGDFNLLTGENAALRLNAMSTTADNDGAGSRIEKKGLAGSYAWGVGMRDEFSLSLYHLDNKNGMNYGMPWIRPNASAPASATTLLPLDPKTYYGAASDYSAGSASLATLGHTHRFDGQAELKTQLRVGHFERDQRAGAIRFAQASRQPGGLAATLENFGPATRLERRTHLKIQELNSVQLQSDFSNKFQALGRQHELLAGADFTDEKKTVSAARSAAQGGVDLSKPDTTVGQPNDGAGIDESRRVLRSASDFKARAFGLYAQDLVQIAEHWKLLAGLRYDSMNGSYRSLSIPREAPAPVTTTSYRQKISAWSQRAGLLYQPNGLQSYHVSYGTSFNTSGDTYSYSSKTVNTPPEASRNIELGAKLDSADKRLSTRLALFHSTKYRERNTDPDLNIDLLSGKRHAAGAEIDITGRLTPRWEVYGSYMWMPSAKIDIGAQGAEGQGSRPSLTPRHSGTVWSSYQISPALRLGAGVNWRSSQTPNRNPGWTAPGFMVADLMAEYALSERYTIRTHLGNVTNKLYADSIYPGHYIPGPGRTIQVTASVKF

SEQ ID NO: 1192 - protein, 257 aa, Alteromonadales bacterium TW-7
MELSMKNKKYINSLLAACVLFSCFNGQAAELKRVYGKLSFGYGDWNKGFVNVDRGEVWKAVADFGAVFDRGEFASFYEMNVLNHPVEGRNHVTQFLGHYRPIEGSDFTVMMKLYMSMENKFGDELNMMYGVGYLGLTSPSGFIKPYIAVHNLSNDYTSKKYGQATGFNGYVLGWVAAYNFDMFNEKFVIANWNEVEMDRNDAYAEQQGGTTGLNGAVTFTWKFMPRWTASVSYRYFNNKLGYDGYGDRMNYLIGFEF

SEQ ID NO: 1193 - protein, 681 aa, Alteromonadales bacterium TW-7
MSMDLDDLTTQSVTVTTAAKKEQSLSDVPAAIYVITNEQIKRSGVRSIAEALALAPGVQVTKISEFNWQVSLRGLNEALFNKLLVMVDGRSVFSPLMSGTFWHTIDAILDDIDRIEILRGSAGTMWGGNATNGVINIITKNSNETLGQFLEVAAGEYNYKEVSYRNGFQINDVTTARLSVKGVQSDYYTFNDDEWNSYNISFRTDYVEDDRFLTFQIGGYYTKSEHSDWYRYDILETPPNPNDPMSAIVGYKAGLDDFSRGFYSNLNLGKTVDDTHYEATLWIDSNSRTEPSANGEYDTLNTDVLAIKQISQNNELTLGLGARYTKIKVPEIEMDFYLGMDPYHRTSTKQTEREQIYNVFSQLETQLTDKFTSSLGVKVEHFTRNNTTEIQPQARLLYRASDDHQFWSGVGRAVVTPSSVDSTTDLYRLGSVVAPLPNCDASSQNCYAQYPMLALTTGNPDMDNESVVTWDVGYRGKISDTLSIDTTIFLSHYENLRMLDDGLWFCRYGECVDGSTQPGQLAVHEFTLIDAIDAQSYGAELSLFWQPTENININTSYSYIDTQAECSTEYITCDSYDNGGYKVLYNLQPKHYVSLQMMWSINSQWQIDGWLKHKSSVSSYLDLYRPPEITTMDVRVAWQYNQDWPLVEFVVDGLGSSTYEDLPNKAPLEEAAFLRFSWTKL

SEQ ID NO: 1194 - protein, 710 aa, Alteromonadales bacterium TW-7
MANGYGEIINLGEKNIYSETGFEKNLRNSTTSPYIITSKDIETKGYTSVSEILDSVPGVNIQEGLHPAVDVRGQGFQKAKATVQLLVDGVPANMLDTSHMNVPIDVVNINEIERIEVIPGGGAVLYGSGTSGGVINIITKKYKGNNNVRGGVGYQVASFRNNKFDVSAGTSVGDFDFDINYSKNRKYGYRDYDFTNSDYFSGRINYNINKTSNIAFKYSGYRDKYTYPNFLDQKELDENRRQSGIEKEAKENNRIKKDEFTLTYNTKIGDKNDLNILGFYQKTDIPSESIEDYTSEYKGMLAGQAARLRKALRNPRLPARARTAMQNRLNALLAELGSTNSVDFKKFSQFKDTKKAIKIKDKFTYDNAGSNVIVGLGYTDNDMLRVSKMELVGKRVMADTKIDLSKKTFEVFALNTFKVNRFELIQGLRFENSKYDGTRKNNDDTLDIKKSKDNWAGSLAVNYLYSDTGNAYLKYERAFTSPAPGQLVDKVQTAPRVYTYKVNNLKSESTNLFEIGWNDYLLGSLLSADVFYAETKDEIATIFDGGAANAHGTAFRSTNLGKTKRYGFDLSAEQKFEKFTFKEAYSFIETKILKDNSSSFEGKHIADVPKHKLVFSVDYDITSKFTVGADYEYRAAAFIDNANKYGKDKAKSVFNLRADYKITNSLNVYAGINNIFGAKYYNSVRGNSSGERFYDPAPKINYYVGFKYKF

SEQ ID NO: 1195 - protein, 918 aa, Alteromonadales bacterium TW-7
GSTENTDTKAPPKIAETVKTAKTLEREQANNIKDIVKYETGITVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTRRNGHELENYDYKNADSLTQGKKREKADPYKIEQDSTLLKLSFNPTENHRFTLAADLYEHRSRGQDLSYTLKYQKTDPNLLEVDSRHTNDKTKRRNISFSYENFSQTPFWDTLKITYSDQRIKTRARTDDYCDAGVRYCEGTANPTGLKLTKGKITRQDGSELKFKEIDEKEKTYDFDKFIDTNNQVIEGKLTLRRASETWYDCSLFDCKNKIKVFKGKKRYGYEGTWTEVELEKKEINGKTFAKIKEQGSYSNPIQSIFPSSPGYLDRLWQERDLDTNTQQLNLDLTKDFKTWRVEHNLQYGSSYNTTMKRMVNRAGNDATDVQWWAEPTLGETATCAYSYNANLCPRVDPEFSYLLPIKTKEKSVYLFDNVVITDYLSFDLGYRYDNIHYQPKYKHGVTPKLPDDIVKGLFIPLPSGKNNNDAKVKENVQQNIDYIAKQNKKYKAHSYSFASTIDPTSFLRLQLKYSKGFRAPTSDEMYFTFKHPDFTILPNTNLKPEIAKTKEIALTLHNDDWGFISTSLFKTNYKNFIDLIFKETREFKLTSGGSSLPFSLYQNINRDSAVVKGIEINSKVFLGKMAKFMDGFNLSYKYTYQKGRMNGNIPMNAIQPKTMVYGLGYDHPSQKFGFNFYTTHVASKNPEDTYDIYAKDKRKTDTSIKWRSKSYTILDLIGYVQPIKNLTIRAGVYNLTNRKYITWDSARSIRSFGTSNVIDQSTGLGINRFYAPGRNYKMSVQFEF

SEQ ID NO: 1196 - protein, 994 aa, Alteromonadales bacterium TW-7
MKLNKIGAMFSGAKNKANNITIFGATLTAMLTMPALAAEPTAQTEAEKVKASEIEVIAVRGIFGSLKAANLLKRTDERIVDVIVAEDIGKLPDNNIAEALQRITGVSIESDFGVGESVTIRGVSENLILLNGRSTAGPGRGGISLDDFPASFLKTVEVIKSPTPEMIEGALGGTVNMQTVRPLELSEPLVAITLDGEYADKTENVAPNFTAAIGNSWDLGDAGTFGAAANVSYQDRELRRDEYFNKVDLQDDIDLDGDGTVDVSGGPNGKYLRRTESTVEQKTEQRERTAFGLSLQWAPTSEELNFYVDMNSTKLDGGQAAYSILDVGGTVVPRSDSYYDGNGQLQNYDLSGVLVIPKTWSDFTTSETTSHAIGGEWNITDNIEISGEYSISKSEERQTASEFNLRPIERTDPTLDLVTHTSTASMTNGGGIPSYVFEDTGMLTNPDNLVFREFYHKTLDTDNEEQALRFDFKIHDVGVDFISAIKTGVRFTDRDYSSNRFDLKPNGNTLKDSYKKAKNADGLYSPTWIDNPIISDSFTTINASNSFDQTGMSGQNDLLTYNVYDAEKLQDAEATYLLAQQMLAGTTYAMNGTLADNMVEDTGAYKFINEKTRAIYAQFHLDFDDITAVVGGRYIQTELESSIVDSVDSNGNKILNTGSNDYSDFLPSLNVTYTLSEETLMRFAAAKVMRRADFDELSPALSIDNSLVTGTQGSYQLEPYRVTQYDLSVEHYFGDGGLLSAAIFYKDVNSFTQTDSSCLADSSTISGQNTTQWNNICLLNTAGQSQGDIVNATQDQGLAYVDAQKAAGRTGIVIDTDVNGGSGEVRGLELGYQQQFSFLPGIWAGLGVNANYTYADSQQPDGNPLLNISKHTANTQVYWEGEEVQLRLAYNWRDRYLDDQSTKRVQTVGALGYNVFNQNDPSADNYDPTVGNSYREDRGQLDFSVSWDINENFTVVANAVNLTGEPIVYTTELDSIWAYSEADRRYTLGVRAKF

SEQ ID NO: 1197 - protein, 838 aa, Alteromonadales bacterium TW-7
MKLSSLYACASFVALSGAFLAAPAMAQEAAQADAADAVPESVGLDAIVVTASGRDKTQLNTSISVSSISAETISNLKPSSEAEVFRSIPGIQVAGTSGPGGNSNIAVRGLPVATGGSPFVQIQEDGLPTVLFGDIQFGNNDYWTRFDASVANIEGVRGGSATTFASQAPGAVINYISHTGKDEGGYVQVGKGLGYDETKVDFRYGGPINDTTYFHVGGFFKNGRGPLHADYTVSDSIQVKGNLTKEFDGGRGYFRLMFKYADTQEPNYTGSPALATINGKKVTNIRPFPGFDGRDSSNYSIYNQDFLIYNREGNLERTKMDGITTNAKSFGGQFHYEFDGGITVDNNMRYTDMSGGFTSPFLNVARTSSVLGSTVNGATVATIKYASGPKAGEVFTGEYLDNNVNVDTRIRDIGSFANDLTVAGKFDVGTGKVTARAGVFYMNQKIAMDWHVNKSLRELNGDNPSQLDLFDSAGNKLTQAGTAGYNNNWGNCCARDYDLSYANTAPYMSLDFDHDLFDIDGSVRFERVKASGYAIGGGDEFDVVSGGVTIPTITSDGVREDLNYTRSYTSYTVGALFKASSNLSIFARTSRGGRFNGDRQTLGGKIRNDGALCTSADAAAGNGGCTADGVTPSVDFVKQHELGIKSRGGLLGGRFTLELTLLKGSFKQSTYELSATKCPGGAGGCVIDAKYKSTGAEIFATYRNGGFSLVGNATYSKAKKQAAGASSYTRADGIPDLIYTLSANYDVGEIATFGLAVTGQTSAIDSAGYEYPGKAIFNPSLRVYPIRNLELGLQVYNVFDTFDLRGNGGIADASVNPTVISGAPALGRTVSASVRYSF

SEQ ID NO: 1198 - protein, 185 aa, Alteromonadales bacterium TW-7
MGYEHTKLNRNVNIGAFSANYNSKFNSYLISEMVGIGKSFNHYGVSYGPLAYIEHSFLHHFAINEENQNSTALNIDSKNFHALNSFMGFNVNYEKGMSDKAIVNFYFLGGWNHYFLDSLKNNASFKDASLNKFYTKSKLSNQDSLYLQGEIDFTHNQSFFTRLMLSSDIKDNIDFSTKLEVGAKF

SEQ ID NO: 1199 - protein, 927 aa, Alteromonadales bacterium TW-7
MRAKGLSETGLVAILVALCLGTPVAAQSRTGDEQLQDEADYEDPNSILVTGQSQRQRGAAVGDIPPIQQYNSGDIRALGVNSVAELLEELAPQTRSGQGRGGEQPVTLLNGRRISGFREIRDIPAEAIERVDILPEEVALKYGYSADQRVVNIVLRRRFHAITGELEGGMATRGGGENGQAELNFLRIRRDQRVNLNIEYQGAAAITEAERNLISRGGGRAFDTAGNITGIPTGAEIDPALSALAGAPVTIAGVPASAASGTPALADFLDTANRANSTDVGRYRTIQPRSRTLDVNGVYARNILGNVAATLNATLNATDSDSLRGLPGAGLRLPAGNPYSPFGEDATLLRYLGTSPLTQGTNGVTGHLGFTLDKDLAKWRLSLTGNYDHSLTKTRTVRGYDVGDLQAALDAGDLSVNPFGTIPATLLDQRLVDRARAKSDSGDVQLVANGPIAELPAGPLSASFKAGFSALGLDATSTRSRVATSSDLSRTDLNGRASFDLPLTSRKNDILAAIGDLSLNVNAAVDRYSDFGTLGSYGYGANWKPRDGIGLIVSMTQDRNPPSVQQLGNPAVLTPDVRTFDYVRGVTVDIPQLGGGNPDLAADRRRVLKIGLTLKPFKEDVTLTANYVNSRIRNAIATFPEATAAIEAAFPDRFTRDADGNLLRIDARPINFARQDSSELRWGFTFTRRLKTSERVIEAMRNSAFARRMAEQRAAATAAREAAGQGAPTQGGGDGARGGGRGPGGAGGPGGPGGPGGFRGPGGGGQGGRLQLSVFHTWHIKDEVLIRRGLPVLDLLNGDVIGSGGGTSRHELEAQLTYANNGLGARITGTWQSGTTVDGGAGAPTGDLRFSPVAKANARLFVNLSQIPALVDSGWARGARISLKIDNIFDTRPRVRDATGATPLRYQAGYLDPLGRVIRIEFRKLIF

SEQ ID NO: 1200 - protein, 389 aa, Alteromonadales bacterium TW-7
MKRRSKKLPWYVFAPALLLAGTAHAQQSITLYGLIDEGLNFTSNAGGHRAWQMSSGDTFGSRWGLKGSEDLGGGDKAIFQLENGFNVNSGKLGQDSSMFGRQAFVGLSSSRYGTLTLGRQYDTSVDALGFGGITAAGNWAGDIATHPFDNDNTDWDFRVNNAVKYVTPTYRGLTAEAMYGFSNQPGGFSNNRVWGATLNYQSGNLTAAASYLKLNNPGLAAGGTVNSGDLFNGSSQQDIGVAASYQFTHVLVGAAWSHVDVYNPDGNAWIDNTALQNGATWNAWKFDNFELNAQYYFTHALWLGASYTFTIAHLYTSDTKYVPKWHQIGMMLDYDLSKRTSLYLQGAWQHVVSARTGTSFDDAQIVDASAGASSGPNQMVYRMGMVHRF

SEQ ID NO: 1201 - protein, 857 aa, Alteromonadales bacterium TW-7
MTTHKNKGFGVSALSFAISLALTGSLASTQALADDQQAEASQNIEKIAVVGTRSAPRSIGDSPVPIDIISSDDLKKNGSTDMIDMLVTTVPSFNSRAQPISDAATLIRPVNLRGLPSDSTLVLVNGKRRHRASVIAFQGGGINDGAQGPDISVIPSAALKQVEVLRDGAAAQYGSDAIAGVMNFVLKDDAEGGSITVGQGEYYEGDGATTTIDANVGLPLSDAGFVNLSLQYKNADATSRSMQRPDAANLIEQGNTFVQDPAQVWGNPEIKDDYSFFLNSGYDINDNARLYAFGNLSSRDVVGGFYYRNPHNRGNVYSLDGGETLLVGAVNGDPSTCAVVPIPKNADGSDGNVLETDAYKAMLADPNCFAMNQLRPGGYTPQFAGTVEDTSFFAGVKGELGAWNYDFSAGMGNNKSTFSLKNSLNPSLGLDTPTDFETGAYEQAETTVNLDFSRMLTLGSVEDISFATGFEWREESFEITQGEEASWIAGPYADQGFNIGSHGFKGFGPESAGKNSRNNIGVYADMEAYLGERWLLGAALRYEDFSTFGDTLNYKLTAQFTATDDLSFRASHSTGFRAPTVGQENVVNTQTSIVNGDLIQTFIAPPTDPLSAFYGGKVLKPEESVSYALGAVFEHENLFVTLDYYNIEVTGRIAQSSQIEVEAKDYDALRAAGVEFPELISAVTYYTNDFDTTTQGIDLVASYDTQLLSGDTKFSLAYGWTDTSVDKYNPNTTDEGKVRRLEDGIPAHRATLTWAQSWDRFSMSLRGNYFGEYYATHADDTSDWGSEMADSAVTVDLELSYQFLDSLTVSIGANNLFDQEAQKLKDGTRGELGAIYYESGPFDYNGGYYYGRVNYRF

SEQ ID NO: 1202 - protein, 427 aa, Alteromonadales bacterium TW-7
MNTFSVSRLALALAFGVTLTACSSTPPDQRPSDQTAPGTSSRPILSAKEAQNFDAQHYFASLTPGAAAWNPSPITLPAQPDFVVGPAGTQGVTHTTIQAAVDAAIIKRTNKRQYIAVMPGEYQGTVYVPAAPGGITLYGTGEKPIDVKIGLSLDGGMSPADWRHDVNPRGKYMPGKPAWYMYDSCQSKRSDSIGVLCSAVFWSQNNGLQLQNLTIENTLGDSVDAGNHPAVALRTDGDQVQINNVNILGRQNTFFVTNSGVQNRLETNRQPRTLVTNSYIEGDVDIVSGRGAVVFDNTEFRVVNSRTQQEAYVFAPATLSNIYYGFLAVNSRFNAFGDGVAQLGRSLDVDANTNGQVVIRDSAINEGFNTAKPWADAVISNRPFAGNTGSVDDNDEIQRNLNDTNYNRMWEYNNRGVGSKVVAEAKK

SEQ ID NO: 1203 - protein, 701 aa, Alteromonadales bacterium TW-7
MKHAVCTWALAGLTFLVLFTATAEESLSQTPRTAVSQAEMQPGSTSATDDANQTRLEELVVTATRLPIPAKDLPVPVQVISRKQIAESHADDLSELLTEFLPEHFQKYPGALSSVSIRGFRTDTTGTDIKGHVLLLIDGHRAGTGNIAVIPVENVERIEIVRGPGSVVYGSAAMGGVVNVITRKGKGEPTGNGAFEFGSAEYVKGRAGFSGGFFDNRLGVSVTGRTISRGDYDRGNGNTVVNTGYNDQAYSASLFAAPHPDHTLFAVGNYFEAWDVGTPNPDYSSPNRIDNKDIERGYGSVDYDGALPDWGMNWHLSYYNVFDSNRWNYPALTYGYSSATTETRTQGVRSQFSLPTFSAGRLLLGFDWDGIDVNSFTKPAGSPWSPDSRYDNYAFFAEEKINWNKFTFLAGVRYDIFQEDLLPTEGLQVNPTSEQFGHVSWRTGLTYAFLDWLTARGAVGTAFRIPAADELAGRYQAGTWMKIVGNPDLEPESTITYEAGLDFDYAGWKGGIGFFYTDYTDRISGGFPACVDGDCTWTTYKNVEGAVFSAIEGNVGYKHSLAFHGHELSVRPFLNFVYYTQRKLEDAAYAKLLKSDSVPYVPLWDVTGGIEVNINRKVNFIFSGFYTGAEKQQDFDWTSPTYGTAVDKGGFVVLAARLAFRPVKHFELFLVTENLTDRDYCFVDGYPMPGRTIRGGMEARF

SEQ ID NO: 1204 - protein, 811 aa, Alteromonadales bacterium TW-7
MKTKIMMLALTLLTTGTVWGEDFPKDSLKVVDMEEVVVIATPKENRKLRELPIAATVLSQENMCANQVHSVKNLTGIVPNLFIPDYGSKLTTSIYIRGIGSRINTPSVGLYVDNIPYIDKSAFDFNYCDIERIDVLRGPQGTLYGRNTMGGLIKVHTKSPFTYQGTDIRMGAATYNNYNVSLTHYHRISERFAFSTGGFYEHTGGFFENAARNNEKVDRSNAGGGRFRGVYIPTSNLKVDINLNYEYSDQGGYPYYYTGIAPSTKEREEPLTEDRADYIGKISYNERSSYRRGLMNAGVNLEYQARNFILSAVTGYQNLNDRMFLDQDFTERAVYTLEQKQKSNTISEEIVFKSKSNKRWQWATGAFGLYQSLNTKGPVTFWEDGVKDVIEGSANTAFAGMPANAPKLHLAINNPTLLVGGDFDTPVWNAAVFHQSTLNDLFVKGLSLTVGVRLDYEKMNMKYKSISDPTDFNFSMKMASRPPMPSVSVEAKNLIANAGYDGKISDDYVQLLPKFALQYEWKKGNNVYATVSKGYRSGGYNVQMFSDLISGDLQNSMINAIKESEQFARFAAMIDKYAKKADVPEVKEATRYKPEYSWNYEVGSHLTLWEGKLWADLSAFYMDMRDQQISQFTGSGLGRTTVNAGKSRSYGAEMSLRASLTNELSLNASYGYTYATFTDYIEYEREDEETLKVRADYNGKYVPFVPKHTLNIGGEYAITCSPRSIFDRVVFQANYNAAGRIYWTELNDVSQSFYGTLNWRTNLEIGDAMISFWARNFLNKDYAAFYFETMNKGFMQKGRPMQFGIDLRCRF

SEQ ID NO: 1205 - protein, 460 aa, Alteromonadales bacterium TW-7
MKTKYVAVATGCLVVMLWGEKVWATDAFNLIGHGPVSIGMGGTAAAYDIGPAGMMSNPATLTFMPDGTYFLIGADMVSADLKVTSTATGETANSYSRGRNNGPYFGPEFAFVWRKDRIALGVGAYATDGVGTQYGTDSFLSRTATNNVDTGLDVFSRLLVMDIPFSVAYKVTDKLTIGGSIDAVWTSVNLGLLLDTTQIGALAAQGRLSGGLVPALLGIPQLSGGYLNFNNGKIAGGAASAWGVGGRLGLTYAVNPTTRVGLAYQFKTSVGDLSGRSTLTAVSAVAGNIPLSGTVRLHDFQMPATFTAGISHDFTDRFTVAVDYQRVFWSGAMKDIQVGFTQDGTGQTLKLALPFNYRDINVFSIGGQYRYNESWTFRAGFHYAQEATPDAGLMAILPATPTTNVTAGTSYSFNQNMKVDIALAYAFPKTLTNGSLPDTSVPIKVRHSQIAASLAFTKRF

SEQ ID NO: 1206 - protein, 714 aa, Alteromonadales bacterium TW-7
MKLKLSKLNIAVVSAITLSSFGVSAESNDEVQAMETMVVTASRSQQLLNDVPRSVTVIDQEQLQSQLNQSRSINDVLSTLVPGMGTSVHGNLSSKGQNQIRGRRVLLLIDGVAQNNSFLDFGQELSAIDPQNVERIEVIRGGSAVYGLGAQGGIINVITKMPEEGAVEYRTKVGTSFQEFGSDAFTWNVYQEATGGDEKDQWRLGLGYEQRGGSYDANGDRLPSVNNEDDMDNLNVNGVWNRNIDEDRSLTLTVGVRNITDNDGWCAANGDAANGKPAEAVHCGPGYNNGVAGKDGAKPNDVTRTFANYQARYQDLGFSLGMLDVTGYWMAQDTETFTLAMKDKNPNSPTFGQTLYGHNETDFDRFGVKANISSQIDWAFVTWGMDVEQQSFKQPNSVGFYNNTPDVEQFAIAPFAQFITDVSDNTVLSYGIRYEYVRLSMDDFTVGNTHNNAGDQVQGGDPYFDEFLFNIGVTHDLTDNHQLFASFAQGMSTNEALRDIRSGNSSTVEGAIKPITTDNYEVGVRGFLGEADYSLAAFYSESDLGSTLNVNEAGDALESTRAPEKVWGAEATLGYSILANLRTDSTISWQEGERKLNEDSGWEPLDGTRIAPLKVTSVISYDAYEFGRYNMTLVYSGNRDKEDEITSGAKYAVDSYFVANAGVDYDLPFGTLSFAVENLFNEDYMTAYAQSERNNSRYYNAPGRRFHLNYEVKY

SEQ ID NO: 1207 - protein, 754 aa, Alteromonadales bacterium TW-7
MKTNTDVSKTLASKLSPVALAVAMTVPALSNIAVAQEAEATEEQQFEAITVTATKRPQVIYEVPIAISAFDGDKLAAQGITDLTDVGKFVPNLNVTGFSAGHTSSVNPFIRGIGLQDHLITTDPGVSVYVDGVYLGRQVGQNWSLNNIERIEVLRGPQGTLYGRNSIGGAINIITKEPDQGDVTKVNTEFGTRGRVKADIFVNHGLSETVAFNMNLAFNKRDGLGEFINVPNAEYDVGETEDISGRVSLKWEPSNDFRMVLTADANNGDGGLRPYTVLIDEVGSARYFGGGNGLGVELRNTDVTPEGADIYDNATGTEAVTGVSNEARGLSLTTEWDINDDYTAKVVASQRTSKYKAGLDDDGTVFSLDQFPERGEADQTSIELQLNGYINEYTDFVTGLYYFNEEGSNRQGDDSNFDGGPNLLELDQETTSKAVYVNVRHDLTDELSVSGGIRYTEDEKEASANVFSALGTIFDSNEWDEVTWEFATNYTFDNGMTGYATIQSGYQSGQFPARPYCLIGQFFGAGGFDDIEGAQAAVRANNCFTASDNITATNYEVGIKGRVNDYFDISVAVFNTEFEDLPYQVSRVSEGGFDTANLVVEQTSRGIEADATFSYGNFSMMTSIGYMDVDVEEQDGFNPVAPLTPDLTLAIGPQYTFELDGGDSIRVRADYSYRSEMYGEPTSAPERMTELDSRALVNFDIAYTPANEAYTVALYGRNIFDERYDNARLNTGDYILQILSNDASEFGVRFTTEF

SEQ ID NO: 1208 - protein, 1067 aa, Alteromonadales bacterium TW-7
MFTMTNFAKRGRLSISWRACILLVGLCCPFPVVSSYATDSITEIQQNKTKKFRGNVLDEAGAPVTGATVQIQGKAGGVITDIDGNFTIEVGESDVLQITFIGLETQLVPVRGKASMKIVMKELRDELEEVTVVAFAKQKKESVIGSIQTVKPAELKTPSSNLTTSLAGRMAGVIAYQRSGEPGKDNANFFIRGVTTFGYKKDPLILLDNVEVSSDDLARVQPDDIASFSVLKDATSTALYGARGANGVILVTTKEGKEGKAQVSVRVENSFSAPTKMIDIADPISYMRLNNEAVLTRDPQGVIPYPESKIANTMAPNRNPYVYPTVDWMKEMFKDYTVNQRVNFNVRGGGSVATYYLAGTFSNDTGLLKNDGLNNFNSNISLKKYNILSTFNIHLTKTTEVKVRFQADFDDYRGPVDGGNILFDHAIHASPVDFPKYYLPDLQNQGVGHPLFGNMEGANHINPYAIMTSGYKDYSRTNISAQAEIEQNLDFITEGLTVQGHFSTVRRSYFDVSRSYTPYYYKIGFYDKESDNYVLQALNPDSGTEYLGYSEGPKDVYTQIYMQAKANYVRKFGLHDVGALLVYQRKEELLGNAGSVIKSLPKRNQGISGRMSYGYDSRYFVEFNFGYNGSERFAQNERYGFFPSIGGAWMLSNEAFWRPIEKVANKLKLKVTYGLVGNDAIGSDSDRFFYLSNMNMNSSGRGQVFGTNWGNYKDGISTVRYPNEFITWEVAKKLNIGFELGLFNSLDVQFDYFREDRSKILMDRSFIPTTMGLEASVRANVGEAASHGVDLSVNYNHWFNNKIWLQGYGNFTYATSEFKVADEPDYAAAGLPWRSRVGYSLSQQWGYIAERLFVDEADIANSPVQSFGTYLPGDIKYKDINKDGKISDADLVPIGYPTTPEITYGFGLSMGFKNWDISCFFQGSARSSFFIDSEQIAPFNNPPSTTGSYTRKTALFQAIADSYWSEEHRDIYAFWPRLSTESIKNNTQVSTWWMRDGSFMRLKSLELGYSFPQQMIKKIHLTKLRLYANGTNLLTFSKFKLWDPEMGGLGVGYPNQRVINLGIQVDF

SEQ ID NO: 1209 - protein, 270 aa, Alteromonadales bacterium TW-7
MIKSLNSYPNGYNKAMGFLKVFKHDALGQVGNVVVGNFLITLTILAVCFSSQSAEETTMLTLSYTLFFVLGAFLLVAISVGAIKNLNALFSKRGVLSFSLPVSLESLLLPKILLPMVFFIFSLFWFVASVRLGYSLFNAQSSVLFILHTALKTFVLKPTKTLGIALFLGLVLMKFLFVLSVLNAARIKKARFLLGGLLFILVGVVLELAFNSLLPLMSSSLSINEGFYYFLQQQELQENKYYLLWGVDFLKILLLYGMIRYLLMHKLELD

SEQ ID NO: 1210 - protein, 312 aa, Alteromonadales bacterium TW-7
MKFVKSSLCVALLGGLSFNALAEVDFYGKANVTLQSSDDGEGSFTEIKSNSSRLGLKGSEKISDGLEAVYKFEFQVDVSDADSKGDNDDNISARNQYIGLKGAFGQVVIGRNDTALKQSQGKVDLFSDLEGDIKNAFKGENRMGSSVSYASNSYQGFKLLATFVAEDSDAAGAENGYSMAVTYGDAALKKSAIYAAIAADSEVNGYDVVRASVQGKVADFKLGAMYQTQEKVDGSSEADGYLLSAAYTMASNTFKLQYQAMDFKGSDDKTAISAGVDHQLNKNTKLFGFYSNFDMDNNVDQDYLGVGIEYKF

SEQ ID NO: 1211 - protein, 409 aa, Alteromonadales bacterium TW-7
MTTEGRDMKIGRRLAAAAATLGCMHAHAQTSGSVTLYGTVDTGIIYSTNQQFTRADGSTGGGHAWQMGGGNLVPSRFGFQGAEPLGGGLDAVFSLEQQFLSANGQALQGGTAFSRQAWVGLRQDGIGTLGLGRQYDSYTDMLGAYVSSNNWATPYGSHLGDVDNLNAAFNFNNAVKFTSADFHGLTVGGTFSFGGQAGDFSAKRGYAVAATYTRAPIAFSVGYLDLHQPLDAALGGASGYIGDFACSNPGAMYCLLQDAGSMRAFGAGGSVTLGAATLALTYTHTRLGDSRYFSTDAQPRTQAFTFDIGELNVTYMFTPALQGGVAYIFNAAHTDGRGTTRFHQINVGTNYSLSKRTALYAVAIGQIASGAGLGTDANGNAANYAQIPVLANSNSSRQLAVMAGIRVNF

SEQ ID NO: 1212 - protein, 770 aa, Alteromonadales bacterium TW-7
MKKFKTLTGTALLLSTVAASALVAAPAVAQDNGASEGRDVITVTARRREETLQDVPLSVTAMTGEDLERMGALDIVAIADTTPNITLEVSRGTNSTLSAFIRGVGQQDPVAGFEAGVGIYVDDVYLNRPQGAVLDIYDVDRIEVLRGPQGTLYGRNTIGGAVKYVTRRIDADEPTLSARLGFGSYGQLDTVLSGSAPLSDTFRVGGTLGRFTRDGYGENLNTGEENYDKNVFGYRVSAEWEPTDSFFVRLAYDSVADTSNARGGHRLTPGALSGAPVLDNVHDTRAGLNVVEQDVEGDGLALTAEWEINENWTVRNILADRNDTSVTPIDFDNLPSGDLDVPAIYENEQFSEEFQLLYSGERLNGLVGYYYLDANATTVFDVLLENLGAAISLPGLNAQTFGDVDTKTWSVFANFTYDLTDEFSLTLGGRYTEDERTSTVLRRTYINGFSEFFGGAGIPIATTSDFTGTNSWDDFSPTASLAWQPNAENNFYVTYSQGFKGGGFDPRAQTTGTPDFDQNGTIEADEVFQFMSFDPETVDSIEIGWKYQGNGYRHSLAVFNMDYTDIQVPGSVGIDTDNDGVNDTFTGVTTNAGAATIRGIEYEGSLDLGQDVFAQGDIMTLGWAIGLLDGEYDQFINAFGVDVSNDVVIQNTPDTTASATLTYITPLHGGDLSVINTISHRGDSSQFEFPFPLLDQGAYTLWNASMVWEGEDGHWQFGLHGRNLTDEEYRVSGYDFVNNTTLAPELGLEGTLIGYYGPPRTVTATIAWRY

SEQ ID NO: 1213 - protein, 991 aa, Alteromonadales bacterium TW-7
MNSNILNLRHLTVLLMLCTALLGGTISVFAQQGGKRITGQVIDENKEPMIGVSILIVGTSTGTVTDFDGNYTLNVPQGNKELQFSYIGYETKIVAIPTSSTTLNVQMKSDSQVLSDVVVIGYGTQRKSDLTGSVTNVSSKDFNMGLVSSPEQLINGKISGVQIMSNSGSPTSGSTIRVRGGASLNASNDPLIVLDGVPLEQGGISGNDGNFLSLINPNDIESMTILKDASSTAIYGSRASNGVILITTKKGSSDKLKFTFSTTNSVQTRTKLADMMSYDEFVNTIQSKGTDAQQALLGTAHTDWNDEIYQNAFGTDNNLSVAGKIAKNLPFRASVGYYNQSGLLRTDNAERYTGSITLNPSFFKDHLKLNINAKGSINKNTFANTGAIWAAATMNPTIPVYSGADNFGGYTEAIDNTGAPVNGAVMNPVGLLKMNDSHSTVKRFIGNIDADYRLHFFPDLKLHATLGYDYAQGKGSVYVPAEAAQNYTTSGLDYTYGPQKKVNRLLTLYANYNKLVESIKSSFDVTAGYDYQYWKSTTPLYYETNTLGEIQKTSKATDDRHVLLSYYGRLNYSFDSRYMLTTTVRRDATSRFAKNVRWGTFPSVALGWRMTEESFLKDNKILSTLKLRASYGVTGQQDGIGNYNYLPVYNISQSGASSLIGGSPIHTYRPEAYVPDLKWETTTSWNAGFDFGFLQDRITGSFDYYTRQTKDLIATVPAAAGTTFDRNITTNVGNVDSEGIEFSINATPIQTKDWNWDLSFNMTWQKMKVKNLSLAAGTQATNTSVGPYIDSYQLQVLSEGYAPYMFYVYHQLYDEKTGKPVEGAYVDLDGNGEINTNDLYRYHSPAPDYILGFSTSLRYKKWTLSTSLRANIGNYVYNAMAMNAGAWETVSYNSYQLNNLSRSYLETGFKSRQYLSDYYVENASFLKMDNLSLGYNFGEIYKGCSLNVSAMVQNVFCITKYSGVDPEVPNGVDNSFYPRPRTFSLNIGLNF

SEQ ID NO: 1214 - protein, 150 aa, Alteromonadales bacterium TW-7
MSTVPVVQGAGSSNSAQDISTSSVPLTLQGRISNLLSSTAFKVGLVVMGLLLVMATIFLVSAASFVNPIYLAIPAIVGCVNICVGILSMEGYCSPERWSLCKKVLKASEDIIDDGQINNSNKVFTDERLNAIGGVVESLSRRNSLVDQTQ

SEQ ID NO: 1215 - protein, 233 aa, Alteromonadales bacterium TW-7
MSNRLFASLIACTSFTLMAPFAQAQSGDFYVGARVAGEFERLKDVKGHFGDDDVKLGSSDRENHLLGALALGYYLTPEWRVEAELGLSGSQTYRFKRQMMGEALDLKTHVSSQRLMFNVYRDIPLGDKFSLYGSVGLGLTASRMKADFTQTSADEEPQHGSFGRRSQTLFTASLGVGASYALTKDMSVDLGYRYIRMATAKTGALAEEGAEPGAHLHARPEAHEVSLGVRYRF

SEQ ID NO: 1216 - protein, 415 aa, Alteromonadales bacterium TW-7
MKLQATRALIAVVAAAPTFAWATNGYFSNGYGVASQGMAGVGIGFPQDALAAAANPAGIAFVGNRIDGGISLFLPDRGANVSGNGYGANGDYDGNNRSIFVLPEFGVTYQFLPNAYAGLALYANGGLDTGYAHNPYQAFGATGSAGVDLEQMFLSPTIAYKLLDRHAFGIGLNVAFQRFTASGLQPFTGMSVAPGNVTDQGADTTVGVGVHLGYTGEITPTLTVGVTWASKIHGRFDKYKGLFADGGSFDIPENYGLGFSWKVTPAWTVAADFQRIMYGNVNSIANPLANLFAGNALGSSDGPGFGWRNTNVIKIGTSYDVSSHLTLRAGYSHSSQPVASTETFLNILAPGVVQDQATLGATWKPDAKTSFGLFYGHAFRNTVNGDNSIPAAFGGGNANVHLSEDVVGVSLGKQF

SEQ ID NO: 1217 - protein, 832 aa, Alteromonadales bacterium TW-7
MTSKAPTTEPFRFLFHTENSKAISVGMFRGGHPVHFSCLTFCLYIATMSAAKTQESSANEATLQDVVVTGIATPDTDKQAFSKQQATQRQFVPSSSTIITKQQLDAAQVRNVLDAQRLQPGLRIRFTNVRNLSINIRGFGASSSSATDGIFNGVPVYIDGILQPRVGQALFDVPDLDGIEVLKGPQATSGGMDNTGGVVNLTTTLPSFATHASAEVSYGRYNWAQFKGSLTGAVGDSTTTAFRLAAFGSDRDGYVSNYNGGQKLNDFHDKGMRGQILWQPTEDLTARFIVDYAQISQACCGQIYNGGIAYYVNGQPIPNNFYNRAARIGLTPPPANALSSYMTDNFGYQNTSQESYGAAAIVDYNLPDGYHFNSVTSFRGWDFHPHNFGDAIYVGLPTDLTTRNNSHVTERSVQQEFKISTPKGQPVEGTAGLFYLYEQLYNWGLSAYGSQAGLWYGKPTDSAAVNNTLNYTARESYDNPTTHYIAPYAQATWHVDPEFDLTAGLRYSYVYKTTLYRQWQNAWDTSYLSPADQAASQAARNTLLGSPRQFTASTHQGLISALASASYKFAPDVMGYVTFARSGRPGGPNPANLPVGAPTTVKEEEVENYEVGLKSQFFDQRLLVNVAAFYMNNHNYITNVTSLVGSSFSTYLANAQRAVSRGVELDVRAQPFEGLNTYASMIYDNAYYASFDNGPCPFERSNQTSCNFTGQPLSLVPRWAVAFGGEYSHHLGLVEPFTKPLIGYVGADFNWQSSVFSNTTNSIYSVIGAYGLLNVHGGVKFEDSSWDLSVWGQNVLNKHYFITLSETNLGTGIAAGNVGLPMTVGFTLRWQM

SEQ ID NO: 1218 - protein, 979 aa, Alteromonadales bacterium TW-7
MASQEVSIKQNVSIILKSDTKVLGEVMVVAYGTAKKESFTGSASVINNKKLELRPISNVTKGLEGQTTGLLTTSGSGQPGEAAKIVIRGYGSINASQDPLYVVDGIPFSGDMSSINPADIESMTVLKDASAGALYGARGANGVIMITTKQGKEGKTKVSWRSTAGWSSRSLKAYDMVDQKEFVQLTYEGLRNGYIFDNGYNWEAAGRQASADLGGVLGGEQYNPFKNYTWGTIIDPATGRVQGDATSAWNESWMDAIQRDNAFRHEHQLSVNGGTEKTKYMFSLGYLNEDGILINTGFQRYNARANINTEVNKWMKTGLNVSLSNSTQNFSDYEGSSNSNVWYSAQFMAPIYPVYIKGEDGKDVLDADGNRQLDYGDGSVQRPQYSDFNPVGGLVDDKADIKTDVAGLRTFLAFGSDSEDAGWAKGIKLTLNFGLDYRNKSQKSYMNMHHGNQAAAGGLLMKYNRRTQSYTFNQLLTWGRSFNFHNIDLLVGHEFYAYKYEFLSAGKTNLVDGILELRPGTNLYNADSYSEDYRVESFFGRFNYNFNEKYYFSASIRTDGSSRFQKDNRWGTFWSVGANWRISQEKFMQNLTWISNLSAKISYGEQGNDNLLRYDSLEGGYVPDYYPWQGLYPLEYPNANQVGGLIGALENKKLSWEKSGNLNVGIEASMFDGRLNVSAEYYNRKTTDMLLGYPKATSSGFSEYNANIGSMRNTGFEFSLGGSLIKTTDFIWNLTWMGSTVTNKVLKLTGESPEIIKGVFSIKEGMPINTYYMAKSAGVDPATGAQLYWVYDKDDNGNITNEYISSDYQKAANSKYYSGSRIPDLYGSINTDFSYKNFDLSILGTYSIGGKVYDSLYAGSMEVMYAGNTWNKHALRRWQQPGDITDVPRIQIGGSYTASDRFLVDASYFAIKNITLGYTIPKQWLKKAGLESVRIFGSVDNLALFSHLDGMDPQYNFKGETDYSYAPNKTYSVGFEINF

SEQ ID NO: 1219 - protein, 1047 aa, Alteromonadales bacterium TW-7
MKNKLNLLLIMALFVLAYSSGYAQEKTVTGTVTDPAKLSIPGVNVIVKGTNRSTSTDFDGKYTISAAPGETLVFSFVGFVKQEIKIGAAPSYNISMEAESANLSEVVVIGYGTQKKKLTSGAISGIKTESFTERPISRIDQGLIGQVAGVRVKQTTGLPGQPFSIEIRGAGSITAGNEPLYVIDGFPIYTEGSNSNGGFSNGSPLDNMNPNDVASIEVLKDASAAAIYGSRASNGVVIITTKKGKKGKPKFTFNTYGGVNKEVNRVDMLTAEGWISRAKTMIDSQWVGSGIAGASASQTTAERIAAYNAVNPTAPLTTANSRYYTYLHDDRWDMPGHPGLDYIDWQDKVFRTGEFSNYQLTASGATDAVNYYVSANYQKNTGYIVGTDYSLFSARANIDIKLSENFKMGINLAPSYSIKNDPGVEGKDNTLFKALTATPVFESAANAAGEKYTTRYAWGSSTTNMLNALARTGRNSMYRNLISGYASYQFAKSFTLKSTINFDNSDNVNESYTPNDVIASIRGAYNTYRRQNIVNENTLTYDKTFGNHSFNLLLGESFNAYEITKSTMSSGALYNSSSIETLPAGSIGSTTAEKNTLLSYFSRIQYNFKEKYILAASIRRDGSSKFGTDRRWGTFSSLSLGWRVKQEAFLQNVDWLTELKLRASTGINGSNNIGSYAQYATLGTYNYSIGGAVAIGQGAASIPNPSLHWEESKSIDFGLDFGIIKNRLTGTFELYRKNNSELLLRVPVPGDSGFQTYLTNIGEVQNQGWEFELNSLNVKTQSFEWRTSANISHNENKVLALGPNQSKIEISNAYDGGVPFVKLEVGKPMYTIFGLQQNGVITQADIDAGGTTIGGNKLVLGDPRYVDQNGDKKINSEDRVDLGNPTPKYTWGITNNFKYKDFDLSVLVQGQNGGTVYGLTGRAIDRTGMGSVENSLNVDPAVRGNWRTSFGYQANSDWLYKSDYVSVRSISIGYNLRQALKGISRIDNARLYVTGENWFYWNKYKVGFNPEAVNTSASSNSDFSVPVDYGGAPLAKSLVIGLNINFN

SEQ ID NO: 1220 - protein, 2522 aa, Alteromonadales bacterium TW-7
MFNNIFTKCSLPLLFLASPLQAAPSISLSSSRMVNRSPKVAIEQQKTLQQLEGAGAFASFSAQPRIQQKAEAAPEEVNVLAFLEQNGLLQSSDVVAATNSGNLDSEFNKSLSDVFYCNPANYEFSDCKIASINRQTPATSPTNADTLTWRFLFDLAVTGVDAADFNIGGTTATITGITQNTSTDYSITISGGDLASFNGTASISLKPAGQYDIRLVYPGLTPPDDLMVPGVRGINNNSYVVSNNVAPTDISLTSTSVNQSGGINAVVGTLSSTDADVGDSHTYTLVSGAGDTNNASFNISGSSLRVNNAALLTAGTYNVRVRTADNASATYEEAFTITVVDNVPPAVTSITLSGSPANTATSVDFVVAFDTSANNISIDDFQLTSTGGAAGTISAVSASSGTSVNVTVNGISGNGTLRLDLKSSTNISDSIGNAGPAAYTSGSVHNVAIPTAPTVPTIGTATAGDGQVSVTFTAPSNNGGSAITTYTATANPGVAFGTCAGPAACTATVTGLDNGTAYTFTVTATNGVGTSVASGASNSAIPKGNQTITFTQPSAQNFGTTPTLTATADSATGTDNLTVSFSSSTTGVCTISSGGNLAFVTAGSCTIDADQAGDSATNPAPTVSRTFTVNAVVPSASTVGTATAGDTQATVTFSAPVSTGGSPILAGGYTVTASPNGATGTGSSSPITVTGLTNGVAYTFTVTATNSAGTGAASAASNSVTPASPQTITFANLGAQNFGTSPNLSAISTSGLTVSFSSSTTGVCTVSGSTLTFVTAGTCTINAEQAGNSSYLAAATVSRTFTVNPVVPSAPTIGTATAGDTQASVAFVAPVNTGGTSLTGYTVSVSPPDVAPVNGASSPILVTGLTNGQAYTFTVTADNSAGTGAASAASNSVTPAASQSITFSNPGAQNFGTSPTLAATSDSGLIPTFTSSTPSVCTITSGGALAFVAVGSCTINADQAGNGSYLAATQVSRSFSVNAVVPGAPTIGSATAGNSQATVSFSAPTFTGGAVITGYTLVSSPGGITASGASSPITITGLTNGTSYSFTVAAINSVGTGSASVASNVVKPNGAPIITSTAITSATQDAAYSYTLVASDSDVGDSVTLSAVTLPSWLSFNAGTGVLSGTPSNASVGSHAVVLRVTDVDGLTAEQSFTIVVANVNDAPTISSTALTSATQDAAYSYTLVASDSDAGDSVTLSAVTLPSWLNFNAATGVLSGTPSNVNVSSHAVVLRATDVGGLTAEQSFSIVVANVNDAPTITSTALPSASQDSAYSYTMVASDSDVGDSVTLSAVTLPSWLNFNAATGVLSGTPNNTNVGNHAVVLRATDVDGLSAEQSFTIVVANVNDAPTITSTALTSASQDAAYSYTLVVTDSDVGDSVILSAVTLPSWLNFNAGTGVLSGTPSNANVGSHAVVLRATDVDGLTAEQSFTIVVANVNDAPVATNQVVTLEEDSSAMITLVGEDADNDPLTYEITAQPVSGTLEQHGNVWLYTPEKDFNGSDSIGFIAKDAEQSSEPATITITVMPVNDDPQAADDSYTLTSATNDTYLLAVLANDVDVDGDTLTIDGAVADIGSVQITSDGLSFTAPKAYVGPVGLRYTISDGNKGRATAKVNVLIEGTDSENQPVITLPDDVEVNATGLFTRVKLGFAKAVDRNGHPLPVSLVNKSLFFAPGSYLAYWQAVDRDGNKAIKAQKVKVNPLISLSKDQVVGEGNQVTVSVHLNGEAPSYPLSIPYTVSGTADSSDHDLVDGVVEITSGQMAEIHFNTLNDSVSEGNEEVLISLDPSLNLGSKQQTQVMITEVNIAPLASLAVTQAGQQQVIVAQNGGDVHIRATASDANEQDTLTLTWESGALSLQADGAGMFFSPAAVQAGIYPVSLTVTDDGSPVMSSTATVYIVVRPSLAALTNEDTDGDLIPDAQEGYRDSDSDGIPDYLDANSDCNVMPEGELQPVYFLAEGQAGVCLRLGNIALSRGQSGVQLQPEAVTEDKAAANVGGIFDFVATGLPQPGQSYSLVLPQRAPIPANAVYRKLSAQAGWRDFVIDANNSVASTEGERGFCPPPGDSSWTAGLTEGHWCVQLTIEDGGPNDDDGVANRTIVDPSGVAVMLNGNSLPVANPDSATIAWNQSIDVNVLANDTDSDGDSLTVTQVISEFGTVTALANQQLSYTPAADFIGTDVLVYSITDGKGGTASSELTIVVNGNTAPVTVNDSAATDDRTSLLIDVLSNDTDVDGNPLTLLSATAQQGAVAIESNKLRYIPKTGFDGVDTVTYRISDGLGGEATGQLLITVKAYQEVIIDNKSGGGSMGLWALVFVLSCALMRRQALQRGAVGCLLLVSVTQQAQATDWYIEGFIGQAKADKTRPDLNVQVGEGEILKLVDTGNAFGVSLGYQWTPTVALELGYADFGEGCARIKGATLTPEQYHELVKAVTPVLADGVMLGLRFTLLQHEGWRFEVPVGLFHWQADISSTMGNTTITTDLDGTDWYTGVRFSYQFSDAWSVGVGYQYIDIEPNDLLSYQLNLRYRF

SEQ ID NO: 1221 - protein, 674 aa, Alteromonadales bacterium TW-7
MKYWLKKSSWLLAGSLLSTPLAMANEFSASFKGTDIQEFINIVGRNLEKTIIVDPSVRGKVDVRSFDTLNEEQYYSFFLSVLEVYGFAVVEMDNGVLKVIKSKDAKTSAIPVLSGEERANGDEVITQVVAVKNVSVRELSPLLRQLIDNAGAGNVVHYDPANIILITGRAAVVNRLAEIIRRVDQAGDKEIEVVELNNASAAEMVRIVEALNKTTDAQNTPEFLKPKFVADERTNSILISGDPKVRERLKRLIKQLDVEMAAKGNNRVVYLKYAKAEDLVEVLKGVSENLQAEKGTGQPTTSKRNEVMIAAHADTNSLVLTAPQDIMNAMLEVIGQLDIRRAQVLIEALIVEMAEGDGINLGVQWGSLESGSVIQYGNTGASIGNVMIGLEEAKDTTQTKAVYDTNNNFLRNETTTTKGDYTKLASALSSIQGAAVSIAMGDWTALINAVSNDSSSNILSSPSITVMDNGEASFIVGEEVPVITGSTAGSNNDNPFQTVDRKEVGIKLKVVPQINEGNSVQLNIEQEVSNVLGANGAVDVRFAKRQLNTSVMVQDGQMLVLGGLIDERALESESKVPLLGDIPLLGQLFRSTSSQVEKKNLMVFIKPTIIRDGVTADGITQRKYNYIRAEQLFRAEKGLRLLDDASVPVLPKFGDDRRHSPEIQAFIEQMEAKQ

SEQ ID NO: 1222 - protein, 785 aa, Alteromonadales bacterium TW-7
MKFSKHALVASSLALVFGVNLCADEVYTIQNKTLKEALEIISKKSNLSYIANDEILERKYINNIENIEGTQQALDKILEGTGLKAVIQNEAIVIVKEKVEGKGTVLEAISVNDSYKRGSVESGYLVEETSDIGPWKGKSLQDTPLAINVMTSELFENLQATSTDQIYNINPTIQMGRNQSQNNNGYAMLRGFSSSTAAFDGIKRERGQFTHNTNPEEYEKLETITGLSGFLYGSASIGGIMNYIPKRPTSKPEHSITVGNGGGKNGYYSHVDLGGPLTENGKLGYRLNAVSQDNDTHVEHQSVERKLVNLALDYRVTDNLLIQGTVSDSDYRLDGRQPYWYLAKGAKRPSASSIDSNKLWGQKWTYNDGEVRRYSTNVLWNINDNIAFRSAYMNEKITRDGIFSSNTIQADGTYTQVTTNSAGADQDFYGYGAYAFVDFDFDTASINHQLTMGMQTSDSYRNTLNTNDTNSKITLTGLNFDSPVYVSSPVVSPIVSKTTKSLHSTSKNFTIGDSIQLNPQWALIVGATHVQLKYQDTDYKKSELTPSVSLIYKPIENLSLYTSYMEGLELGGIAADTYGGYNVVNARKAMDPLMSEQIEVGAKLTLGDTLLTVAIFEIDKGLEYYDVTDITKPTYVQDGRQVHKGIEFTATGKITDNLTAITGITLLDPKTKENKNNPLLEGKRPQDVADKFAKLYLEYSPFDTMDLAFNSGINYTGSFYGDNLNTDKIPSYTLVDFGARYTTKATTYPLTFRVNVNNAFDRDYWINSNYLGDKRTIHASVQMKF

SEQ ID NO: 1223 - protein, 1078 aa, Alteromonadales bacterium TW-7
MKLRKKMLCMVKQVKKITIFACLVCVVYPVAGIQAAVGEQQSVAQTLKKIKGKVIDVLGEPLIGVNVSVVGQTGGTITDIDGNYSLDVPAGAKLKFSYIGYEDQIIDAGVKAVLNVTMKESTEVLEEVVVVGYGAQKKETLTGAVTVVSDKMLKDKGALSNPAQALQGQVPGVIITRNSAAPGDESWNMKLRGSFSKNNSAPLVIIDGVESDDFSQLNPGDIESINFLKDASAAIYGSKAAGGVVLVQTKKAKEGKVKVEYSGSVTAKFVGLQPTLMTLDEWCDAMEQARLNDNKKLADDQWLQYVALARQNKGHYINVEQSGNPFPDSFQGLYDFVFFDTDWQDIMWGTAASTSHELSVSGGNERSVFRLSGRYMYDDSNLKWGNNKNQRYNFRLSNTFHLTKNFDLESIIFYYRQDQVSPTQIGEALTAGTQQPGFPSSTMDGKPYAWGNWATPNWRCELGGDNKLNTSGINISETFKYRFDEHFDAVATLGYNTSTAIRDVKNQTVDYYDYTGTKRETRVEPRQEDTYYIKTTARTNLYTLNFYLNWKRTFGSHNLGMMLGTQYSMKEYDYTATKALNILPSLNIINGIGEITLRNTKNEGPSRYQEALLSYFARLNYNYKSKYLLEGNFRYDGSSKFQPENRWAFFGGVSGGWRISEEEFVKGLGVFDDLKLRLSYGTVGNQGGIDRYDGVQLYDFKQNGGALVGSGLLSYVDTNGKLLSTDRTWEVIKNYNIGLDFGFLDNRLTGTAELFWKKCNNMLIDVTYPGTLGDKAPTANRGSFKANGWEGTINWSDKIGEISYHLGGTFTYTTNKLVDNGGDAVIKSGVVSNREGYPLNSVFGLKYCGKIQTQDQLDKYINQYANGNNNIAMPGNLRLGDNMYEDVNKDGKLTEADYVYLGTDDPKVSFSFNAGLSWKGFDVSVIFQGAGKRTVWRGGENNQKGKNDNWRIPMMSWYNNSTNQSVGNVWSAETPNAHYPTYTHQTQINLYNYICSSWSVEDGAYLRLKNVTLGYTFPANVLSKTKFISYARIYVSGADLWENSKIKDGWDPEASRKVETFGRYPFTRNLTVGLNLTF

SEQ ID NO: 1224 - protein, 941 aa, Alteromonadales bacterium TW-7
MKQRVLALAIKRMVWAELALTAALVPPAFAQSQPAPGAASIADAVANGASMTVAQADGAAGAVAATGASASGAAAEATPAASGANGQGKVAQIKRFEVTGSLIRQADKVGFNQVQTVTSKDIENSGQTSVADYLRSTSANSASSWSEGSTNSFAPGGAGIALRGLSEKYTLVLIDGMRVSPYAFAVNGSDQFFDLNTLPLNIIDRIEIVKTGAVSQYGSDAIAGVVNIITKKNFQGLELGGSYGGATNGEGGQGTTKFSILGGFGDLNADRFNVTAALSYYKSNGISIADRDTTQNQNFSNFPGGLSNQSVSYWRNPATGAKVPLSPCPNGGQAVPGTSVAQVNGPGTVCANNTAYASSLSPWTERLSAKVHADFKINDAMQAFADLWESNNTTVTNNFVGRLGNSTQTYDPATGGLTPISNLVPGSNPYNPFGVPAKLVYAFPATQAVHTSSNFWRAATGVKGSFSTPRVGDWDWTASYTHSQNTVSNNYSNLINAAALENVVQNGVFNFADPSSTPNGLNGLYGSTSTQAITKLDAVDATLSTPNLFTLPTGNVGLGLGTQFTHQSQYIGTGADYANGTLIQPSLQSVNGERNVAAVYYQIDIPILKNLTFSQSGRYDHYSDFGGAFSPRFALRFQPIRELTMYGSYNRGFRAPTLIENTSSRTYGAQGAVDSNDPNNPNAYNLVEEVQTGNSKLQPERTKNYNIGFQLSPTRNTDFGFDWYKIHIDNVIGTEDIQTVIDQNDPSKVIRNPNGTIAYVLLPYMNLSSLDTDGFETTFRQSVSTKIGTFTLSGDWAYVWHFKMPVGGESTDFAGNNGSLNEPFGGSFPRWKGNTSLNWNYHNQWNATLTWMFTGPYSQAILSPGQYPNMQDSVASYSQFNLMVSYTGFKHWTIYAGIDNIFNRAPPFDPVYMNASYQTGYDTSLYTYVGRFAQVGATYKF

SEQ ID NO: 1225 - protein, 288 aa, Alteromonadales bacterium TW-7
MNPIYKLLLSSAALATLSSTAIAADYSDGLHKNDYKWMQFNIMYSINEKPSIADNLDHDYLELEFGGRSGIVDLYGYVDVFNLANSDSSDSDKTDGASKIFMKLSPRFSLDAMTGKDLSFGPVQEVYIATLFNWGGGGITGVDGDGNSISGDVNNSFWGLGSDVMVPWFGKVGMNLYGLYDLNIKDWNGYQFSMNWFKPFVTFDDNSFIAYQGYVDYQFGADANDAVFVPTTAHGGVMFNGIYWHSDRYSLGYGMKIYNDVYTVKDGAGVLELESTGFSHYFAAIYKF

SEQ ID NO: 1226 - protein, 727 aa, Alteromonadales bacterium TW-7
MQKFFVAGRPAFVRGPRRTPSLLSAGLLASVGLTLSTLSTSGWAQVAASDAGTTLPAVSVSAAKDTTVAQADTISAGALGSRKQVDTPFSTHVVTSDEAQDLFATTANDLYKYDPAVSVISDNGVSENSMFTVRGMPIDTLNSVKVDGQTFPSWDTDLSLEPFEQVELLKGLSGFMYGFGSPGGIVNYVLKRPTDTPYRSISVGYKSAGVFSEAVDLGGRFGNDDRFGYRLNLANENGNTAEDHGHVRRQVASLAFDFRITPDLTWSADAFYQKRRTNGTLFGLMFGGDAGGIPDASKVTHALTQPQNYYETEMASFGTGLDYRISENWHASIKYRFAKENRTNSDSFLFVTDPAGNYSNTLYAALTRYFYQNVDGMVQGHFNTGTIKHDVVVGAGFLTQTSEYSNSTGWNEGYFLGNGNLYASTLLTNDEVSISSNLYRQQRTTQAAVYASDTVQLTSRLAALVGVRYTQYQQHVYDPSGAVSSQYQADPVTPTFALMFKTDPYSTLYVSYVESLEQGGAASNTNLNYPDTFGPLRSKQYEVGFKTDHAKWGANLALFRVDQGYNYTNVDNIFVQDGTKRYQGLDASGWLAVTSEWRVLGGVMWLDTKAMDVNDPTVEGKRIYGAPRFTVTGRIEYNPSYLRPLTLAFGGKYVGNQAVDAQNTQFVPAYTTFDLSGRYETKIAGKDVTFRAGINNLFNRRYWTTAWGYYVAPSATRTAVASATLQF

SEQ ID NO: 1227 - protein, 729 aa, Alteromonadales bacterium TW-7
MTKSSKKFIAPQLLFMLLMAAVPLPAFSMEASGPETVVTAPAEKKVQSLSSKRLKSSDTAELLSGEPGVAFATGGGVSSLPVVRGQADDRVLIYVDCMCLTSACANHMNPPLSYIAAANVSGIGVSAGVTPVSYGGDNIGGIIHVDSDQPLFANPGEQVTAGGSVSSYYRSNNRAIGGAFSGTVANSNLSFGVTGAIDHASNYKDGHGNTVTSTYYESRNLGATLALRGDSSLLTLKAGHQFIPDQGFVNQWMDMLENNASFINLHYKSDFAWGKLDATAYWQNTWHRMNSGEDKLPINLRIPVTMPDMPMATRGIDTGYSLKTDIPFAEKNILRLGNEFHRFSLNDWWPPISTTLGTMGPDTFLNINDGSRDRYAFFAEWESKWNSKVTTIFGVRNEQVRMDAGDVQGYNAQNMAGMIVTNYKRDSEAFNAEDHARSDSNWDVTALARYEITPTGTVEVGYARKTRSPNLYERYAWSTMWMASGMVNWFGDGNGYVGNLDLSPEVAHTLSISADWHDSERKSWELRVTPYYTYVNDYIGVQVYNTQTWTWPGGSETRKILKFVNQDARIYGLDISGKLALWENSALGSGQLRGSLGYVHGTDPNTGSSLYHMMPLNGHLTLEQNVKGWSNAVELQLVGRKSETDPLRFEPETAGFALVNLRTSYKWNNLQIDLGVTNLFDKFYYLPLGGINYDNFLDSKLPPTTKRAADFEPLAGQGRSFNVGLTQTF

SEQ ID NO: 1228 - protein, 810 aa, Alteromonadales bacterium TW-7
MAVSSRSSFLSLSRNPSRTPVLRPSLLAVAVQAAVIGLASPGAWAQTQTQTQTHVQTADDEARLMAQAPTKALAQVDVVDAAEPVQRTPGASTTVSGPALEQAGSMADVVRYQPLVSAPGTASGTSRNRSSFDRSGTTGYNIRGIEGNRIGMDVDGVEMPDATTRPYVSRVGANTFGVGRDFIDPEMFSAVDILSGTTTARRAAGGIGGSVGFRTKSAEDYLVGGKTSYLGGKIGHDTADRSWNESFTAAGRSGDLDGLIAYSRRDGHETRNHSAIVNSYPDDWNSNALLLKGGLRINPAHRLVLSADLYRRKNDTSFHGWDTTNTSITESSRQNSDTSRNTLQLQHLWTPAGAWVDQLDTRLYFQNTDTNDVTDTTTLATGAKVHNVSGNETRTWGFSSTGDKRIDRHRLSFGVNASTQDTERPWNVFATGTPVMKPQPDTTTRRYGAFLQDEISFQAGGRRLALIPALRVDRVEIKTRDLDNFVSGVLTAADVEKIYGGTRGNTILSPSLALVYDLTPTFSAYAQFKRSGRVPSAGEIFGSWNMASNYNAAGQYALVGNPNLKEESSNAFDFGLKGSPTPGVTFNSSVFYTRYSDFIAYTRYLRAGRPDLFVNVPAHIGTIYQAENRDSAKIYGFEASARLDHGQWMPAARGLYSTWALGISRGTSKSYYAGDKDVPLDSVLPRKAIVGVGYDAPARQWGLNLTGTFVAGKQAVATNRDSYLNAGTGLTDSTTELFRVPGYAIFDLAGYWQVAKNVRLNAGIYNLGDKRYWDYSSTRSLQPGVARDRRDIELLSNPGRTFAVSMNVAF

SEQ ID NO: 1229 - protein, 699 aa, Alteromonadales bacterium TW-7
MKISFNRTTRWCVSSFVTLLLSPTISYAEDAELKPVENITVIGNRQAYQGDFTVLETPQAELVISEEVLKSAGVVDLVQALDLSASVARQNNFGGLWNSFAIRGFVGDENLPSNYLVNGFNAGRGFGGPRDLSGIESVEVLKGPRAALFGRGEPGGTINLVTKRPTFERDGEIVLSAGSFNTYRTDVDWTSPVSDMVAVRLVGFYEDAESYRDTVETSKYGLNPSVAILFSDQTKLNYELEYTQQEIPFDRGVVAMNNELGVIPESRFLGEPSYGPIETGVLGHQLEFQRNLNDDWTALVGFNYRATSLEGLASENGFAVPAEDGTFARFSRSRDYDAVYQVFRAELNGSFNTGNIVHRVIVGVDADTFENDQYSLRDRSTDQSINIFNPVYGQSPADELELADNIDRVETQESSGLFIQDQISLTDNLDVRVGVRIDDYQQKLVNRLNDGVSEYSKTQASPQFGVVYKSSEVLSFYVVYGENFRPLSGATDENGLEPNLSESTELGLKFALNDGDLQGNIAIFDVKQSNIATLDADYNPTAVGEAGSQGIEFDLTGSLTDSLSVWVSYAYTETETKNDFTDAVGWASIPAGSDLLNVPDHQLSTQLVQKTELAGKPVKLIAGVLYVGDRSGEFGNPAFNLPSYTTARVAAQYEISEQIEFSFEINNLFDKSYYANSYGPTWVMPGAPRNFRLSTRFRF

SEQ ID NO: 1230 - protein, 789 aa, Alteromonadales bacterium TW-7
MTKLTLISSAIFSVLCSHSALAATVNGKVTDEKNQPIENATIHVHGKSQSVKTNKLGEFAIELDASGQLHISKDNYSDSRITVTESSNNIAIALKPTSIETVVVFASALHKSSLEMISPVNVLSGDELRNKSKPTLGETLKGLPGVNASYFGPVSSSPIIRGLDGPRVKIMQNGLDSSDASRIGPDHATSSDSLAAEQIEVLRGPSTLLYGSGAIGGVVNVVDNRIPTSNIDELTGAVEYSHDSVSNANTYAAKLETGYNNFNFHFDGTKRSGDDYQTPRFNQLHEDGDVESKDSVENTFIDSETVNFGTSYVGEHLTVGFSYGKIKTDYGIPGHEHDHGHEHDHAADGDAHSDEAHEETPVFAQLEQDRWQGLLSYALHNNWIETINLRLGYTDYLHSEIENGEIGTTFKNKTTEARLNIEHKLADWHGMVGYHYSDSDYDANGEEAFTPASVTTTNALYLLEEREFGDVTIELGARVEDYKIKSQIAAHQHSHDDTQTSNAEVLAYTKSFTNLSASMGAIWQYTPGYSMAMSLSHSERAPLSAELLSNGLHIATGTYELGLGYHIEDGEAHFEPENIKQETSTNIDLGFRRFSGDFGYSVNFFYNDIKNFYFQENTGLVFDEEHGLEAADNGHDHGVAVYQFTSKDAELYGLEFDAHYKVNASTLVKVFGDSTRAKLKQDDENLPRIPANKLGSELQYTLGNNWQFALTGTHYFSQTDITAYETKTDGYTLFDAQANYQLDLGNLDTQLYINVDNITDELGFVHSSFIKDTAPLPGRNFRFGIRGYF

SEQ ID NO: 1231 - protein, 578 aa, Alteromonadales bacterium TW-7
MFKTFLAASTAMTLALAAPAHAQNATSNIIFMMDESGSMSGEQDFLTQFVLDLDASLAVGGFGTRNYGLMGFAAGSTNPGLIREFTIGGNQIGNATDLSAATLNLTTPGGTEDGYAAIDYVLKNYTIPAGNTTLVLITDEDRDDTTSGNVLYADVLNAIQTAGANLVAMVDIGIRDANGDAAISTDGTTTLIQTGTTFASTAHGNFVGGYGTTEADYADLALATKGGCVADLNQLRLGGDAAAAFALAFQTCVINAATDAGTKFILTTDIFRNSSMTVAQNIRAQIRILALVKSYLGTGGFYSTQGNAIVNDMLGIEGLRGYAFATASSGSASGGTDLSGKGLTIGADYTFQTQQYLFRTGIALSGLNSSSDASGFDSDSDTKTASLYGLYQTSGGLQLYGDITAGRTDHDYTMMFPTGTASGSTESDYRSASLELGQRFAIGGQASNILMPYIGVSRELLEIDSFTASNGAIIPGYDQTTTFGKLGMRWEKTTAMSFGALHTDVDFSWNHVMNEDIDVNSGGTVTATPGGTDENRFDLALNFGLDTKGGGRVIMTLAGSKSENVRMGTVGLGYEMKF

SEQ ID NO: 1232 - protein, 281 aa, Alteromonadales bacterium TW-7
MSLKSLSTVFLAATTLLGVQQANADVNATLWGIYSNNIKFSPKTVENAYLELEYYGQTGPIDWYGYFDAPKYFGGNDNIKGVWDKDGSKLFAENQPKVSFNRLTGKDLSVGPFKDWFFATDWIVDAGGHSNNSQNTLYYGLGTSIDTHTKLGMNVNVFAKQQWENYGAPNSYTSDDGGRLQVQFFYPLYSFNNGASLNYFTFTNYDFGSKLGDKDPNRTNEALVSTHVFSYNMKHLRLFTAARYFHNGGQFKDGAIANWGNGDFVQNSNGWGYYVAAGYQF

SEQ ID NO: 1233 - protein, 767 aa, Alteromonadales bacterium TW-7
MNHNIKGLSMNNVSYNRNFKTGNDQRINHRSFVLNDVASAQMALRLGYALGTVFVLCASNTYAAVIDNSTKTLEQQQAAQTNVAALPAITVKAEQDDIYAGGQVATSSNVGFLGSKKFLDTPFNTISYTDKYIEDKQAKDITEVIAATDPSIYTNGASGGWSENYYIRGYASSTNDMSMNGLFGITPFYRTSPEMFSHVEVLKGPSALLNGMPPAGSVGGTVNLVTKYAADEPFARLTTTYMSDAQFGGHVDVGRRFGENKEFGVRINGMYRDGDAAVNDQSKESRLFSLGLDWQGERARVFVDAYDALDHVDGVTRGVNVSTAVGIPKPPKADTLLSPDWGSVETKDKGAMIRGEYDFSDQLMAYAAYGQSTTQYKYNGASAGTITSSTGTLSSMLGQLAFEVDKKSADAGFKGKFETGPVKHQWVANATYYNHAQDDYGYRIIPGFGDPVFTNIYDPNPNWGPKPEFTPPFLFHSTLSTSSFGLADTLSFAQDKVQLTLGLRHQTVKATSSVNTLPENAKSATTPGVALLIKATDKISVYANYIEGLTKGDQAPATTSNKGTIFPPQKTKQQELGLKVDLGTFAHTLSAFEITKPNSYSDPSQLVNNLPTFVSDGEQRNRGIEWSFFGSPIEHVRLMGGFTYLDPELTKTKSGGNDGHTAVAVPKNQAKLGAEWDTQVAQGTLTLSGNINAVSKQYINAENTLSVPGRTLLDVGARYSTKVENHPVTFRANIYNLTNKAYWAQPQLTNLALGAPRTYMLSVSYDF

SEQ ID NO: 1234 - protein, 159 aa, Alteromonadales bacterium TW-7
MGTEAVHIAYNLETGIGDFNFKFDLTHVLDFKEQANASAEMIDYAGLVTQPDWRGNLATSWKYDDFSAAWTVVYIGSQSADYYNKLEKTTRYVDYSDYFKHNIQFAYNHAYNGSITVGVNNLFDADAPNYYTYADYRDVDVGLYDVLGRTYYLRINQKF

SEQ ID NO: 1235 - protein, 357 aa, Alteromonadales bacterium TW-7
MNRTCLVGLLVISVSGAASAQSSVTLYGSLDSGVAYVNNSGGHALFKANQSNMQPDRWGITGAEDLGGGLRSVFRLENGFFTNTGAFVNPGTEFNRRAYVGLDSDRLGTLTLGHQSALSFDFLTPFANAYAGNSWNMFHPGNVDGLANSATSVIDNAVKYRSPSYGGVSVAGLFGFGNTTNFGHGNTWSAALTYDHGPLQVAAFYQRQHNQAFALAPLALGTFQGQTAASYVADRAEFWGAGGAYTLGPVKLHALYTRVKLESKQHADIYQAYDSGAEWSVTPFTTLTAGANTTTLDAHRWTQVGLGCLYALSKQTQLYLQGIVEHTNPGGFAALSVAGISSTNNQVMVLTGIHHSF

SEQ ID NO: 1236 - protein, 954 aa, Alteromonadales bacterium TW-7
MLNNKLTKAVRLAIAYGAASTAVFATNTFAAEEGAEAVERIEVTGSRIKRTDMESASPVQITSQEEIALSGFTRIEDMMNSLPQIEASETAFQANGASGTATLDLRGLGSNRTLVLINGRRMQAGGVNSQAPDINQIPASLVKRVEVLTGGGSSTYGADAVAGVVNFVMNDDFEGFEISVGGSAYQHNNDNKYIQGLMDKKGFEYPKGNSGLDGSSLDLDITLGGDFDGGKGHAVGYITYKKQNELRQAARDYSSCALDGPGTSCGGSGNAVVPNFYIGGLDANGGFNWDDYEYWTLDSGSDAFKPSVGNSYNYAPINHFMRPDERFTFGTFLNYEINDHFRPYMEMMFMRDRTTAQIAESGTFFNDQYDIPVNTPLLSDTQRQQLMDRFGLGIDDTFSTYIGKRNTEGGPRASSIEHNAFRLVVGTEGEINDNWTYDFSMQYGSTSSSEAYLNDFFGPRIKTALSANDESCAATAGCIPYEVFTYQGISQESAKALTGVAVKNGVTEQIVIGGYVTGELDLTVPSADAPIAVVLGSEYREENYERITDEVYAQGLLLGQGGATKSLTGGYDLTEFYGEASIPLVSGAPMVEQLTMELGYRYSDYSTTGGVDTYKVAFDWTPMDDYKVRASYNRAVRAPNVAELFSEQSKGLWGGNDPCAGASPQLKQEECARTGVSAAQYGNVSKSPANQYNGLFGGNPDLQPEVADTMSFGIVAQPIDNLNFSIDYWDIELEEVIGSVGPELTVTQCALTGNSAFCDNITRSGNGSLWIGTGIVKATSVNLASRHWEGVDVSANYNAEIMGGNFNAKLIGTYMLSKEYEPLPGTPTANYDCVDNISTDCFATPEWRHTATFSYDTGSFWTAQLKWRYFGSVGYDGTTDKLLEADGGISSQSYFDLKGSFEVNDHVGVLVGVNNIFDKEPPLVGGTLSTNANAVSGFYDSLGRYVHASVTFRF

SEQ ID NO: 1237 - protein, 562 aa, Marine gamma proteobacterium HTCC2143
MALHRLAFIFLCLPLMASAAPFTSPGDRDLIRDRQQRLLDEQRKRLEELQQLPGKGAPAAADASGGDERCFEIRRIELEGAGHLGESARRQLLAPYQGRCLGVGQLNALLKAVTDHYLDRGYVTTRAYLPQQDLASGTLRIIVVEGRLEGLDSSALASPRELTMSFPGRTGELLDLRELEQLVDQLSRLPSRQAQLELVPGSEVGGSRVRLKGERDKPWRVSATRNNDGDVSTGEQQMGLGLDWDSPLGLADQLNLRANRDAVTDRWRHSDSQSLFYSLPWGWWTFTYGYSQSDYRTRNEASGFPFKLDGDSRSHQFRAERVLHRDGVSKTAMSLGLSHQRTNNYVEDTRLEDQSTRITETQLGFNHGRRIGSGFVNLDLGWQQGIGALGAQGRGHPQAGDPNARYDKYSLTLSYLQPFQLWGERFSFDSLATGQRSEDVLFSPQRISLGGNSSVRGFKDQTLTGDSGGYWRNQLRWRRAVEWAPLRPWLQEYGVAFAYDVGVIRHDRYNDGASGRMSGNAIELDARGRYFAASVGFARSLERPSAIERREHPIYFRVDAFF

SEQ ID NO: 1238 - protein, 594 aa, Marine gamma proteobacterium HTCC2143
MAVAIALAASPAMADSAFDQTVFFGDSLTDSGYYNPLLPAASRAVTGKFTTNPGWVWAEYVGDHFGTNAAPNGNGQTGDNYAAGGARIQASSVSALGAAPSVTSQVNTYLVANGGQANPNALYTVWGGANDLLAAATAPAQAQAIIGSAVTAQVGAVGALQAAGARYVMVPTIPDVGITPRFRAGGAAAMAQGTAAATAYNTALFNGLQSAGLRVIPVDTFHILQEVVADPGIYGFSNVTGTACNPALALPACNPTSLVAANAPNTYVFADGIHPTTATHQILGQYAISLLEAPRLQQVLTRSAQAGGRARADQVAWHLDGKPEADGLRWWGSVRGDIQRYDDADLYDGMAPAGLFGVDWTAGDLVFGGFAGFGRMDADFGNRNGSFKQDDTTLGGFVGWYTGPVWVNAQVSYSWLSYDVDREVQLGPATRVHSGSPDGSNLTAAVNAGYSLGEGNVKYGPVVGLTWQKLKLDGYTESNASSTALGYADQDIDSLVGRIGFQVRLDGAPVKPYLQATYDHEFKDGTEASAWLQSMPEVGMYTVPGQNFDRNYATVVLGARTGIWGLQSNIGLSTTTAQRSARDATVFVNFSGNF

SEQ ID NO: 1239 - protein, 627 aa, Marine gamma proteobacterium HTCC2143
MEHVMSKSFQPTRLVGAIAIAMGCSPVIFAEDATNATQLDPIVITASKSAEKASEVPARISVISKEEIEKNPVLNLSDVLQKDASIYIKQSGGVGQLTDLSLRGGQTGSTLLLKNGARLNTQNGLGPVSPEFINLSDVDQIEILKGPASVQYGSDAISGVVQLISNNPTKSGASLTGVYGENRTYKTLVNADYVDDSGFYASIGGQRMETDGTSIINIQDKSEKAAFDQKGYNAKIGYSNDVINTSLAIDQNQGTNNYTTNYSTNNAKRNFENRLVNWLASYKASSDLVLNARYSHYLDKIEQIIYQSHFNTTSDEGDINAKWNFVPNQNILAGVTYNRSKYDASSSPEAVRDISSTGYYLQHQYNDNGIHTQVGVRVEDNDWFGTHTVGQAAIRYQISPLTSIYTNIGTAFKAPTLEHLYGSYGYDFYSNPDLKPEESKSYEIGIDQKFNYGISAYLSGYYTDVKNLISYGAINGRTTYINLNKADMKGGEIGLKWSKDNIFVNAEYAYVEARDKDKDIDVPYRPRQTYTLTAGYDDGIYGVNASLVSRSKANAQNIENSVKVPGYATVDLNAFWNMNPNIKLFTNIQNIGDVRYNTAYNAQSSFSPEYWYINGGRQASVGVTFRY

SEQ ID NO: 1240 - protein, 305 aa, Marine gamma proteobacterium HTCC2143
MYAALMCSSINAYAGDKNDALTVYGRANIGLLYSDIADQDDTEVKSYSSRFGLKGRQSLDNNLEVFYQFEWGVDLAGFDEDNSISDRNQIVGLRSDFGTVMLGRYDTFLKDSQGAVDQFKDYTADLKYLFKGEVRADNSLTYYSPAYKGFKLGFTYVFSDEDSVDDGQSFGLIYGDEKLKKSNVYAALAFDNEVAGFDIVQFSFATKVNDFKLGFAAQDYQSVDGIISAQGVLVSAAKRYGAWVPKVQYQVIKDDERDHSISIGSDYYLGDNTRLFAFYTARNRDIQQQITEDYLSIGVRHDFSW

SEQ ID NO: 1241 - protein, 964 aa, Marine gamma proteobacterium HTCC2143
MNNTSDKIFGKSMLNFAVVCAMGLVPSYALAQQTNQEPSGSDAETEVIQVRGIRASAAENLAIKRLSNAVVDAITAEDIGKFPDKNVADSLQRVPGVVIQRNGGEGSSVSIRGLSPSLTFTQLNGNFIAASSGNPSRSFSYELLPSNLVGKVELFKSSEARLDEGGIGGTVIVHSRKPLDMDKNSGVVSLEYTYADITDSYEPQLSGIYSWKTDEEDFGFLVGFTQQDRTNRTQTSRVNIINQNFLYTERRNGQEIEGGAQGYARQSLVQEVLEEDRERTGVQFTAQWRPTDNLEVGFNYFQFKLGLDSVLHQLEYPEWHDTNQFWTDVYVDAEAQYVTGIDYARGVSGEALDTQIPRMNGEYVVEESTSDTFDFFMEYEGGDFNVKFVAGHTEAEGGPTEKYRAAYYSGSTADYWGWRFENENLVTNIDPEMFNRLKAGEGGEADIGATDSSFVGGTQEEDYAQIDTDWFVDWGIVETLRFGVKYRKGSIHRDTRNTYYLAKDFDIAAGEARPGGITLDDDYSRNGGIPLLTTVIADQPLGNLGGSINTNLFPVVNWNKYQNELETNFQRYTRFEPDFVYDVEEEVKVAYVQADYRWENFRGNFGVRFVDTVNTNTASDRLEFRLDRVNLDGDDVAQVNGIVRDVIVNPKENSYSHVLPSFNIAWDINDDWVLRGAAAKVLSRPDYADLGQFQTLTYNSSEWEADSSDRPDYDPLRDSEGWTGSGGNSSLRPLESVQYDLSLEYYYGEGSGVSLAVFLKNIDNFVVPFTLDVNSSVPDQTFTLVESGGGTVNVGGDILVRDFDTAANGTDAESKGVEFSFQHFFENGFGVSGNYTRNITSAATVEADGRLVGESPLTGSSKYQGNFSAFYENDDYSLRVSYNRRGPTIGVLAEDWDINRYSDTYDQVDVNASYNINEDITLSASVINLTKSEDYVHLGDDTKVRFLTNSYSGRRFFAGVNYRF

SEQ ID NO: 1242 - protein, 704 aa, Marine gamma proteobacterium HTCC2143
MNVKKIHFPLSAVALAVATTTVFSVQAEEYSSEEKMVVVSNRMPKAISDIPGTVWYIDSQTIEQEYRGGKSLDEILAATIPSLDVSSGGRTHSGQNLRGRSLMVMIDGVSLQSVRSLSRQLDSIDPFNIERIEVLSGATSIYGAGSAGGVINIITKKASGEEVELESFVSGTSGFSSSEDFDYKLAQSIAGGNEKVQGRASVAYTKTRGYFDANGTMVTPDITQGSTQFNETIDLLGNLQINIAEDQQLNLLAQYYDSQQDTPYGLYFEKDGNGNFQFVDVREGYSADRQQGTERVMLSAAYSNNNFFTQQLIAELSYRTEDHTFMPYTEDGKSKLATNSSRQSTDIFAMKVALSKSFDSWNLTYGIDGFIDKFDSDKAIYDQATTEASGGLVHVISEMQGRYPGIDTQSIASFMQVDYSITQDWSLQAGYRFQRMDVDVSDFQAISRSDFIPGGSTDYTEGLLNLGTIYHVNPTSQVWANFSQGFDIPQLYRYYGKSATQDVDASKLDGIKTDSYEIGYRNDLDAISLQSALYYSHSSATVQYEDDLSISGLAEPKRVYGAEAQLSYWATDMLQLGVLGHYVVTETETKTGWEDHKAMEASTSKAGAWVGWFDNDYSLKLQSLTMFDYKDADQRKLDGFTVVDFTGNYQLPIGNLGFGVKNLLNEDYYTTWSQRAQYWYRGSDALYQYKGRGRTFTLNYQVTF

SEQ ID NO: 1243 - protein, 814 aa, Marine gamma proteobacterium HTCC2143
MTKSTLGLAVIAAIPMFSSVHVLAADEAANSIEKIQVTGSRINRTDMETASPITVIGDDFIAKSGFTSVADILSTQPSAAGISLGASSNNGSGGSATVNLRGMGSQRTLVLLNGRRMVSSGTGADSSVDLNTIPVAMIKSIEILKDGASAVYGSDAIAGVVNIITKKDFEGTELNVEGSRTTKGDGNNYGTSLLHGMQVADGNLVVGAQFSSRGEVIQSDRSFVPAGQSSFIPQGTLGGKTYEGNGEFADRTTSYDFTTSSYAQTPNDLYSLFTSFDKELDADTTFNVDLMYTRRDSSQQLAPQPASVDLLTANLDNEYTNAFIVDGELTDSLEYRRRMVDAGPRIYEQTTDTYRASVALQGVLDNDASWDVSATYGRNDSKDKVQNSINASQVEQSIYANQAIWFSGDALSRDFLTANDSIYTESNEGGNEQFILSAGYSALTDNDIGYAIGIENRFESGFYTPDLITQLGQSTAAQQDPTEGDYSVQSIYFETSMPVLEVVTLEGAARYDNYSTFGGETTWKLGATWDVTDSFMVRSVLATGFRAPNVAELFGGNSGSYDYLADPWGNEQDAQILVNYTSDADLQAEESRSFTFGMVWEVVDGLSTTLDYWKFDITNAITRLDVQNEMNNCFAGDTQSCDSVNITPAGDLSNLSSALTNVGSQKTSGIDWNIGYTADNYRINLDTTYLVEFEQDDIDYTGTIDGNIGGYSKIKSNLSVNYDLSDAFSMLYNARFIRGMSGDYYGESFSTYNVVYHDISMTYNLNESLKVTGGMNNIFDKEPEEVLGGNDMGTVPEIYDVIGSRVFASINYKF

SEQ ID NO: 1244 - protein, 361 aa, Marine gamma proteobacterium HTCC2143
MKKQYKPALKLAAIAATLFSGAAMAQSSVTLYGMADAFIGGVKNPGSGDRAYVVNSGGMQTSYWGIKGTEDLGMGTKAIFDLNGFFRPDTGSMGRFTGDSMFSRNAFVGLTNETYGTLKIGRNTTPYFVSTILFNPLVDSYTFSPMIFHTYFPTPQNVGGVSDPGILGDSGWNNSLLYSTPNFGGLTANFIYGFGESPGNNGKNKWGGNLTYFSGNFAATLAFQQVKFDVAPFDPQNANLAGLDKQSAVQAGVTYDFKIVKAFLQGQYIKTNFNTSTNGGDIKHIDGQAGVAVPVGAGNILASYTYGRVLNEVAGIKRNTFAVAYDYNLSKRTDVYGAYYYDKVSGVEHGDTFGVGVRHRF

SEQ ID NO: 1245 - protein, 732 aa, Marine gamma proteobacterium HTCC2143
MLFKQKRISLCIGILFGSAFISAGVRAQIAPPPDYGQRIGDVVVSASRSGTELKDMTQNTSIITNEDIQNSPSMTIDQVLKNQSSVFLNDQPYYEKDPTGQSLNVRGLGNARTLALIDGLPANDAMYGTIQWNLVPLSAIEDVELIRGGVSNLYGNYGMGGLVNITTKPITDNKGEISASYGSYNTSTVAASKEVAINEVLKLRVSADYFNTDGYVNQPTISPATTYPKKNAYGQSAPLLPGMGPESANSANYRLQGALKLSSDTDVFFNVGSHNMQNLPTGGYNFATKTTNETTFSAGATTRLSAVQKVQVNAFYENTTLWQQNVSNSGTSAPYISANYNDPYSTTGASAQYTHDLKDQAIQQFVVSVDGRQVAAQNLTNSFSSAAGYTNGVVTSSDYAKGQQEFYGVMAQMKAKTDVIPLQATLSLREDQWQSQTPTYWIAGANGKPSYTNVPNQTVNKFSPNLGLLLQATKELDFRGAAYQGFHAPGLNNTLRTYGNSTSVSLANPLLTPENMTGYELGTDYRWNAGFVQITGFSAQVKNAVYAPNVSQAQAYSAGCPLSVCTGANGQTYTLYGNNQNLQSQGLEVQAHHDINAQWLVDGTYTHTNTVLTWIGSGVSSTLNPIGSQVGGVPQNMGYAGLTYMPVPYANLTANIRYIGNSWLDGAHTLPVPSYAVVGLKANLQLTPQASLFASIVNMFNRTYITYGTGTSQGSYIAGQPQSITVGARIIF

SEQ ID NO: 1246 - protein, 751 aa, Marine gamma proteobacterium HTCC2143
MKYRGEFLTGIIAILVGLLMAVPVFAADADTAPEAKSMEKMQVTSTRTQKKADLAPASVSVITKEDMEVMQINTIDEALRYEKGVYLDRPGGLGDALPATTMRGLPGDERSLVMVDGIPVNDPYSSLVPYNMIDPNAISQIEVVLGPGSALFGGNAVGGSVNLITKDPKELEAGGRLGCGTYNNQKAGAWVGDKVGERFTYRITMDWEAQEGYPTQLVTKTTKAGAATGISGGNEINYSVIAGTDQVAKRWVVGDKGDKNSERYGGTLRTTWKTTDTGKLTFMFMGGSHTYEYDAPHSYISDGSNFVFSGVAEAGSGQVTSKVNPKDFLAGKGSREYYAPSLKYEETVGNVDITAKLAWQKRNSWYTSLTGASSSETFYSAKGRYVASVDNEYLAEIQGDYEFEWMRKHVLTAGLYYKQGTFEQETTRLRYYQDEDSTWGGVVDLTEGDTTFLAPFLQVEWSLHDKVTLYTGARIDWWWAKNGKSGDPKDLAILEDKDKSAVSPRVSMVWEPVKDSTYVRASVAQAFKPPTIYDLFRTWYGSTGTLYKSNPDLDPETMWNYEVGVDQYLLNRKIKLGGTFIFSQIQDLITNYYEAPKVAKKTNVGKVDIIGFEADARVYPTDWMQFFVNYGRYESEIKEYELDKTVEGHSLLEFPRDLVKLGTDFRFWKFQYSIFGQYFGKTYWEDDNSYTDEETYMGYYPHWEWDTKLTFNATDKVHASVAVNNVFDEGEYWGGSVKAGQTVYGEIRFEM

SEQ ID NO: 1247 - protein, 364 aa, Marine gamma proteobacterium HTCC2143
MHKIKLKKLQLVMALGSAIALPAMAQSSVQVTGVVDTYLGSMKQSGDAGRTSSVNGGGMTTSWFGFKGTEDLGGGLKATFNLTSYIRSDIGAIGRFNGNETFFSRDANVGLRGKFGAISLGRDLSPNFLPSVISNPFGDSFQFSPLILHKDVPLFNASGWTNSVAGDTGWSNEIMYTTPDIGGLKASINYQFGEVAGKSGKNNVGGNLLYFNGPLALTAYYQKVQVNNPMDLSPNNVQPATNIPFASGMTAARQTAWFVGGAYDFSIAKLFASYNQSTHDIDLKDKTFQLGTSIPLGQGAILASWANTKRDGVAVGTELKRNTASFGYDYNLSKRTDIYSIYMYDKITQQSAGNSFAVGIRHRF

SEQ ID NO: 1248 - protein, 355 aa, Marine gamma proteobacterium HTCC2143
MKISRIAVASLGLFATTAFAQSSVTLYGVADAGIEYLSNVPSASPGGSNQVRMTSGNMSTSRWGLRGVEDLGGGLKAIFELESGISFDTGAQNNSTRLFDRSAFVGLGSKYGQLTLGRQTTPMYDTTLQLDPMGFAPRYSLFKMDDVLAGRADNAIKYRGIFSGLTVTGLYSFSRTGGGEVPGNYKVDRNMGVSLMYETGALAVGAVYDEIQGSTVATADRKDRRALIGASYAFGPAKAFIGYRWYNGNVGALPTNGSNIYWAGLRYGLTPALTLTGAAYYTDSRNSGADPFLFVASADYAFSKRTDVYMNVGYALNRGNSQLGMNGYNSTTGSPTNVVPGKDQTGVVVGVRHKF

SEQ ID NO: 1249 - protein, 679 aa, Marine gamma proteobacterium HTCC2143
MNKQLTLIASSLVAALSPSVYASNDVSQFDEVVVSASRVDETNQDKTRTVAKVSSEELDEMQVNSVAEAVKFIPNVSVVGGNVASNQSVNIRGLEGNKVLQIIDGNRQNVQFDHRPSFFLDPSLISDIEVVKGPVSSLYGSGAIGGVVIQNTITADDLVEDTGFGGKIKTGYQSNGNVVTTVGAIANKQDNVDWLLAGSYQDSGVMEQGNGYKLYGTEAINKTGLAKFNWHFTDSQSIGLDYRISDYDGHPPVVDSTEPLSTEDKLIDRTSSDQNITLKYAYNPESNLIDSAFRVYRNDTDIKELGNGNTEKDISSITTKGFSVTNKSDLDRFQVFIGADGYEDKLDTKRPVTTSGRPTPPDGAKATTLGGFAHVNYSLLESLELDAGLRYDTFESKAEGFENNKQDAWSPSVGANWQATDWMAWSLRYDEAFRAASTSELFMDGTHFAMGPITNVFVPNPNLKPEQAHNIELKGTFNFDNLIGDDELLITASVFQNKVKDFINLDVTVPSRSEMIACMMANRGSGVGCGGTSTSDNIDNAKLKGFEVVAQYRYDRLNTLLSYGQTRGKDENTGEWLSNIPADKWVAQVDYGIWEIDTKVGTRAIFASTQDRRPKDDNEGPYKSYELVDFYASWEPTSNMEGLTVDFTVANAFDENYRTPWTQVYEPGRSYKISAEYKF

SEQ ID NO: 1250 - protein, 336 aa, Marine gamma proteobacterium HTCC2143
MKLKSLSLSVLAALSLGVATSAMAADATTSTTAPAQTAPSYDQSGFWVGGALGMGYVSNSDISKFPGSANGEAPSVKLDAGYDFNQYFGIYGSYDYMHDLGNADMHLATLGVKGNLPLTQKLSAFGKLGATYIYADNKNFANNTLHMKSDSFSPTAGLGLSYQITHALSTQIGADYYQDLRTSHGHADLTQAYWGMTYKFGQPATPMVVTNNVEVVKEVAVEAQVPTRSSYVLPYQNGQTKLNDYGRYNLGEVIATMQANPEVNAQIIGRADKVGSAKINEKVSAERAANVANYLEANGIDASRLTVSSVGYNNPLKTDTSTKTNYVQRSVQIILK

SEQ ID NO: 1251 - protein, 793 aa, Marine gamma proteobacterium HTCC2143
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 1252 - protein, 783 aa, Marine gamma proteobacterium HTCC2143
MRFKHIAHARALALSASALTLCLGAQAHAQEAAQEQAAEETGGISEIVVTAQKVAENVQDVPIAITALTAERLENAGTTSLEGLTQLVPSVTFRKGTTSANSAIVMRGVGTITFSVAAEPSVSTVVDGVVLSRSGQAFMDLVDAERLEVLRGPQGTLFGKNASAGLVNIVSKGGTDTLQAEGRAEWYEGDEYRLRASVSGPLADGLTARVTGFYGSYDGNITNIYGGKNEKINGYEHYGARGIIDYDNGGSKFRLIADYFKANDDCCADVTTVSRGTALDKELGLPGGVAQGLEQRYVNHNLVTQTKDRQWSLTASGDFDVFESHTLSVVAGYRNWKNEEIREGDFLPRALVGTDQLHDNGEVRTEQLSLEVRLASDQTKPFFYQVGAFAWGSNNQQDFTRSDVKCATSTLPVDPLTGAQPCNLNDTVNTIFPTATSFSDVKSRNYAVFGQATYRFSDLISLTGGLRYTWDDLSFTHTRAPGVNATDGLPATGAGINDNPAGGKISAGGNGTNTSRGSSNNGNLSGRAVLQITPSDDVMLYGSYTRGYKGPAFNVFFNHTAPTNAVPIDEETSDAFEIGLKSQFLDNRVQFNAAAFTVTYNGFQANNFVLLNGAVVSNLTNAGSVRSKGFEADLLTVPVDGLTLRASAAYADAKVLKFNPNPSTNAPDARNGTRLPLAPKFTWTLGGSYERDLGGFKVYLDSDFRHVGKQFSDLGESGPIAAYGIWNAGLGFSDAEDLYRLTFHVRNITDKSYALLNVSSGQRLQIPRDADRYFGVSLRAKIR

SEQ ID NO: 1253 - protein, 837 aa, Marine gamma proteobacterium HTCC2143
MTLLPDSGLIPVRLRFMQLLIVCGSGALPLELIQAADLVNFQSGFLRQGQGYDIDAANKALNNLAEVEDLAPGNHWVEIHINTRYFGQRELRFDADPQGNGLLPCLSKELLEQMGVRIESLAEQTLLQASCVDLSRLIPQATTKLDGGRLQLSISIPQIAMRLDAIGRVDPALWDYGINAAFVSYQASAQQTTRTDTGTGNSANLYLNSGINLGAWRLRSNQSVRHDEEGRREWTRAYAYAQRDLPGTHANLTIGETSTDSNVFRSVPIKGALIKTDQEMLPDTAQGYAPVIRGVAQSRAKLEVLQNGYPIYSTYVSAGPYEIDDLAATGSGELEVVLTEADGQVRRFSQPYATIGNLLREGVWKYSTALGRYNGASAIEQPWIWQSTLAIGTGWNATLYGGLMASDMYRATALGISRDLGALGAVALDATQSDADIDRAGTTSVQGMSYALKYGKMFTTNTNLRFAGYRYSTQGYRDFDETMRQRDNNRPFTGSRRSRLEASVHQKVGSRSSVSLTMSRQNYWGSAAEQQQYQFNFNTQHAGVTYNLYASQSLTDTRNQKNDRQLGLSISLPLDIGHSSSAAFDLQNSGDHYSQRASLSGSLDDNRLNYRTSLSNDDGRQQSAGLAVGYQAPFASFGAGLTQGNDYRSTSINVSGALLMHAGGIEPGPSLGDTIALIEVPDTPGVGVQNAIGVETNSRGYALVPYLRPYRYNHIELQTDQLGPEIEIDNGSARVVPARGAVVKTTFAARTVTRLVITALTDSGKPLPFGAQVSDAEGNIMGIAGQGGLILLSTGMQAQTLDVSWGEQTESRCRLHIDPTNMPLTKGYRIQSLTCSQ

SEQ ID NO: 1254 - protein, 315 aa, Marine gamma proteobacterium HTCC2143
MHLTDNNVLVAKNGSYIAETKSNTPETSETTTQSPAAPTTPTTEAPKVEQPSENAGSETTASTSAQPTDATAPTNGQTETSSASANHNKITITTAEQETQRTIAESRYATLVSNFAQFSETYKTQTYGMALYGAYETEERHYFDVAVRMAKASSELKSNASQTYHHNLYSASLAYSKGFELSNRWEIEPYTQLFYTHLSSTNYIRNGLNVTADEINSLVGSVGTKAEYQLNQILNFYTKVAMHREFNATQDINIIRSATDRVQHNINHRGTWTTLGLGMKARLGNNTHLYLDVDKLFGNGYKQSYQINLGLDWKF

SEQ ID NO: 1255 - protein, 52 aa, Marine gamma proteobacterium HTCC2143
ADIDVSRNWFVSIDIRKLYLKTDASGYLGPQEAKAKVTLDPLITSIAIGRQF

SEQ ID NO: 1256 - protein, 1577 aa, Marine gamma proteobacterium HTCC2143
MKSKNFKLSPSGRLAASLAIIFVSLNAYGNGIVPDAGHQGPDVSAVNGGTQVINIVTPNNEGISHNQYQDFNVGKPGAVFNNALEAGQSQLAGHLNANSNLNGQAASLILNEVVSRNPSFLLGQQEVFGIAAEYVLSNPNGITCDGCGFINTSRSSLVVGNPLFENGQLKGYSTLNNTNLLSLGKNGLNTTGLLDLIAPRIDSRGKITAAEISAFTGQNTFSQHFDILSSQKPVSALDSYFFGSMQSGRIRIINTAEGSGVKLAGKFTADNDLSVKADNIQTDSQVRYDSYDKDGSENYQNYRGGITVNNSGSSQTLTKTELKGKNITLVASSHNQIKASDLMGDDITLQGADLTIDGKQLQQKETDIDNRWFYSWKYDVTKEKEQIQQIGSQIDAKNNATLTATKGDVTLDAAKINAGNNLAINANKDIHINGLVEKESRSENGNKRNHTSRLESGSWSNSHQTETLKASELTAGKDLGLDAQGSITAQGAKLHANENVLVNAKDNINLNVQKTNNDKTVTDNHVMWGGIGGGQNKNNNNQQQVSHATQLTADGQLLLAADNNVNITGSQVKGNQGAFVKTTQGDVVIDNALSETISKIDERTGTAFNITKSSHKNETNKQTSTGSELISDAQLTVVSGNDVNVIGSLIKSADKLGIHSLGDINVKSAQQVTKIDDEKTSLAITGHAKEVEDKQYSAGFHITHTTNKNTSTETEQANSTISGANVDLQANKDVTFAGSDLKTTAGNASITGDNVAFVSTENKKQTDNTDTTISGGFSYTGGVDKVGSKADFQYDKQHTQTEVTKNRGSQTEVAGDLTITANKDLLHEGASHHVEGRYQESGENIQHLAVNDSETSKTDSLNVGIDVGVNLDYSGVTKPVKKAIEDGVNTTKPGNNTDLTKKVTARDAIANLANLSNLETPNVGVEVGIKGGGSQQSQTDSQAVSTSINAGKIDIDSNNKLHDQGTHYQSTQEGISLTANTHTSEATLDKHQTTFHETKGGGQIGVSTKTGSDITVAIKGEGQTTDNALMETKAKGSQFTSNGDISINVGENAHYEGAQFDAQKGKTVINAGGDLTLAQATDTHSESQSNVNGSANLKVGTTPESKDYGGGFNAGTTHHSKEQTTAKVGTITGSQGIELNAGHNLTLQGTHLSSEQDIALNATNKVDLQSASSEHTEKGNNLSGGVQAGFGKKMTDDASSVNGLGSAQFAIGKQDEKSVSREGGTINNSGNLTINGNSVHLQGAQVNSKDTQLTSQSGDIEITSAQSTDYKNNWGTDIGFNGKKTNNTPKEVTEEKPATSIHNIGGKLLVNVEDQQKTSHQNATLETGTLTINSNKDLTLSGANVTADSVTGNVGGSLNIASQKESDRHVTVGVNVGYNHTNDPKSSQVNKTAKAGGSLLEKTIKDTIDSGIKSSTDAISDKYNSLSSTIADKTGISDETKAKIDQGFGKVGNGIKNIVTGAEGHTANADIKVTHVDNDAVTKTTSLTSNNDLSLNVNGSTKLTGAEIVSQQGQVDLGGSSVKLENIEGHHYEAGADLDLKSSVVDLAKQLVGGDISFKSPVKTNETVNTKASISEK

SEQ ID NO: 1257 - protein, 751 aa, Marine gamma proteobacterium HTCC2143
MIARHRSPAGIVSASRWWGTPQLLAWSLACACMPAVADEAGDADAAPERTAQTLGAVTVTATRRETTLQQVPVAVSVVQGETLERENRNNVADLPALVPSLTFRTGASNKDTSLFLRGVGTISTSPGVEPSVATVIDGVVLGRPGQATLDLLDVERIEVLRGPQGTLFGKNASAGVLNIVSKPAPEVFGGYVDYSHFGGGDEDRLRASVGGTLVPELLKASVSALWAEYGGNVRNVADGQTVNGYRRAGARLRLDLSPNPGLNATLLADYLQSHSDAPSGVVVDSTRADFAAALAPVIARDDNRQINSDYRTHLEDTNKGASLQLDQQLGDAVLTSISAWRQWDNTQFQDGDRTAQRSATFPSSHDRGDLGYTQYSQEVRIETPRDRAVEAVAGLYYLHARSDETYQRTVTSPTASNVGVADYDTRAETYAAFGEATWHWRPDLRALLGARFTRDTLDYQHQRVSTSASAVTGIQPATASSGSTAENGVSGRAGLQYDVDARTTGYLTYSRGYKGPAYNVFFNMQPRDTPALKPETSNAWELGLKARALDDRLSANVALFHTEYANYQANFFDTVAGQVVTRLINAGQVRTQGVELDLEYRPTERLSLAASLAYTQARIQRFACPAAAAANCNVDGKPLPFSPDWKGNLRAAYRVPLRGSLALEFNGDVSWQDSVQYDLSQTAQTIQGPYAIWNASIALADDLHGWRVAVLGRNLGDRAYAPLLANATGNVYRLVPRDDQRYVGLQVHKDF

SEQ ID NO: 1258 - protein, 406 aa, Marine gamma proteobacterium HTCC2143
MPSYDEKIPVPNGLITGLFKKFAKNDYVYGSKHSIPQGYTDCTYDSVCYKQNFKDNLALLLRKTDYKHHSYNLALNLDPTDWLRVQLKYANGFRAPTSDEIYMTFKHPQFSIQPNTDLKAETSKTKEVAFTFYKNSSYITLNAFQNDYRNFIDLVEVGPRPIEEGSTIAYPFHQNQNRDRARVRGIEIASRLEMGDLFEKLQGFHLGYKFTYQKGRIKDNGLNPKYKEFLDLNKDKHPEYEAIARKPQPMNALQPTTSVYNIGYDAPSQKWGMDVYITNVAAKKAKDSFNSQWTSMVERKEKLYTDTPTDKAASKANGKEVKDSRGLWRNNRYTVIDTIAYWKPIKNLTFTAGVYNLTNKKYLTWDSARSIRHLGTINRVKTETGEGLNRFYAPGRNYRMSVQFEF

SEQ ID NO: 1259 - protein, 1024 aa, Marine gamma proteobacterium HTCC2143
MSYKNLKTWALASSLLAGLGAVSAPALAQEEGADAQQDIIQVTGTRIQRGNMTEATPVNTFNSEQFELSGAVNTAELLRTLPAVGVSSLTSTNSNFTVASSGVNTIELRNLTEDRTLVLMNGRRFVAGLPGTNNVDFNSIPTELIDRVDVVTGGASAVYGSDALAGVVNVILKDDFEGVVASTQAGISDEGDDETYRASLTMGSMFDQGRGNAVVSTTWSRENGVYARDREGLDRDGLSRAYFDPTVENWQEDVIPYYSSYSERGRILIPGLSAGGTPTNAANLVFDETTGQVRPFTSANPDGSALDGFNRQAYRAIAVPTERFTFSSLVNYEVNEKMNFFFEGTYASTETTSSLEPFALASDDVFGDNAAQFVDVDGDGVYDRSTNGISILNPYVPLAMRQAARDAADFDGDGIQDVADEDLVVGFVRRMTEVGQRASANTRQTARIVFGLEGDLTDNWSYEVSANLGRTTQSQRSSGQVNVLNLRQALNATTLNGEIVCADEIARAQGCVPVNIFGKGSISPEAAAYINAPSSRQAEITQQVYSGFLSGDLGFASPFAEENVQVVVGAEYRSEESESVPDALSQSGLNGGNVSPAVYGDFQVAELFAEAEIPLVQGRQYVEDLRLNLSARASDYTTVGQTFAWAANVQYTPIDMLRFRAQYSESVRAPNIGELFQPPSETFEGADDVCAGLTLSGSDPAFFNAADDATSGVDSSTVNSSLAQACFADPSVAARVDRDGFYIPTQGEIQGIAGFNGGNPNLSEETATSITLGAVFSPEFGNQWIDNFALSVDYYNIEIEDAIAGIARQTSVNQCYDNGTGAYNANSVFCSNIVRYNSGPSIGAIKELNALQQNLATIETAGIDVQASYFLGLNDVFTNSSWGLGDLNFTLTYGYLEKWEQQAFPGAEVIDYSDTAGLFEHEVLFSTVYRNGPLTVAYDMNWMPETRLEATGDLSEAMVPSATFQDVQVRWAFENQLELVFGVDNLTDEFIKYGQGFDSTGTGTDGAIYDAIGRRWYVGARKTF

SEQ ID NO: 1260 - protein, 442 aa, Marine gamma proteobacterium HTCC2143
MGMSQKTRFTQSALAVAVALVSTQAWSAGFQLNEFSSSGLGRAYSGEGAIADDAGNASRNPALIMMFDRPTMSAGAVFVDPGVNVSGTSPTGKSLNADNIAPTAWVPNFHFVAPINDQFGWGASITSNYGLATEYNDDYAAGSMGGKTDLTTANFNLSGAYRLDSNWSFGLGFDAVYAKAKIERYAGDLGQIVAGSGALPPALAGQVAKIPADTQIAHLNGNAWGFGWNAGILYELDKNNRYGFTYRSEVKIDFDGNYRSSLPAAYNQILGNFGLPAGTNGQTTGGSLTLNLPEMWELSGYNRVAPQWAVHYSLTYTSWSQFQELKATGSNGQTLFYKEEGFKDAYRLALGTTYYYDDNWTFRTGIAFDDSPVPANNRSISIPDQDRLWLSAGTTYAFNKDASVDVGLSYMHGQHVEIKEGPYTFRSEGTAWLYGANFNYRF

SEQ ID NO: 1261 - protein, 666 aa, Marine gamma proteobacterium HTCC2143
MIATPFEATAPRIPVRLGALPHAPLLMLSLLGFASGIASAQSAPVTEAGKLPPVLVTASRFVEDSATLPYGVSVLTAQDIADSGVSTVNEAVMKLLGVPGRLDLYGGGDYALDLRGFGTTSDNNQVVILDGIRINEGDLGGTRLAGIPINSVERIEVLRGSGTVLYGEGATGGVIIVTTKAGHGTARSNRASVYAAAGSDRLRDLRADATLEAGGFSLDAAANRRTTDNHRDNFRSETEGASLTGQWRNDWLRVGLRHAYDDLDTGLPGALTAAQYAADPSQTTAPNDHADIRNTRSGVFAEADLGGDWQLGLDAGWRDKELRSRNGAFAYDYDVDAKNYSLRVRNRTQFASVVNAVVFGVDRNEWERTVLGAIGSVGEQSSTGYYLKDDLTLSGGTRLSAGVRTERIEKAVSSTVDRIDDRQRAWELGVLQPLSENSAVYGRVGRSFRLANVDEFSFTNPAVPLRPQTSRDTELGVRWRAAGRSAELRVYRSSLKNEIGFDPSGVGPFGPFGANVNFDPTRRQGVELELAQALTEALNLRVNGALRRARFTEGAYDGQDVPLTPERTLSLRADWTPAPAHKLDAIVNYVSSQSPDFANVCSIPGRTTADLRYAYRWTQAEFALGVVNLTDRKYYTQAFGCTAGGETTSIYPEAGRTFAASVKVSF

SEQ ID NO: 1262 - protein, 657 aa, Marine gamma proteobacterium HTCC2143
MKKILVLLAAAGLLATGVTRAETLSGEEKSPHYSSGEIVVTAGRVEELKKEVTSSVLVISREEIKESPATDLGELLAEKSIGNIQKYPGANTTIGIRGFRSDAHGNDLKGKVLILLNGRRAGTGNLAKLSTSNVERIEIIRGPAAVQYGSAAMGGVVNVITAKGKGVPSLFAQHMQGSDDFQETSAGMSGTLGRFDYSGSLSFSDREDYTTASGETYYNTAYNGKVVASLNAGYEFLDGHRIGVVVNHFDIDRTGSPSYFVRNDRSSYIEEQNRSVDIIYTGKPSEGYWSWMARYFVGEDFYGYRSPSISYSSDRSVDQKGAQGQVTFSPEWLSVTAGFDWLDYVVESTMAPRESEYENPAAFLLLKKGFLDDMLVVSGGLRYDKYDVRIDNGEGNHESTDNINGSVGLAYNPADGFKLRVNYADGFRMPSAGELAGYYPYWGGGFYEGNPDLKPEKSSTIEFGADYQSGGVTTSLTWFHSDFRDKIQESGLDSGNRTWVNLGGATIAGVEGEFSYAGMYPFTGSNLSFTPFVSFTWLSEYNDDDTGDYLLYTPEWNASGGIRVKNESGFKGVFTLAYFGKKYVQDYVTSWAGDVIAKEGFTVANLVISKKFTLDREYGRGFTITGEIENLFDRDYEYVNGYPMPGRSFNLGLRVDI

SEQ ID NO: 1263 - protein, 727 aa, Marine gamma proteobacterium HTCC2143
MSFYKYSVAIGFAITTLSAFAIEEPQPLEHVLVTLPIHQTATETSLPVTVLTGEELAREASATLGETLERLPGVHNASFGPGVGQPVIRGLSGPRVTTLQNGTRSADASALSADHVVAVEALLADSIEVLRGPATLLYGGGAIGGVVNVLDNRIPTTLPEETSWGLDYRYRGASGGNTGTFRVDTALGPFAVHADALFRDTENLEVADGAGTDGMDLLPNTDTSASAGTLGAAFHFDGGFIGIAVNRQKNKYGLPEGSHGHHGHGDDHDDDHDDDHDDDHDDDHDDDHDDDHDEDHDDDHDEDHDDDHDDDHDDDHDDHDDHEGEEEEVDIRLEMEQTRYDIRLQLDEPMAGIARFSGVVSLTEYEHTEFEGLEVGTVYSSDAIEGRLELVHSPIGDLHGVLGLQISETEFSAVGEEAFILPTDTSRLGLFLVEDWHSGSWKLEGGLRFDRDEVDPQGNMAPAREFDTFSASFGALYEFTEAWHLSTTLTRSERAPSVEELYSNYENTGPSTWVTHAATAAIEVGDVNLDTEESLNIDVGLSLHGETQSLRIGAYYNDFDNFINLASTGMEVGETPVRRYEQGAAEFMGLELDAHWEVLETNFGLLNLEVEMDVTRGELADGSDVPRLPPLSGALGLVWEQPSARYFTRLTAADKQDRAGDNEEATDSWVRWDIGGQWQFGFSDSLITLSAVVRNIRDEEIRLSTSVLREYAPEPGRSFNVGVRMEF

SEQ ID NO: 1264 - protein, 346 aa, Marine gamma proteobacterium HTCC2143
GFVEDSTFSINTRALYFSRDKRNNDSGQSRSEETGLGFNGLYQSGFTQGTIGVGVDAIGLLGLKLDSGKGRAGTGLFPTGSDGRSQDDYSKGGAAVKFRLSNTVLKIGDQYTTAPVFASDDSRLLPELPQGVSITSNEIKDLKLEAGHFTSSVAQAQTYKDSITDFPGNHVGLKEANFVGGVYAWTPEFTTSLYYSKVEDYWKKLYANVNWTHALSADQSLAVDFNIYSTKSDGAGLQRAEKDDTTKLDNRAYSLQGAYTYQAHTFTLAYQKVSGDGDYGYGIDGGGTVFLANSIARSDFNAEDEKSWQARYDLNMATFGVPGLSFMTRYVNGSGANTGTTSNGKE

SEQ ID NO: 1265 - protein, 907 aa, Marine gamma proteobacterium HTCC2143
MLKNSMLAKSVRFALVAGATTAAFTAPTVYAADEGEKVERIEVTGSRIKRTDLETASPITMFSAEDIANSGVATLEDFVQNIPAINGGAEGSSVNNGSRGFATASLRGLGSGRTLVLINGRRFASGDLNSIPTAYVERIEVLRDGASTVYGSDAIAGVINFITKKDFEGIEFGAQYDIASEGDGEKTLLSVTTGTSSDRGNVVMSLQYTKREAIWQGDRDFSACPIFERGGEKVCGGSGTIPYGQFFYTGANSPAGGHVIDPSTGAIRKFDQAVDGYNYAVASYMVTPQEVFSINGAGRYEISDTLTGFMEGGFTNRQSDQLMAPEGTFWGPTMPASNPYNPTGEDLIVVRRLAETGGRGFTQDFSDYRMVFGLEGSLGDYYWDLSYNFARYVDSRLDLGRVNPTRAETLLDPDLCAKDSDCPGIWNPLAEGTLTPEMLAYAFVPNSPVVRGETRQLQGNISGSLFGLELPGGEVMFAAGFEKRWDEYQSVPDGAASIGQIYSVAGEPTSGDYSVNEAYAEFDMPVLEGLPFAESVRVTAAVRYSDFDFLDDGSTNTKFGLEWVPFDGLMLRSTLADGFRAPSVSELYAPQSETNLAYAEPCKNYATGTQNATVKANCAAEGLPGNFELSSNQSSTVVGGNPDLQPEESESFTAGFVYSHDIGFSASVDYFNIEITNGIGTAGTDNVVSACWNSANFSSPLCDLIKGPSLTGDAPHPTSPYRTALGPVAGILLTNANLSTFETSGYDFDLSYKTDIGEGQFSALLNGTYLEQYDYLPYEGADIVSAAGKVAADQWETTLAVFPRLRANLSLNYTMDNWSVSWQTRYQSEGEDYFASEDNLDNIADSIWYHDVQGTYFAMDNLSLTVGVRNLFDEEAPYISNNQDMNTIPVSYDTAGQYWYARVNVKF

SEQ ID NO: 1266 - protein, 174 aa, Marine gamma proteobacterium HTCC2143
MKRLLPLLLLGATASAQATDTLHQIYIQPSLANLKIDGSHGSALMTQVGYNYHFAPMIAMDLSYYMTASMNDIAMDNDKASATGATIAAKMYFPMSYYGSFYGKFGLNRTNVEYQYKEGNQTLKQEAVSTKPYVAVGTVMKLFPSVTFNVEYQYMPLASDDYISSIGAGVNFMF

SEQ ID NO: 1267 - protein, 361 aa, Marine gamma proteobacterium HTCC2143
MKASISSALKTTLKATACAALLASASSAFAQSSVQLYGQVDEWVGAQKFPGGKTSVQVSGGGMSTSYWGLKGAEDLGNGYKAIFALEGFFLAQNGQYGRFTGDTMFSRNAYVGIESPYGTVTAGRLTTPLFVSTILFNPFIDSYVFSPMVYHTYLGLGTFPTYSTDQGVTGDSGWSNAVSYSSPNFNGLSATAMYALGNTTENGAKKWSGQVLYFHGPFAATAVYQYVNFNNVPSDLGSFSTSGVPGLKSQSVAQLGLSYDLKFVKFFGQYMYTYNDQQVTSWHVNTAQGGASVPFGPGTVMASYAYSRDGGGFDQTRQTAAIGYDYPLSKRTDIYAAYLYDHISNQSSGNTYGVGLRAKF

SEQ ID NO: 1268 - protein, 671 aa, Marine gamma proteobacterium HTCC2143
MKKIIPLSLIAIASLYASEVQLAPISVESTVITEVSQNAQVSADLAQALSTSVPSIDMNRRSGIANDVYIRGQKRDNISVDVDGTKVQGACVNRMDPPISHIITSQIDEIEVIEGPYDVENMGTLSGGIRIKTKKPTKDLHGSVDFGFGSFNYTKIGATISGGNDTVRVLVSGSSESSDQYKDGNGDTIAEQIDKYAVANPAAAGMKFKPAHKEMPAYKKKSIMAKAFVNVTDNQELRLSVTKNKSDDVLYGNSKMDALYDDSNIYAVEYNIKNVSDIYKNINLKYYYSDVDHPMATTYRMSSNVAAQDNTNHLKTTMQGLKLKNDFDINSFKLLVGFDGSKRTWDGNYYNTTTGAALAAGNSKSLDDALTKNGAIFAKLDKKYGSFGFSLGARYDSTKITHATLQSNDYTSFGANLMTSYNLDKENKVFLGFGQASRVPDARELYFRSSNGAWSGTANLNQTTNREIDLGYETDNSAFKLKIKGFYSMLSDYIYYQKQANGVAITTNNFKNLDATVYGTELTTSYYATDDVTVDLGASYKVGKKDKALTGQTDTDLADMAPLRGNVALNYEYMKGSIATAEVQASDKWSKIDSDNGEQELKAWTILNLKVKHAVNKNFNFTLGVNNLLDETYAMNNTYADLILVTAGGTSDIMLMNEPGRYVYTNLNFKF

SEQ ID NO: 1269 - protein, 703 aa, Marine gamma proteobacterium HTCC2143
MVTNTKGIQDLSDNYENLSKLLTRYSTLNTLIKLSADPSAINAARENLGASAKNLIGDTKNSPAYQAVLLAINAAVGFWNVLGYATQCGGNANGQESTSSTTIFNNEPGYRSTSITCSLNRYKPGYYGPMSIENFKKLNEAYQILQTALNKGLPALKENNGTVSVTYTYTCSGEGNDNCSKKATGVSDQNGGTKTKTQTIDGKTVTTTISSKVVDSQAKGNTTRVSYTEITNKLDGVPDSAQALLAQASTLINTINTACPYFSVTNKSGGPQMEPTRGKLCGFTEEISAIQKMITDAQELVNQTSVINEHEQSTPVGGNNGKPFNPFTDASFAQGMLANASAQAKMLNLAHQVGQTINPDNLTGTFKNFVTGFLATCNNKSTAGTSGTQGSPPGTVTTQTFASGCAYVEQTITNLNNSIAHFGTQEQQIQQAENIADTLVNFKSRYSELGNTYNSITTALSKVPNAQSLQNVVGKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 1270 - protein, 732 aa, Lyngbya sp. PCC 8106
MSQQQKTLLPLGAALMAGGLSISAFAAEGSESSEAAVLPTIKVQTSAEEQDGYRATATRVGKKLQDPHDIPQAVTTITNQFMEDYQASSLRDALRHVAGLSFNAAEGGRSGDNMMLRGFYTFGDMYLDGIRDTAQYNREIFYMEQVDVLRGAGAMMFGRGQAGGVINQVSKAPHIGDRGKITGSVGMYGYYEMTGDFNKQITDTIAIRFNGMKRTEDSWRKNPAADDRASLDRDGFAISAGIGLNTANEFILSHIRTTTNDKPDFGVSFDATTRRPQERFPAKYYWGTNSNFDKSTVNITTASFTHRFSPDSEWRTQLRYGDYERSYWARTPSLTVAPNIGGTICTPNCNGGPTRAMDYETLAIQTDYNKKFQLFGMNHEFLAGAEYLNEDGFRHSLQNFGGTTAANPPLYRPYEINSAGNPVDFKSRTYAVYMQDTIEFIPKWKLTLGGRRDEMKAIYSNTLSPRLRYGEWSTRGALSYHFSDQSHFYVAYSDSFSPTADLYQLNVAPLPPERSQVKEVGAKWLLFEGDLALRAALYRADKQWERNTDLESTASVLTRKRRTDGIELEMAGRITPNWEVFSGFTVMDSEVRKVAVNVNPNTGALTSGNPAYEGERSRNTPPYTFNLWTTYKLPYGWRVGGGVEVKGKRYAYNPSGAGPIPTLPGETEFHPNTAPSYMRWDAMVAYEQPKWAVRLNVQNVFNKLYYDAVYDNGGFVIPGQRRRAIMTAEYRF

SEQ ID NO: 1271 - protein, 889 aa, Lyngbya sp. PCC 8106
MNKILLFIALLMVPITMMTQEVKGIVTDNAGTPLPGVNVYEKGTEKGTSTDFDGRYTIEVAGEATLVFSFVGFEEQEVAVNGRSQVDVTLADGVSLGEVQLVGSRSPRRTATDTPVAVDVIDVSEVNTQTGKIEVNELLQYAAPSFNANKQSGSDGADHIDPASLRGLGPDQTLVLVNGKRRHQSSLINVFGTRGRGNTGTDLNAIPAASIKRIEILRDGASAQYGSDAIAGVINIVLKDAVEKFSGSVNYGFYSTNADGDFPDGTPNTDGNRLDTDRDGNAIGDDQNFDGGSVKVAANYGFEIADEGYANFTMEYLNKNKTLRPGFDFRRGFGEASIEGVNFMGNLAIPISENSEFYAFGGRNYRDTDAFAFTRNNPTARNVVDIYPNGFTPRITSIITDNSVAAGFRTKTESGWNIDISNTWGKNLFHYYIKGTLNASLGENSPTDFDAGGHNLSQNVINLDFSKYYEDMLEGVNFAFGAEYRTENFEIFAGEEGSYATYDEDGRPIINPDIQQQPIDPMTGDPRPGGSQGFPGYGPANEVDRSRSNVSLYADAEFEFTEAFLLAAAARFENYSDFGSTINGKLAARLKATDDINIRGSVSTGFRAPSLAQIYYNLKFTNFVGGDALESLLSPNNSPVTASFGIGALQEETALNASLGFTANFGKFTATVDGYYINVQDRIVLTGNFDAPQIDNVEAAQFFANGADTETVGLDIVLSNEFEIGEGKLTTSFIGNFNNMEITEVKNGNLNEQTFFGERDKSFLLASAPDSKLTLNLIYDIEWFDAALGLTRFSDVTLLDFQMLEPVEDYGSLANQVDAASDVYDSKIVTDLNLGFKLNDVLKLNVGSNNLFNVYPDQQDDWTEAGGYWDAVQMGFGGAYYYAKLNIRL

SEQ ID NO: 1272 - protein, 197 aa, Lyngbya sp. PCC 8106
MTADFGVNFKEAEFYSFYESNVLNHAVAGRNHTVSAMTHVRLFDSDMTFFGKIYGQWDNSWGDDLDMFYGFGYLGWNGEWGFFKPYIGLHNQSGDYVSAKYGQTNGWNGYVVGWTAVLPFTLFDEKFVLSNWNEIELDRNDAYTEQQFGRNGLNGGLTIAWKFYPRWKASVTWRYFDNKLGYDGFGDQMIYMLGYDF

SEQ ID NO: 1273 - protein, 736 aa, Lyngbya sp. PCC 8106
MSRSVTALCAATCLVTLSSPCFSQASTQVRELTNLPMVTVDPAKRAAPRAARPAGNDQSAAPTRAARSAAEPRAASAVPAGPAPSRTAPNTQTATQRIQQTPGAVAVVPDTAFKTGAAQTIKDVLDYVPGVFAQPKWGDDTRLSIRGSGLSRNFHLRGTQLYLDGIPINTADGYGDFQEIDPTAYRYVEVYKGANALRYGANSLGGAVNFVTPTGRDASAFESRLDGGAFGFLRGQASSGGVAGAADYFVTGSASRVDGYRDHSWGTSERGSANVGYQVSPDFETRFYLNANSVRQRIPGEVSKTSALTSPQTAAANNLLNDWQRNIDTVRVANKSTLHLDNTDVEFGVFAVDRHLMHPIFQWLDYRYHDYGGFVRAIDDREIGGHRNRFTVGLNIQNGTTDANQFVNIGANKGMQMSSLVQNPENYTLYAENAWYALRSVSLIAGAQFLHAVRSQQVNFTLNGDAAGTATYDLFSPKLGVLWDVDPAWQVFANVSRSGEAPSFGENVAPTFLNPNFPTIPFYKIKAQTATTWEIGTRGRRPDVTWDFALYHADIRNELQCFYSSFGNCNVTNADKTMHQGVEAGLGFSLLKGLAVKSDTPDRVWLDLSYTYSDFRYSNDATWGNNRLPGAPPHFLRAELLYKHPAGFAFGPNVEWVPQAYFVDSANTLSTDSYLLWGMKATYDDGKNFSAYLEGRNLANKAYIATTSIIDRATPTSTLFNPGNGRGVYAGLRYKL

SEQ ID NO: 1274 - protein, 681 aa, Lyngbya sp. PCC 8106
MSERSLLIRKPLLVRKPLSIAVAVICTSLSANVLAQEEAQATDEQMVVTATRTEMALKQAPASMSVITAQDIEDSPGITLADIVAESTSVESDFDSTRAGRQMISIRGMDSDYTLIMVNGRRLSSASAIIRGNDFDLSTIPADSIERVEIIRGPMSALYGSDGMGGTINIITKAPENDWSSTLSMDTSSPLDGDGGEEYSMGFTTSGALIEDELFARLSVNQTSRDAWQPYSGTHSSGYDRSDITALEERETLSLLASLTWNATDNQTIDFDFGYSDDERESSAENVSSVIESDTRVVRQSQAITHSGFWSWGDTQVRYSRENVTDNDAADSDTNYSSDVEELTQIAEASATTYLGENHTVTFGMDYQLSELTNKENLVNGTSEAYQGALFVQDQWLMTEQLTATIGGRLDKHELYGEEFSPRVYLVHQTTNDLIIKGGVGKAFKAPTLTQNQADYTVNSCKGACDLYGNEDLKPETSLNYEIAAIYSQPRWNVEGALFRNEINDLIDRDETYCENGGMFESGKGCADSSSSTGYVKGKRTYTNVSEAVVQGAELTGQFQITDEWGVSGNYTFLDTEDKSTGEELLERYKHSGLVKLNWSPTYDLNTFVSARYRGERNIETDLTQEAYTTLNIGGVYNINDSVRVRAGIINLTDEAVSQELESMGYVEEPRTYYVGMTADF

SEQ ID NO: 1275 - protein, 231 aa, Lyngbya sp. PCC 8106
MSKRTFAVILTLLCSFCIGQALAGGIVLQRTRVIYDASRKEAALPVANKGAETPYLLQSWVDNIDGKSRAPFIITPPLFRLEAGDDSSLRIIKTADNLPENKESLFYINVRAIPAKKKSDDVNANELTLVFKTRIKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 1276 - protein, 978 aa, Marine gamma proteobacterium HTCC2080
MLNTKVSKAVRLAIAFGAASTALFSASSFAAEEGEVVEEVEKIQVLGSRIRTDSFASDTPITIISVENAANQGITSLGELLRTSTIAAGSSQVTSALSVGYVTSGGAGTETISMRGLGANRTLVLLNGRRAGPAGTRGQVSSFDMNALPISAIERIEVLKDGASSLYGSDAVAGVINIITKKGDDKSISVDLSQPFESGGEQQRINFSIGEEFKKGSIRVVGDYKVQHELQRGDREFFDCSARRYYNKDGERADPIDPRTGNYHCNESGYGLWLSNDGASNFDSGYGSYDYDGFFGNNGYSSFNDAASGPGDFTTPDGWYNVGFDKESDGWRNLEHPFSDNESMIPKTATYSLFLQGDYSFTDSISGYAEALYSSRKTETQAYRQFWVGDIARPDADLYEGFGGDVRIMPVALTDHYGSETTIDYRRFVLGLEGSLGFWDWDVSYQNSHSKGEYQNKVIYRDSMVMAQQHLGNGTSCSGEVTANSGKACVDVPWTDPQFLYGNPSDEVRNFLFGEETGETIYKQQTLEAYITGDLFELPAGAVGSAFGMSYQKDELDDTPGVASSTGNSWGLSSASRTAGTQNTRAVFGEIRVPLFQGEPWAERMELTTSGRWTDVSTYGSDNTFKVGLVWEVVDGFTLRGSRGSSFRSPALYELYLAGQTGFLGQNSVDPCFDYGSGYADGTVSERTYNNCLASGVPTDYDGSTASSATSVTSGGAGRLTAETSISEGFGFVWTSPENTYAFSADYYKVDISNQVANLGGSDITSTCYNSENFPNDPICTQFTRNDGTDGNYGIDTIYGGYTNVANQSTRGVDLNFTYRDDFDFGSVYFNIEHTVQLERTYQLFADSEPSQYIGEIGDPKHVGNISATFKKDDWSLTWTTRYVDETNDYEYYDDSNESTYRGEEITFVAETPKVFYHSLSGNLKLDQFDVTMGIANVFDEEPPQVSPSYVRAVGNSALYSQYDNLGRRFFANVTYNF

SEQ ID NO: 1277 - protein, 765 aa, Marine gamma proteobacterium HTCC2080
MKRAEIYLAGGAARKRRIFPATTSLLLASAALLPNTAFSQQAADQPATSANQIEDIVVTAQKRSENVQKVPIAISALGGEALANRGFDSLATLTKLAPSIQLSNFGPIAFVTQRGIGNENSMAGGDPGVAFHFDGVYVGRRVGTLFSAFDSARVEILRGPQGTLYGRNATGGSINYITKKPVDEFEANADVTIGNYDMWRLRGAINIPVTNGISTRIVGYKEKRDGFAHNSVPGGTEANDADNYGIRGHILAEVTSNFTALISGAYIHAGGIGSQPELRTPFPGSTTGQNLGGPPVPGTNNYLVNGTPLVNDLRPFHEAKNTSEFQDKTFRLISATLDLDLGPAAIKSITAYAKSTFRTQQDADFSSKDLGSLNLDEKARQFSQELQLSSTAGPGSVFNWIVGAYYFREKGYREITYRGSRYDILAAAAQVPYGFRIAGNVTSESYAFFGQATVRPTDRWSVTGGLRYTHDEKSGNNMGFQFQPPSYSGPVGGNWQKVTYRVATDYEIADAILGYASYSTGYKSGGINQAINPNVANAIFEPEFVKAAELGLKSQFFDKRLQLNLSAYRNKYDNLQFQIFGPVGPQAFNAEGATVKGIELEFQAAPTSWLRIDGSGAYTDATFDRQILQGIQLDGNRVQRTPKWTFNLGGSIDFPLGEIADARLRADYSYTGNIYYTAFNRNTPFPGLAGSDFAPSYQSVDLRAFLYSKDRKWTGELFMTNVFNTVQIGNVFRGIGFTDVAGGGGPELVTYKPPRQFGLRIGYSF

SEQ ID NO: 1278 - protein, 1106 aa, Marine gamma proteobacterium HTCC2080
MLQIYEKRADNVVQKRVFLIFLGLLLMQTLAFAQSDSKITIQQKDITVVDALKTVERQSKMSINYSDSELKGKKIADLNLEDVSVTTALDAILKGTGFSYQIQGNYIIVTEKKPAAAQSVKDIKGKVTDENGEPLIGVNISVDGSSTGTITDFDGNFSIKSPGNARLKISYIGYATQLIAVSNKDFYPITMKQDTEVLDEVVVTALGIKRAEKALSYNVQQIKSEDITGIKDANFINSLNGKIAGVSINKSGSGVGGATRVVMRGAKSIEGDNNALYVVDGIPLFNTNMGNTDSGIMGEGKAGTEGIADFNPEDIESISILSGPSAAALYGSSAANGVVLITTKKGQEGKLQISFSSSSEFSKAYMVPEFQNTYGNKEGMFESWGDKLARPNSYDPKSDFFNTGTNFINSLTLSTGTKQNQTFASVSSTNSKGIVPNNSYDRLNFTIRNTATFLDDKLQLDLGASYVKQEDKNMVSQGQYWNPVISAYLFPRGEDFEDIKTFERYDQSRNIPIQYWPIADATYGSQNPYWTAYRNIATNEKSRYMFNVGLSYKITDWMNLAGRYRMDDTHVQFERKVYATSDQKFAEGKKGLYDYSNYKDRQEYADFMLNINKQFNDFNISANLGYSYSNYWSLARGYKGTLLGVTNLFAASNIDPSNGRISEDGGDSRVRNHAIFANVELGWRSMLYLTLTGRNDWNSRLVNTSEESFFYPSVGLSGIISEMVKLPEFISYLKVRGSYTEVGSPVSQSGLTPGTVTTPIIGGALAPTGIYPFTDFKAERTRSYELGLSVRLWNKLSAEVTYYKSNTYNQTFIGDLPEFSGYKQIYLQAGNVQNHGWEASLGYRDSFGDFSFSSNLTFSRNVNEIKEMVENYRTDMSPEPINVPEVRKDNGRVILKVGGSINDIYANTFLKKDSQGYVEIKQDGSYGLEQGEPVFLGKTSPDFNLGWSNSLSYKGFGLSFLINGRFGGVVTSSTQAILDRFGVSKASAEARDAGGVLLPGQGRVDAQSYYQLIGTGDYTTSGYYVYSATNIRLQELTLSYRFPDLWFKNVLKDVTLSFIANNPWMLYSKAPHDPELTPSVGTYGQGNDYFMQPSVRSFGFGIKFKL

SEQ ID NO: 1279 - protein, 790 aa, Marine gamma proteobacterium HTCC2080
MLFSISSIIAQNIRIQGVVNTSQNSPIAFANVVLLDEEQKLVKGTITEEDGSFILENLKTGTYHLRVSFVGFDDQKIESILLEKDTTLRPIVLSASQESLDEVVLTSKKPTVVRKADRLVFNVENTILSSGNTMDILKRTPGVVVNQEEITIRNEGVTVYLNDKRVQLSAEEIQDLLSSLSGDAIQSVEVIANPPARYEAEGGPVLNIVTSKVVSLGYKGTVFARGTYGIFPKHSFGTSQYYKNEKLNLFFNYSFNPQKSSFRSDDFINYRTADERINWLQDFERKNWSNAHNANLIIDYKLNETSQLSFSAVGLYSPGIYDYSRSITDVTSSIEDPYTIRTSSGLNGERTNIALDAKYTKTLKNGSLSMNVHHTNFSRKRDQSLNSRYIDATGDLFRNVRFTSDSFQNIEIYTGQIDYATTLGTVALELGARTSIIDSRSVVKFPTIVDSGVSGLQEAQDDDFLYDEDIVAGYVSVAKDWDKWNVKAGLRAEQTNSKGTSLALNEINDLDYLEFFPTAYVQYAPVENHSFSLDYSRRVDRPRYQDLNPFAYFLNENNFDQGNAQLTPAFSHRFNFNYTLKSAYSFDLYYRDNGNEILRLPFQNNDAQVLRTSNQNALDSKSWGLDFTHGRSISDWYYLYTYLSAFHEEVTFLAQESGNVAQDNKVDGVYAYIGNYLTLSKDRSWTAEVSAEYISKFLFGSYIQDRVITLNAGVQKKFWKNRAILKVTVNDILGEANALLTSQYLNQDNAYFAVPETQNLQVGFTYKFGNFKLQDNNRALEIDELERLKE

SEQ ID NO: 1280 - protein, 910 aa, Marine gamma proteobacterium HTCC2080
MNMTKKFALSTLTVAMISFAPVTTTSVFAAEEEKIEKIMVTGSRIGRAELESSSPITVVTKVQLDNLGVTDVSAALRRLPAITGATSNNQSSAGAVNIQTATLRGIEATNTLVLLNGRRMVGSNEDGLVDLSSIPFEAVSQIEVLKDGASAIYGSDAIAGVVNIITYQNYEGFEVNARYGVSSEGDAQEREVGLLMGFSTDKGSLMVAASTSNNSGWEEKDRYMTQDTDQSYLGGGDTSSGTTPFARLSGFGLDPSETWTVLDANNPSAVTPFDYDTMGYNYRAAQSGANDNQTTSVFVSGDYELTDDMLFFTELSFHDGFVQGNQAPPGTDTGWYGDNVDTPNAFKRYPDADGNNFGVGANQKYNPFGIAGNVSRRFSEYGSRIYKTDNTVQRYTLGLKGAIFDEYDWEVSYSSQSAELVQRGGAQPSIMQIERALSDECETAADPSCVALNVFGPEGSITTEMLDFINTTAPVTTNKNDLMFIQAHISGPIVSLPAGDLMFSSGVEYREDQLSLEVDQAQRTATFDVSWGGSSTPVISPVREISEFYLELAVPVLDNLDIELAARYSDYSDIDESTTNPKVGVIYQPLDMLKLRGSYSTGFRAPTMAQMYQGRTSSINTNLYDPCNPGNEANFSSSKPECVALGLDPAFSQNAIQSNDIIGGGNPDLKPEEAENTTLGLVIEPIDNLSLTLDYFAIEQTNVVFASSRYVIDQNLAGNPTYAGDVIRSNNGTGYIQTIYSPANNIASRNLSGYDLNANYRFETDIGDWSINFDGTYLSEFEVQDTSDSAFRDITGTYDPAFGSLPEYKANIQIDWTMGNYRATWDANYNSEIFAGEATEEFEADIMSSTVFHNMQVGYFVDAIGVDLHAGIQNVFDKEPPFLRANGTSTDDNLYSFRGRFFYFGLKKSF

SEQ ID NO: 1281 - protein, 708 aa, Marine gamma proteobacterium HTCC2080
MKSSRCGNEPAAPQIALRATALAVSLLCMAPLAFAQKVDAQSGESGNVEQVLDTVQVTGNWLGTGLQNSVKTFPGARTVVGEEQIEQSGASSISDVMRRIPGVQSTDNSGTSGSAISLNIGVRGLTGRYSPRSTVLLDGIPMAVAPYGQPQVSFAPVSLGNIDSIDVVRSGGAVRYGPQNVGGIINFNTRPIPTSPGITGDASIRENIYTEGGGSNTQYNAFVGTTLDSGLGLAVLYSGMTGREWRKGSDDDVNDLAVKFAYDINNTSQVYGKVSYYDVRSRTPGGLTVAQYNADPFQNTRPNDYWSGNRTAFDLGYVNTISGNQEFEIRTFFNESYRQSTLQQSATVIAHQPRNYTTFGIEPRYTQRLALGPTTHDITVGYRYIRERGDDNAFNQNPRTGVVGPTTTFDNATDAHAVYIDDRIAVGNWRIVPGVRFEHIDTTRQQRGTTTQFDSMNNKALPSINVSYLVNNAWTVFTDYSTSFGPVQNTQLNSQTPSNPLQPEVARTFEVGTRWTDNRIKAELTAFKIKFDNQIQQVPGLFPATFQNIGATDHDGVETAIDYTFDRASVLGGLNVYANYTYTRAIQKSGATAGMDVPFYSRNTDTIGARYNWRNWTFNASTTHQSAQYSDLANTVAESADGSVGRIPGFRTWNLQAMFTVPQWKRTDITIGINNLFDKRYYTRTTDSNAGRLVGAPRMVYIQARAGF

SEQ ID NO: 1282 - protein, 946 aa, Marine gamma proteobacterium HTCC2080
MKKVATAVQLALAGSVALTSANVIAQDAATESADVEKIQVTGSRISRQGAIAPSPVTAISGESLLNSGAMNIGEVLNELPSLANTFSLGNSGQFIGTAGLNILDLRGMGTDRTLVLVDGKRHVSSSAGTAAVDTNTIPTTWIERVEIVTGGASAVYGADAVTGVVNFILKKNIEGFDISATQGFAQENGYKNDKYQASYGFNFDNDRGNIAFAAEYSSQESLDALDNPWTATAYRNMSFESIMGYEREEDQLNSTAFPDNFYTPNAGYYVLNNAGVFGGGTKTFNADGSIKDIYIGDQVDGVFCANCDLFNLRQFTQLQPEFDRTNLNVKGNYELNDDTTVYAQAKYARTRAISMAQPAFFFYSDETTITRNNAFLDDSVAEYMDANGLESIELNRMMTDLGRRTEADERETYRYVLGVEGYINDEWNYEAFVNYGKTELERENRNNLILQNFYNAIDAIEDDNGNIVCASGSEDGCVPLNIMGYGQPSQDAIDYVNTTSVGTSKIEQYNAGATIANSGIYELPAGYVGFAAGVEYRKEKSAIEEPDNAAGTFFNALGEDKGEYDVSEVFTEVTVPLLEGLPGVDMLTFDTAARIANYSSIGNAKSWKLGLDWQVFEDLRVRATKSSALRAPNISELYGEASQTFFSVSDPCRTDELEDLANADQRIANCAALGVPADFNSDYDSATLEGVNGGNIDLQAEQSISKTLGLVYTPAWFEGFTATVDYWEIELTDAITNIDGQTILDRCVDSETGINNPYCGLIDRDSETGEITQIRSYALNIAGQEAKGVDFELGYDFDALEGAFRTSLIATYLKDRKEFPFQDNPELFYQNAGTAGESDWQGVFTVNYSRGDWEASWKTRYIERASLYDNQELARNPNPSNRMELASYAVTDVTAGYNFKNGVSLTVGIDNLFNRALPKGTTGTGEIDGAYDNIGRFGYVTVAYKM

SEQ ID NO: 1283 - protein, 1035 aa, Marine gamma proteobacterium HTCC2080
MMRHRRLKTSASMLALSTAIFAAGQVQAQTNNDSQAVEEVVVTGIRASLERSIEIKRTNSGVVDAISAEDIGKFPDTNLAESLQRITGVSIDRTNGEGSQVTVRGFGGGFNLVTLNGRTMPTANVSTVGGDQSADFQTGTSRSFDFSNLASEGVSTLEVYKTGRAGIPSGGIGATINVKTRRPFDAREHGLSGSIGAKAVYDTSMKERLEDASKVTPEVSGLLNWLDSEEKFGVTLFGSYQKRNFTSRSATSNDWNIRTYSDFLNPANGFVRNGGATQITNAPANGSTLVAIPNDSRYHFSQGNRERVNAQATFQWRPTENVVITADGLYAQNKSFERRNDQTNWFNRPFDKVTFDKNPTVATAVFLQETLSGTKDTGFEQQYRANEDKLQSFGLNGVWDVTDRFKVSLDGHVSKAESNPDAPNGTSSTSVSIGAPIISSHSVDYSGKIPVQAVTINDALPRGNGNGKLDIGDLGSQVARTSAQSQDQKIKEFRADASYELDDNGSKFDFGFDYRASKMKQASINTQQDLGSWGISNPRDVQQYAGSLVKEFCMSCRFDSFDPKQSGVGLVAFRANAIDLYNALSAPYVALGNKVGVTSQDDNRVNEDVWGVYGQLTWKGELAGREASMVAGARYEETKSKSVSLIRTPQAIVWTADNDFRVDTATTYSPISGKNKYSNLLPALDFQVELAKDLLGRFSFSRTIARPDYGNLFASVSAQAPNRPIANGAIPLGTRGNPELQPLISDNFDVSIEWYYKPSSYVSAGFFEKRVNNFVGTGTFNQSLFGLRDPSSGAAGTRSGDARASLTTIGANQTDVNLFTMTSLIQTTGSVAAATAVFQANRGPSGDLNQAFVDQVLAATDVSPTAADPLFNFQVAQPINNKTGKIHGFEIAAQHFFGDTGFGLSGAYTLVRGDVGFDIASDPGQDQFALLGLSDTANATLIYEKNGLSARVAYNWRDKFLQATNRGGSRNPVFVAPFGQVDFNVSYDVTSSLAISLEGINLTKENLRTYARDENELWYAQELDRRFLLGARYRF

SEQ ID NO: 1284 - protein, 1196 aa, Marine gamma proteobacterium HTCC2080
MRNNWNLLIVCFLCVLCFRPYQVNAQVQSQKKITIEISNERLPSVLKRLEKLSGYKILFTYDDVKKFTVSGSVKDKSIEQTLDIILANKPLEYHIEDQFITITIKGPSKQAKVFNVKGVVISGDDGQPLIGATVVIKGSKSGVLTDIDGKFSIENVSNKSLLQFSYIGMKPQDLTPAPNMNVTLMPDVQTLSEVVVTGMQKMDKRLFTGATKQLSADEVKLDGLPDISRGLEGRAAGVSVQNVSGTFGTAPKIRVRGATSIFGSSKPLWVVDGVIMEDAIDVGPDDLSSGDAETLISSAIAGLNSDDIESFQILKDGSATSIYGARAMAGVIVVTTKKGKAGVSKISYTGEFTTRMIPSYKEFNIMNSQEQMGIYKEMEQKGWLNNSDTYRAKDSGVYGRMYQLINQYNPVTGQFGLANTPEARNAYLREAEMRNTDWFDTLFSNNITQNHSVSITSGTEKSSFYASLSAMSDPGWYKQSEVKRYTANLNTTYNIYKNLSINLISSASYRKQKAPGTLSSEVNAASGEVTRQFDINPYSYALNTSRALDPAVNYTANYAPFNILHELDNNYMDLNVVDVKFQGEVKWKALPELELSALGAVRYQASSQEHNIKDHSNQATAYRTGMDDATIRDNNNLLYTNPDNPYALPISILPEGGIYQRKDYRMLGVDFRATASWNHLFAEKHITNLFAGMEVNDLKRMQNYFQGWGMQYTMGEIPSYVYEFFKKGIESGENYYGLNHTTTRSVAGFANATYSYDGRYTVNGTFRYEGTNRMGKSRSSRWLPTWNISGAWNVHEENFFETLSSVLSHLTFKASYSLTADRGPEYVTNSHAIITSYSPFRPFTSGQETGLYVSDPENSELTYEKKHELNIGADMGFLDNRINFSIDWYKRNNYDLIGITPTQGVGGSIYKYANIASMKSHGIEFTISSKNIQSKDFSWNTDFIFSKAKNEVTELNARSSVMDLVSGYGFARQGYPVRGLFSIPFVGLSSNGIPMYNINGKITSTDIDFQTRDNIDYLKYEGPTDPTITGSFGNIFTYKAFKLNVFITYSFGNVVRLNPCFNYQYSDLSSMPREFKNRWTVPGDEKHTNIPAIISKRQYEDNKDLMYAYNAYNYSTERIAKGDFIRMKEISLSYDFPKSWITSAKISNLSLKLQATNLFLIYADKKLNGQDPEFFNTGGVASPVPRQFTLTLRLGF

SEQ ID NO: 1285 - protein, 436 aa, Marine gamma proteobacterium HTCC2080
MSFVFRFTPLFVALTATMPVAAQADEAKADGFIEGSTLNLHFRNAYFNRNEKNAQIKDKREWGQGAVARFESGYTPGVIGFGLDAHAMVGLKLDGGSGHAGTSILPSTPGDKARHAFSTAGGAIKLKGFDTEFKAGDLFLTNPVIAGGESRMLPQTFRGVAVTNRSIDGLMLEGGKVSFTKPYNQSGHRRINTYYSQQTAEQDSQNLSWAGASWSGTEGVTANVYAAELKDIWNQYYADFDYTYQVNDLVSLNPGVHFYHTQDTGQSKLGDIDNNTWSVHFTVAAGYHSVTAAYQRVNGDTPFDYINLGDSIYLDNSRMYSDFNAPNERSWKLQYNYDFAGLGIPGLTSTLSYSRGKADLTKASQDTQYYNFYNAEGENGRHWERDFDVKYVFQEGQLKDLSVLLRYATHRANAAYSSTADNDEFRVIVDYPLNVF

SEQ ID NO: 1286 - protein, 613 aa, Marine gamma proteobacterium HTCC2080
MKSLFVSRKGISLAMAALLGWGGVGEVLAADVETATLDKIVVSATKTPHTLGDVPVAAEVITREELQERNVKTLQEALERIPSLKVHSTAGYNNRGLVSLQGLDPRHTLVLIDGQRVQGGHENAMDIQQVSIDMIERIEVVKGPASALYGSEAVGGVINIITRGASKTPEFSGSLGMGSRGTMVGTVSAGAGSEHIGGHVSYTYRESEGLDLTEGDDPPTYDDYYEHILQGALSFDLSDNTELSIRPYYSYQVATDTVPELSQERYGVNTLFKWEPDDLSNVTLRGSYFSYHNLTQEDPTDTDTILSNTEFEASYSRLLLNTHLVTAGYQYWLDDRDSESQGLFVDQETHSVYMQDEIDLSPVVLVLGGRLDMHENWGEEFNPRAALMYKATDKLTFRTSVGTAFKAPSLLKIYGFRHVPMIAVGNPDLKPETSVGYQAGVDYQFCEGVRIGVSGFRNDIEDLIKTEVNFPYMTFSNVEEAMTQGVELNLEGCLNDDISATLGYSYLDTENKLTGKELTQRPDHRLTAGIDVKLPSADTSLHFETFYTGERWNDDDNTEKLDDYWIFNASATKEIGEHAEVFVKVDNVFDKKDVKDEDYVIGREFFAGVRMNL

SEQ ID NO: 1287 - protein, 804 aa, Marine gamma proteobacterium HTCC2080
MKLFILLFTISLSAFSQQSQNTISGKVVDNLGQPILGATVSLPSNTKVALTDANGLYELRNISEGTFVVTTSYMGFASQSKEVSFNKDGAKTVVLNFNLSEDVKSLDQVLVQGKSEKAKIETSGFAVDVVKLEEASLRNIQTNELLNTTVGVKIRQNGGLGSETNYSLNGLSGNAVRIFIDGIPIATYGSSFSLNSIPTSMIENIEVYKGVVPGHLADDALGGAINIILNKDAKTNLNASVSYGSFNTLQASVNGLYRFDDSGFTVKGSLFHNSSDNDYEVSGRSVVVTGLGGTQTPITAKRFNDAYRSTGGMAQVGFTDVKWADQFFVGVTGSDDYKEVQHGAFMTITPYKDRFLESDALLANLTYQKKNLFTKGLDVNVNGAYGKRNRVVNDTVAWAYSWNGERAVDFRGEEYQYIWGSQQEGGPTLATIKRKVASIRSGVSYEINEHHKFLGNHVYSGTDREDSDELKSVLENAFVGTRDLRKNIYSLSYELTALDKRLKASVFGKHYQQKTISNDPSIAQDSEGNDIIVDEIVESNNTNNGYGFASSYAITSNVILLASAEKAIRLPDETEVFGNDGDNVVANSSIKPEQSENFNLGFRFGRFNINKHGFTISTNVFTRNIKDRIGLPIETSLNIDDELIVYVNQGSGTSKGIDAQVNYSYDNNFGLNFNVSRFDLQIESNGVEVEVPNTPFFTMNGGLRYSFENLLQKESRLNLFYNIYFTDEFSYLPSQGTNTVGDEFFAIPQQLSQDIGISYAFPNKKLVASFDVKNIFDEALFDNLSVQKPGRAFYLKLNYSINKF

SEQ ID NO: 1288 - protein, 256 aa, Marine gamma proteobacterium HTCC2080
MTGFAVALSTAAYAADLPTPVIEHIPEVPAVGGWYLRGDIGYKIYQAPDIKYGTLDFYDEEMEGTFMMGAGVGYKFSDHFRTDFTIDYEFPAEAKSKGPCNLCGSPGYSVEKADIDVWTFMLNGYVDIGTWNRITPYVGAGVGASYVTTSNINFVNPNGVAGTYEGDSKWNFAWALMAGASYDITPNLALDAGYRYLNIGDAHSAKFSTAGQNTRIEYEDLQAHEFRLGARYTFNTMAAPAGPVYYEPQGPITSNF

SEQ ID NO: 1289 - protein, 402 aa, Marine gamma proteobacterium HTCC2080
MIFLPRNPSDCAGCRQGKLFFRLFLWKAVFGTTNTQKGKRRVKKTLILSACAVMLGSSAYAGGLDRSGQSMSILFEKGTYAELSFGMIKPTASGVGNGTVNTETISNVANNYSQTQLGFKTDVNDQLSYAIILDQPFGSDTAYGATGVNFGSTGAKINSSAITTMLRYKFSDRISVHGGLRAQTINSDLSLGGAGFGGFGLLYAATFASNMGLGYSVGAAYEIPEIALRVALTYNSKVKHNFATTENGASTGITNVETPESWNLEFQSGIAADTLVFGSIRYAKWGDFDVIPPVFGADLADLDDSTTYNIGIGRKFSDKLSGSISLSYEKEGDPLVSPLSPTNGKLGIGLGLKYTMDKVEISGGVSYTKVGDANPKSGTNVAFANFSGNNALAFGMKIGYRF

SEQ ID NO: 1290 - protein, 870 aa, Marine gamma proteobacterium HTCC2080
MKSKFFTLSTIAAGLIAASASPALLANDASSELERISVTGSYIKRAQNEDATPLQIIDASDISASGEITLTDLLRDLTVNTGNSYDEQYTSSFSAGSASVGLRGLSPKNTLILVNGQRVSNYGFALGTQDTFVDLNALPLGAVERIEVLKDGASAVYGSDAIAGVINIILRNNVQSTQFRAGVGGASEGSLTQYSAGVISGFGDIAGDGYNLTFSYDYLTRERLNADDRDFTRSGDFRDKPGGRLSGWSSQGGNYLSDPQNPQAFENCPGISEKRDRSDFTPGADGQVCAFNAQPYNTLQPEVERHQFSLQGTLQLTEDIQAYSDFLYSNNRSSHVFGAPLSVGAGLRAYNEETGSLVDIPVELPVGHPDNPGSEALPFEYTFFDVGERVKANKQDFHRFLAGVNYRGLDWDWSVNVLNSQSRQREYVDNFINRYTFEDMLASGEYDFFNGNNDPATIEALRIDTRRPGFYELNSINANASTILKELDNGPLSVAFGVDWREEEMDAGTSPEVLSGTELRPAINLVKGKRQVAAGFVELDVPVVENLNVNLAGRYDHYDDFGSAWSPKVAFHYVLGDDWLLRGSWSRGFRAPSLPEIAESNTISYGSVIDPNDPINPGASRGFTQVRTGNSELDAERSTNLNAGIIWSPQKGASIAVDVFEIEQDDIIAPDNAQFIVNNEGLYADRIQRDDAGRLQIISNQYRNQGTRSTRGFDIDANYQVQLNNSTLQFQSTWSRLLEYKQALVAGQEPTDGAGSNILGALPKWKGNNQLRWLISDWQWGVSLNYTSSYEQQVATQSSNPGLDEKVDSYWQVDSQLVYQGFGDTQLTLNISNLFDEQPPFDPAGGAYGYDMTQYNLRGRTANLSIVHNF

SEQ ID NO: 1291 - protein, 452 aa, Marine gamma proteobacterium HTCC2080
MRFDNNKNPARILSLSVLLALPIAALGEEGFFEGSSFTLLNRNFYFSQDFRNGDRFRNAQTGESKHFRADWAHGLIATFESGFTPGPLGFGLDVRGLYGIKLDGGDGRVGDGIGGPGLIPRHGHDFDGRPKDQFGKVDVELKLRLFEDTELRYGDVRPLSPVLNTSDIRLLPQSFRGTLVKNTSVKGLTLQGGKLESSSDRTATAHNGPLGTAYGGRFEEADDFVYGGIDYNLDDRLLLRLHHGRLDDVWNQSAFYADWRQPLGEGLSFNAAFRYYRTRDTGKSLLGDLDNDSWSLQAGIGVGAHAFSIAHTRIDDDSPFDYVWHTWDFFLNTNSQVSDFNNPNERVWLFRYDYDFAALGIPGLTLIARYVRGTDIDGRDVGPAYAAYQKVRDGRHWERNFWLSYVVQSGPAKDLSFRVMQATHRVNGDHTAEADIDELRLILEFPLDLRMF

SEQ ID NO: 1292 - protein, 265 aa, Marine gamma proteobacterium HTCC2080
MLLLAGKRPYNPSNSFFISGSIMSATDRYSHQLLYATVRQRLLDDIAQGVYQAGQQIPTENELCTQYNVSRITIRKAISDLVADGVLIRWQGKGTFVQSQKVENALLTVSGFTDFGVSQGKATKEKVIEQERVSAAPFCEKLNIPGNSEVFHLCRVMYLDKEPLFIDSSWIPLSRYPDFDEIYVEGSSTYQLFQERFDTRVVSDKKTIDIFAATRPQAKWLKCELGEPLFRISKIAFDQNDKPVHVSELFCRANRITLTIDNKRH

SEQ ID NO: 1293 - protein, 823 aa, Marine gamma proteobacterium HTCC2080
MPMRNTNLPANPCVTGTCRSQALLRQIMLLACLSMAAAFVPVRAQSTTAPVQPQASLRYDIPAGTLDQVLNHFAADAGITLSIDGALTAGKHSSGLSGSYSVPDGLKALLAGTGLEAVATPGSGYVIRRATAATITTSGTVLPTVTVAGHRAAIDEAPPLYKGGQVGSGARMGVLGNTAVMDTPFSVTSYSAQVIENNQARSVADIAAMDPSVRMSSARSNINEDLTMRGFSVSSADFALNGLFGLTPYWRAPLESIERVEVIKGPSAALFGMAPGSSVGGVVNLVPKRAGDTPLMRITTGITSNSLFGGHADIGGRFGPDNVFGARLNVMHRGGNTTIDGQSTYQSLGSLGLDFRQRSLRASLDLLWQQERINNVVRQFQLSPGLTAVPRVPDNTTAYPGYGWTDGRNISWLFKAEYDISQAVTAYASYGMRKLNWGAIAANPILLNTAGDYSYAGGWQRMPTRTQSLEAGMRGVFATGPVSHSTALGFTWLDQSQELGFYTGLPPGISNLYTGQLFSTPSIEGINNLARPYLDTQLTSVVLADTMSFWDDRLLASLGLRYQKVEGQSYNFATGMASGPRYDKSAITPVVGIVFKLRPSLSLYASYIEGLSKGDTAPISAAITNPGEIMSPYKSKQKEIGVKFDQGNFMTTLSLFELTRPSAGISGTTFGVFGEQRNRGVEATIAGEVVRGVRVLGGASYIDAVLSKSVSAMLKGNKAIGVPEWQANLGAEWDVGFLPGLTLTGRMVYTAKTFVDATNTLKIPDWVRFDAGVRYAARIVSRPVMFRLNVENLLDKDYFGAATAGYLFIGTPRTINFSASIDL

SEQ ID NO: 1294 - protein, 706 aa, Marine gamma proteobacterium HTCC2080
MAAACGLFATGATSPVLAADPAPPAATSIQRLPAVQVDAARVRGVDDFDLPASFTVVAADDDNRRGAQVSELLDGIPGLVARDRQNYAQDTQLSIRGFGARSTFGVRGVRLLVDGIPASMPDGQGQLSHFNVLGAQRVEVLRGPFSALYGNSSGGVLQLWSADGEPDDPWRLRATYGSNATVNVGAQVLGQQGAVHYNLAANHFDTDGFRAHSRAKRDSVNAKLGFDLAEGRRLDLVLNYLDAPDAQDPLGLTRAQFNADPAQATSVATQFDTRKSVRQSQAGAIFTQRMDDQTLRLMAYGGQRSVEQFLAIPVAVQRNPLHSGGVIDLDSNYEGADARWAWQGEALGRPLQLTVGTNVDRQRQHRTGYENFVGDTLGVKGALRRDQRDEVENVDQFAQLWWQWSDRWSALLGVRHSDVRFASDDHYIVGRNPDDSGRRDYSATTPVAGIVFRADENLRFYASVGRGFETPTFNELGYRSDGGAGLALDLGAATSRNYEVGSKWRAQSGAALEFTVFRADTDDELAVASNTNGRSTYRNIGATRRQGAELSWQQPIGATQQLQLAYTFVDATVRDGYLTCASSGCATPTAAVASGSRLPGVPRQQLFARWQWQPAQWQLAAESVASGATVVNDLATERAPGYALVNLEASRRWSTPQGALRTFARIDNVLDRQYVGSVIVNDGNGRYYEPGPDRTYTVGLQWDFGG

SEQ ID NO: 1295 - protein, 709 aa, Marine gamma proteobacterium HTCC2080
MESAIILIYDLPQPSPMPIHALQPARLPLAAALALCLLPATRAFAQDGATTLDSIQVSGSWLGTGLHDSVKSFAGARTVVDRQRIEASGAASIGDAMRRIPGVQVTDNSGTAGSSVSLNIGVRGLTGRYSPRSTVLLDGVPLAVAPYGQPQLSFAPTSLSNIESIDVVRGGGAVRYGPQNVGGIINFSTRAIPTGAGLHGEAGVRYTAYDHGGGDSTQYNAFLGGTGGNGLGAALLYSGQDGRGWRQGSDDRFNDLALKFAYAIDEQQELRAKLSYYDVRSLTPGGLTRAQYQADPFQNTRPTDFWKGHRTGIDLGYTNTLSANSEFEVLAYYNESSRASSLINAANTQLTVQPRDYRVLGIEPRYTQRLHWGASVHDITAGYRFLRERGNDRSYTVTRRTGVASATTRFDNATDAHAFYIDDRIAIGQWRITPGVRMEWIDMDRRQAGGTATFSSRNDKALPSLNIAYLLTPQLTVFGNYTTSFGPVQNIQLNSQTASNPLNPEIAKTTELGARWQDGALRAEVTVFKMRFDNQILQVPGITPPTFQNIGATDHKGVESALEYHFAEDSALAGLELYANYTWTKAIQQSGDNRGLDVPFYSRDTDSVGARYALAGWTFNVSSTHQSGQYADAANTWAESADARVGRVPGVRLWNAQVAWQVPGLGDSEIALGVNNLADKRWYTRNVDGNAGRMVAAPRTFYVQGRYRF

SEQ ID NO: 1296 - protein, 700 aa, Marine gamma proteobacterium HTCC2080
MLSKKPYTAIILLPFALSASQITLADTESVSLDELVIQTSRSNTKKEDSPQVITVITRQQIEDQLSISSDSSQVLSSLLPAYAPNTQKLNDSSQSFRGRSVLYMIDGVPQSNPLRDGSRAAHTIDLAMVERIEVIHGASAIHGLGATGGIINFITKSNRSNELKQHVDVQLTTPTDELKSDSLAYKIGYQVEGAQDNFDYLVGLTNEVQGVYLDADGDYVGSDSTRGDTMDSKSYDAFIKLGYWLTDDKRLELEVNKYRLKGRMNFTGVNGDRSNGIPTSSIKSTPRGLAPYNDVQTTSLAYTDSDLDGMEFKAQVFHQDFEGRYGVSKSGSFQDPSNGITFDQSQNQSEKIGAKFSLTKDDLLDNDLSVTAGLDLLQDTTSQTLILTNRTYVPETEYTNYAPFVQLEYRPTDRLVLQAGARNEHAKLDVDTYQTVAANNNVTVNGGKPSFSDTVYNAGAVFKITPAISVFANYSQGFGMPDVGRVLRGVNTPGQDVDSLIDLSPIVTDNYEVGFRVNRHPYDFELSYYESNSDLGSRIEAVNGLYVVKREKKEIQGAEASLGFQLNKDHRLQASYSFIQGKSDTDGDGKVDTKLTGSDISPNRLVTSWNARWSDKLSSLLQINHAFDKSFDDKKLEFDGYTLIDASVGYKLPVGKMSVAVSNVFNEDYFTYYSQSSVKTDDLYFKGRGRTVTLAYGLDF

SEQ ID NO: 1297 - protein, 342 aa, Marine gamma proteobacterium HTCC2080
MATAKKITIHDVALAAGVSVSTVSLVLSGKGRISTATGERVNAAIEELGFVRNRQASALRGGQSGVIGLIVRDLSAPFYAELTAGLTEALEAQGRMVFLLHGGKDGEQLAQRFSLLLNQGVDGVVIAGAAGSSDDLRRMAEEKAIPVIFASRASYLDDVDTVRPDNMQAAQLLTEHLIRNGHQRIAWLGGQSSSLTRAERVGGYCATLLKFGLPFHSDWVLECTSSQKQAAEAITALLRHNPTISAVVCYNETIAMGAWFGLLKAGRQSGESGVDRYFEQQVSLAAFTDATPTTLDDIPVTWASTPARELGITLADRMMQKITHEETHSRNLIIPARLIAAK

SEQ ID NO: 1298 - protein, 273 aa, Marine gamma proteobacterium HTCC2080
MEFMKKFVALGLLSAVLSSSLLAEGDGVYIGTNYQLGQARLNSNIYNTGDCTGSVVGCPPGLTANKYNPGHTNINWHAKYANGALNGLGLNVGYKKFFQFKSFDMTSKWFGFRVYGLFDYGHATLGKQVYAPNKIQLDMVSWGVGSDLLADIIDNDNASFGVFGGVAIGGNTWKSSAANYWKEQIIEAKGPDVCTPTYCNPNAPYSTKTSTVAFQVWLNFGVRANIYKHNGVEFGVRVPLLINKFLSAGPNATNLYYHLKRDYSLYLGYNYTF

SEQ ID NO: 1299 - protein, 405 aa, Marine gamma proteobacterium HTCC2080
MKKHNIIAMALTSLMALPVIAQDSTPAVGDILQGINMFTPEEGDPACKVKANEKYGTQWGVDMAYGLWNTEKVSDVKRHNNLALLHAQLNQRLIEDKANGGTWLRVEFSGSWGLDRESAQSDTFFTEAYATASGLHADAMGPHEGIFPEVALMQYFAGKRACLIAGMVNLTNYFDAVSIANDSFSSFTNDGFVNSTILPLVDSNIGGILQVELNRNNYMMVAVSRTGCDSGYNPFNSDYCDGYAVVGEYGHIFADGAATLRINPFYTSTDVDMDDGTGERRRQNAGLVASIEYTPCDPLTIYSRAGFAAKQYLSNSAEFSVGANIKLFPSREDDFLGISYGVFKGQTPCDGERAEHNREQVLEVMYSFQVNDYFKVVPHFQYIANPAYSTSSENILWGVQAVFSF

SEQ ID NO: 1300 - protein, 788 aa, Marine gamma proteobacterium HTCC2080
MLIAQKETCGYSLNGKVLDAYTEEPIPNAVIKVKGIERYTTTSAEGTFKIDNLCTKNNILIISCLGYTNLIEDHEHDSAIHFYLTQEVTGLNEVIIQAKRRKEKGTETISQVTIGKKEITSNPTQSLAAVLSQQQGVTFMSTGTNVQLPVIHGLYGNRILVLNNGLKHGFQNWGADHAPEIDIASTNSITVVKGAVGVRYGPEALGGAIIIEPNPSLLNNPFYAALGTGYQTNGKGYNTNFEIGNGTENWSYFANGNYTRIGDRNTPGYNLTNSGKEEKAFSFGILHHLDTWDFKVNYSFVDQKLALLRASIANSPDSFIRAINSNEPIIINPLSFDINQPNQKTQHHLAKAEINWWYTKGAKLTLIVGVQLNKRDEFDVRRNAELPIINLDLLTYDYQLEWKHPKWHGLNGLLGAQYFSQNNDNNPGTQTTPYIPNYNTDRVSAFAVESLTFGKNMIEAGLRFDLETNDVRGREINQDIFRDNYTFTNFTGSLGYVRQLSENSTFRTNIGTAWRTPNMEELFSFGQHGFKTTFGLLRFKDTNGKLSTDEVIPLNQSTVNPERGYKFINEFQTNKNGNSHNLTVYSHFIENYVFDRPIGVFGTIRGPMPAFIFDQVDALFFGADYSWKKEWTDKVSSIFGASYLWSRNVGDNAPLINQPPISTTIELKWNQGKVGFFDSSRWSIRPSYTFRQSQAPRTITPQSLVDGSVELTTSSEIFDFAAANDGYFLLDLSWTFKRKNLSGGITVQNLLNTRYRDYLNEMRYFANESGRNLLFTLKYTLKKNAKNE

SEQ ID NO: 1301 - protein, 716 aa, Marine gamma proteobacterium HTCC2080
MKQVLPPSQTISRLVASVFPRAHRSRLLHASVVFCMASGMAYAQEATTQVEDTVVIKAKALSTTDKAKVRLESVTGNVSVVKNADVEKGRSSTLEDVLAFEPGVFAQATGGNDAIKISIRGSGIATAGGVFREGTSFLFDGLALTGSGGTPYELLEMSGIDYTEVLRGANAFQYGALALGGALNLVTHSGRTSPGVYGRFEAGSFGWRKQQLSVGGVSESGDNDYYVSVTNSERRGYQKWTNVEAKGIVGNFGFRLTPQLETRLYLRYREEYHQNPALLTIAQMKADSSQTTPATVSGRNDGTKPGSTFIGSKTTYTIDDISKLEFGLVYHDYPQILNINSAATPNYWTWRDINASLRYLRSEQLFGLQSETAVSFTRTQAINSSVKTYNGTTRALKKYATYDSSSDTVLAVGNELQLNPRTWLSTGLSLVDVRRDVRTLYADIPAGNAATTYNHLDLAPRLGLRYELAPKVVAFANVSRSIDPPVTWGFTGSGTTSTQIGVKNLTEQKANTVEIGVRGSNDTFSGSVALYRSEVRNELLTAQIPGGLPTDTEKRNATPTVHQGLEAGLDARVWKGKGGDNVVLRQAYTYNDFHYKNDPVYGANELPGLPKHVYTAELQYQHPSGFYAGVNARYSSKTWIDYANSLAAPNYTIFGAKFGYDQPGGKWSLFLDLRNLTDKAYASAISPQYNLRGLDNTGAIYVGDGFGAFAGASYRF

SEQ ID NO: 1302 - protein, 199 aa, Marine gamma proteobacterium HTCC2080
MGFACRYLFFFIVLFASGSFGNQLLSVPCWLSEEESFYTHRFDFSKSYPDMENMEIQAQRKKRVEFNLTGEFPKLETLNYQGSFGHLRAKCRGVYPVLYALNFSCSSCKMDMDFRGKWNRSSTITISNQKESINLKLPKDVGVIVNTKTSLKGNVCPGSTFIKQGWGVWNKIYHNDLVGFSEVTLIFNVSSEGGTITFS

SEQ ID NO: 1303 - protein, 150 aa, Marine gamma proteobacterium HTCC2080
TDHTEDGPQIVGDLLFASPDFLEPIWSPRPFLSASISTQGYTNLVTAGLAWDYGFTDRLSGEFSFGLSYNDGVLEVYPDRDGPVEAQRIKDTRALLGSDWLFRTGFALDYALNDQWSAGVFYEHHSHGQILGSGRNQGLDELGLRMSYRF

SEQ ID NO: 1304 - protein, 787 aa, Marine gamma proteobacterium HTCC2080
MNKRNRMNPLLFAMCTAGFCTWNTITAAYGANSGSQSTSVGEVNASASALSESAKALASTDGKLTRKKIFKSTQSQAVVGKREIQGVGPAAGAAQALSLAPGIAVRGYGGISSTARYEIAVRGVKVGWSSVNGDVERNGLTVLFDGIPMNNLISHNGGWDSNEIPILQMIHGINVTYGPGNPAGRWFDSVGGTINFVPLQPSVKPSAEIGTTFGSNGTLGYNFDLKTGMYDGWSAILAGGYTKNNTFRTGTFNAPSQSLAYFGKAVKTFRSGTFSLGGYVDSSREFRPNFIPVTPIQGITTQGLNANAPLYSQQTSGFYASLPESIWFKQLKVQGYMLYSKLNLRLSRDVTLHEMAWYRHGHRVHYRITNFVPGSSVNSEYYNPSSDTYGDKLYFDWRLPMNLVKAGGSWIHQQYTTPYAGYNTLLGTSPSFPIQYNSDVLYNNYLTGFVQDTFTPFSGFKITPGIAAVQYQTQMYNNGAQAFPNLPAGAQNQTLINSASDTISRLEPSIGVRFAPVKWGSVYAHYGRSYQNPTDNNYGAYNGNGGTIDLNSLKPVKSTDYEVGAKFLVHNWMLLHNFTFNVNYYHDSLANETIATFLSNISQTKFAAADAVVNGVNIAMADNPSWNWHLFANLALNHSYYTSYTPQGGGTTLYGANVSYSPYLTMSAGIDYRYYYHGFLFSPQFVDQYTSSEYLFNNGTGAPSHQKQPGYNVSNLSLGIKTTRLNPYIPTLKDVKLSVGIYNLFDARYNPIEYITSGGYFGGNSAGAILADPGAPRQYFMTVSAKF

SEQ ID NO: 1305 - protein, 2477 aa, Marine gamma proteobacterium HTCC2080
MLRATHNIIYALKNLVTEYRCLSWCRLFLGGFLALASFGAMAVTPSDQNFNSEQERFLNPNGETIAGATYRLVSPAGVLGLTQVPSSISITPDSSDLAVMFNFEGVNITAGALDARISSADGTQFRIVSIEVDTGAGLGTSPNLTVTGYRNGVSVASDSVNTGISDSSGSVTYAKNGVGGGFGGTLTFNSDWQYIDEIRFTGTDTIVVVDDLDFEDGIPPFPTITSATYNASTGVLVVTGTNFTATVGATNDVVANKFTFTAEGGSTYTLTDSANVEIASATSFTLTLSATDRAAVNLIANKNGTSSTGGTTYNLAGAAGFIAAEPATADLTGNGITVSNTAEPTVTSATYDASTGVLVVTGANLKSRSGASNDIVANRFTLSGEGGSTWTLTDTANVEVTSGTSFTMVLSATDRAGVNLILNKNGTNSTGATTYNLAAAEDWNAGADAAVTIADLTGNGITVSYVAVPTITSATYNASTGALVVTGTGFLSRAGATNDIVANRFTFTGEGGSTYTLTDTANVEITSGTFFTLTLSATDRNTVNLLLNKNGTSSVDATTYNLAAAEDWAAGADAAVSVADLTGNGITVSNAISVPDAPTIGLAIAGEGQVSVAFTPPGNNGGSAITGYTVTSNPGGITGIGAGSPITVTGLTNGIAYTFTVIATNAVGNSIASAASNAVIPKGNQTITFNNPGALNFGTTPTLTATSSAGAGYAVSFSSATAGVCTITTGGTLTFVTSGSCTIDADQPGDAAVNAATTVSQTFMVNAVVPGAPTIGTATAGNTQATVAFTAPTNTGGTTITGYTVTSNPGGLTGSGAGAPITVNGLTNGVSYTFTVTATNSAALTGAASTASNSITPAAPQTITFANPGAQTYGTSPTLTATSDSGLTPTFSSSTTGVCTITSGGVLTFVTAGTCTINADQAGDLSYLPAGQVSQSFTVNAAVPGAPTIGTAIAGDTQASVTFTAPVNTGGTSITGYTVTTNPAHVPPVNGAASPIVITGLTNGQGYTFTITAENVAGSGPASVASNSVTPKTIQTITFNQPGAQNFGTTSTLIATTDAIGLIPTFTSSTPGVCTITSSGLLTFVAAGSCTINADQAGNAGYLAATQVSRTFTVNPVVPGVPTIGTATAGIAQATIAFTAPAFSGGSMITGYSVTANPGGATATGAGSPITLSGLTNGVSYTFTVSATNIVGTGASSSVSNAVVPNGAPTISGTPALSINQDTLYSFIPTATDTAGDTLTFSITNKPTWATFEPATGALTGTPTNADIGITNGIVISVSDGTLSASLPAFSITVVNVNDAPSITSVAITTATQDVAYSYTLVASDADTGDVITLSAVTKPSWLTFNAASGVLSGTPSNADVGMHPVMLRVTDTDGLTAEQSFTITVTNVNDAPVAISSTVTLEEDSSVMITLMGEDVDNDPLTYEVVSQPESGTLAQHGTVWLYTPEKDFNGADQLSFIAKDAELSSEPAIITINVTPVNDDPQAVDDAYTLTRSVNDIYTLAVLENDTDVDGDTLTIDGAAADIGSVQITPDGLTFTAPEAYVGPVALRYTISDGNKGRSTAKVNVLIDGAESDNQPVITLPDDVEVNATGLFTRVKLGFAKAVDRNGKALPVSLVNQSLFFAPGNYLAYWQAVDSEGNKAIKAQKVKVHPLISLSKDQIVGEGNEVIVTVHLNGVAPDYPLSIPYTVSGSASSSDHDLVSGVVEVTSGQEAQITFRTVEDGEVEGNEDVLISLDPSLNLGSKNQTQVLITEANIAPKVSLEVTQAGERQLIVAQNGGDVRIDAHISDANMQDSLTSVWESGALDLQSDNQGMFFSPAAVLPGIYPVSLTVTDDGSPALSTTEKVYLVVRPTLPVLTGADTDGDLIPDDQEGFGDADRDGIPDYLDAISDCNVIPESELQPVYFLAEGQAGVCLRLGNTALIEGLSGVQLQPNQVATDSIAANVGGIFDFIATGLPQQGQSYSLVLPQRSPIPANAVYRKYQAQHGWKDFVIDARNSIASSEGERGFCPPPGDSRWTPGLTEGHWCVQLTIEDGGPNDDDGVANRTIVDPGGVAVVLNGNHLPVANPDSVSLSWNQSIDVDVLANDTDSDGDTLTVTQVVSEFGTVAILANQHVSYTAATDFVGTDVLIYSITDGKGGTASSELTVIVSGNVAPIAVNDSATTDDRTSLLIDVLSNDSDPDGNSLTLISATAQQGVVSVESNKLRYIPKTGFDGVDTVSYRISDGFGGEATGQVFVTVKAYQDVVIDNKSGGGSVSLGALILLLAGGLIRRRAWHLLSVVLLLVGMVNPVNAANEGYWYAEGFIGQAQVDNGKRVLQPQAGAGAVTSVDTTDTAIGVSVGYQWTPLVAVELGYADFGNGSARIEGASLTPEQYHEQVKGVTPVLADGVTLGLRFTLLQHEAWRFEVPIGLFRWQADISSTMGNSRLTTALDGTDWYAGVRFSYQFTESWSVGLGYQYVDIEPNDFLSYQLNLRYQF

SEQ ID NO: 1306 - protein, 768 aa, Marine gamma proteobacterium HTCC2080
MSTTKFVVSPLAGALALVISLPGFAAPAPAPAPQAKDVEGLEVHGQRIQKASSGKYTANLRDTPQSITVIDRDTIDGQNLLSLQDILSTLPGITFGAGEGGGGFGDKINLRGFDASNDITVDGVRDSGMYSRTDPFNLESVEVVNGANSVYSGAGSVGGTVNLVSKSAGLNEFHKASVAAGTDAYARFTSDSNFVFGEGTALRLNTMAHQNDVPGRDVEENQRWGVAASLGFGLGSDTSWTLSYLHQKDDNTPQYGLPFFNGDVLPGIDRGNYYGYSNIDRQEIELDAVTSVIEHSFNERFKLRNLTRWQQADQFSLVDAVQGTWCLGNNLTPTGASCGSTRPGNYTPSGPRGYGRDTRNTTLYTQTDLTATFSTGAIEHNLVAGFSVLHEKFDLDVTSDFRNPNGTNPFLAGLPQMNIANPDHIYRGPLNRTLTGRTEGELDNRAIYVFDTLKFNEQWQLSLGARYERNEGKTSIANVVLAPTAANQPLPAQPIGTVTGYGVPFKNNDDLFSYRAGLVYKPVENGSVYVAYGNSKTPSKASVNGSCTIETCSVDPESAVNYEIGTKWDFLDGRLALTGSVFRNERKNYKVADPANPLNPSGLQQLDGRARVDGVMLGLSGLIADNWAVYANYAFLDSEVLQGASNRQSQLGLDYTRGDRLLNVPEHSFSLWTTYDLSPKWQIGYGATYQGKIWLTQHSATNLNGPLTTYGSYWTHRAMVAYKINRQAQLQLNVNNLTDEEYFTRVRNNGWATPGDGRQVVLSANFSF

SEQ ID NO: 1307 - protein, 872 aa, Marine gamma proteobacterium HTCC2080
MNNRSRNILLAGISTVSVLLACGVNAYAADVPDAAPDATAELDTLIVTARGKPRTVLDSAVPVDSFSEADLKASTFTDTNDILKTLVPSYTLAREPISDGATFIRPASLRGLPTDKTLFMVNGKRRHRSALVSIGGTGAQAPDAATIPASALKNVVVTRDGAGAQYGSDAIAGVIDFQLKDSPSGGSLTAQYGQYYLGDGEDVLLTGNLGLPIGDKGFVNGTFEYTSQNQVNRGRQYCNKGIPNQSAGFCVADYAATNPAYGALIHDYVQKWGQPDAEATRGVINAGYEFSEAVSVYGFANYSKSSATEYFNYRPPVSNAVNATPIRKSDGSLFQFSSIFPAGFTPMFGGDITDYSLTGGFKGKFASGLTYDISGRYGNDKLSYTLWDTVNPSMGPDSPKSFYVGSLISTETAANADFAYDWGVGGFATPITINFGAEYRKEGYEIEAGDVPSYKAGTWAVPNPFGFCDTTTHTPTAAATATVLANGLNCANYKSDATDGFAGIDPVYNALAVGSNGAPGSPPDYSGKLTRDSYAGYVETSANITEAWFLDLALRGEHFSDFGGTVNGKVATQYQINDKFGIRGSIGTGFRAPTPGQLFTTNVSTRVENGAIIASGLFPATNPVAQFMGAKELKPEKSLNIALGFTATPIDNLSLTIDAYTIQIDDQFYTTTPITVTDTIRANLIANNIPGASTIGQVQFYQNAFDSTTTGVDVVATYKVDWENGQSTAFTASGNWNSFVIDKVFSNKFFDGEGVYDFKHAAPRWRSVLSATHEVGKFKAIGRLNIWGPYKNMFSVANPVIQKFDTEAFVDLELSYKATDTYTVSLGARNLFANYPAIDKTGESATNGRLYRSDSIVDWQGGFWYLKASATF

SEQ ID NO: 1308 - protein, 247 aa, Marine gamma proteobacterium HTCC2080
MKIKIVSAAVLIGLTSVAAHATTINIRHEYVPEYDGQDQENKDRIEVSHRFANGIGFGVEAKWGSAKGAGPFDELSGNGQQTNISYRYKISDTLTLTPQYKWESGSDKVGHQFNLSLGYKVNDDWSVGFRHRYHYDKLADKAKQNSHYNRWTFSTGYKGIEDWGFGASVDYTFNQESSGPRWKGDKSGFSEVNFTGEYKGFKSGWSPFAEVGMKPYKSGDTYSYKGAQVKSNDSWRPVYKIGAKYSY

SEQ ID NO: 1309 - protein, 824 aa, Marine gamma proteobacterium HTCC2080
MFRHHALGGVSVVALQLALLQPATIAHAQPAGELPSVTVDAPRAAPQRPARKPAGQARRATAARASKPAATPQPAASPASTANIDGGGVKGSFETPAAKQRFALPQESFSITAKQIDETINLKDPEDAVKYMPSLFVRKRNDGDNQAVLATRTWGLNSSARTLIYYDDLLVSTLLGNNNSAASPKWNLISPEAIARVDFLNGPFSAAYPGNSIGGVLLITSKMPDKPFATVKETVSVMPWSQYGTKDTYVTSQTSASAGNRDGKLSWLVSANYLDSYQQPLTYTTISSLTSIPTTTTGAFPARSKTGTEADVVGTGVLAHSQQTSGNLRLAYDVSPLVQATYSLGIWNNHQVSTPQTYLRDANGQLTFNNISTFASGRYIWDQTQMSNAIALKSDTRGTFDFDLSASSYNYLQDAQLNPYTVTATGTGYSQKGKIARLDGTNWQNADAKGIWRPFGYDGPHEVSFGLHGDRYRLENPTYATTVWDQATSTGTGQLYATGVGETRTGALWVQDAWKILPDLKLTLGGRLETWRALDGFNVNTIQSAAGAITQSLVTTQPQLSATKFSPKASLSYDLNRDWNVTANFGEAYRFPTVGELYQNLAVGTNIFLPNPLLKPEHDYTGELNLERHWSDGRVRLTLFQEKTFDALISQSTLVTNNTNGQQVTQTAVSNVDAIRMRGVELSADKDNVLVNGLQLFGSVTYVDSKILADAKWSAATTVVGKRVPYVPDWRAKFGATYRPNESWAYTVAARYSGKQYSTLDNTDIIPHVYGAFDSFFLVDMKIHYNATKNFAFDFGIDNLFNQQYTLFHPFPGRTFVLAAKYTF

SEQ ID NO: 1310 - protein, 364 aa, Marine gamma proteobacterium HTCC2080
MKNPLAGAIFAALAACCTAASAQDHVTLYGRLNTSMEYSDASTASDGTKLGGTGRLTNNRSVFGMRGEEALYGSLKAIWQIESNISLDTGSGQLASRNTRVGLAGSAGSFFMGNWTTAYLEATSSYDPFYPTTAGYMALIGNGSTPTSDNIQDTSAFDRRQKNSLHYRSPKWNGFSGGVTWGVNEERATVPRNPSLWSFAGAYDNGPLNVVLAYERHNNYQTAGRDDEGMKIGLSYQFPTTKVSAIYERLHYRTATGDLKRDAYYASVVQKLWTGSLRAGVGFAGNGRGNATETVGFFRSGPDTGAVQATLGYEYPLSKRTSVFGFYSRIFNKKNATYDFAINELGISAGADPQTFALGMRHVF

SEQ ID NO: 1311 - protein, 731 aa, Marine gamma proteobacterium HTCC2080
MQIKWKNIYKSCVALSALSIWAPSFVFAQNNDEGSVTDLKSIVIEGKQDLDPSSTVTILTDRQTAQNIEQKQVSDVHDVNRLNSSISYNSSNDSFIVRGLDANRVLTTIDGIPLPWLNDEARSVKGGNSTFDFNTLSTFDLIQGSDSSIYGSGALGGIIALRTLNPEDLLTEEKNWGSLTKGSYNSVDNSWQVDQAYAVRANQTFVLFQGSLVGGHERKNMGSIGDYGTKRTLANPADFDQNNLLFKVHQYFDHNHRLSFTAERFHYNKDTHVMNAPAIYFPESVHEENKKSRERFSLSYDYEGSQDTLLDAFHGQIYWQNQLNNHILSGNRVVSPKGNYLRDNQIRNTTYGLNTNSIKKVDIGTTTNTLQLAINIFESKFHQYASGKDNCHLPENARGCAFLHTNQSDAPDTNSRGFGLAFENEIDFYRYHVRITPGIRYDWYTHNPQETASYGKVPISQKLPSKSSSSHFSPKLRLEWDIHNQVALYAQWAQAFRAPSVSELYLNYINPSFYYRAGNPDLKPETSNGYDLGVKYGNMNFGGSFGAFINDYKNFIDLVDKGPSREFRLSREHYVNRAHVRIFGVETKAHWNLDNGLHSDFSLSYAHGKDLDKKEYLSSIPALKTIFGLGYAKEFWGLDFVLTLAAKNDKVAKKSSYREVPGYSLVDVLSWWKPFGKDGLTIRAGVYNIFNTKYWNASDLPSVSPRGESPLPKDYFSQPGRSFKVSFVQKF

SEQ ID NO: 1312 - protein, 738 aa, Marine gamma proteobacterium HTCC2080
MTFNLTPLLLLPAVLLASQLKAQSLSEDDIVELDAITVQGEKLGRTLQETQTSVAIHGREAIAQSTDASLFDVFERTANTFAKNGSFSIRGISNNGLTYSEGSDMATVLLDGAAVDAQMLQYDGLSVWDLDHVEILRGPQSTSQGRNSMAGAVIAKTRNPTFNYSGKFRATYGEDGSSQLGLAYGGPLVKDALAFRLSATKQSSDGAFFNQTLDTSDWDHQEQLTLRGKLLFEPAKWDGFSALLSYSHSENDAPYRVYSYGPDRQALYQRIAHENTPEITDATTRLASLEINKEMANGWLLTATNSWSDFFRSASYDGDRTPEEDLVYGFDSDNKTVSQEIRLLGKGENWNALFGLYAAEETRGYATDGPFYYTIASPLDAVFGLTPPAQALLSIIQYSKTDIANTAFFFNGDYQPNKRWTLSAGLRLDQEKNERDRNQFVELLEGFPNAVALIDVPSYGIPAGTPANVVLQSLVADATAEGLGDDEFDVALPTLGATYHLQEDLSLGFTFSQGYRSGGVAFNQARAEIVPYDPEFTDNYELSLRSQWHDRKVTLNANAFYVDWTDQQVSVQLSNDTFDRQVENAGASTYYGFEAEMRQRLENGWSLFQNIGYTHTEFKDFATSVDDYTGKEFPNAPRWTLGAGVSYQAPRDWFGTASLTYYSNVHAAPENDPDMTLGDRLILNAKIGYQKESWSAYLYGKNLLDDDYLNSLWEQNATTLAAQVGDPRQIGIGVDLHF

SEQ ID NO: 1313 - protein, 234 aa, Marine gamma proteobacterium HTCC2080
ATAEAVWQLEQDVSVAGGGATQWGNRESFVGLAGEFRTLRAGRVANQFDDASQAIDPWDSNNDVASQLGIFKRHDHMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKDTDLLKNHQVHRLTDGYEEGGLNLALAAQLDLSENGDKAKTKNSTTEVAATASYLLP

SEQ ID NO: 1314 - protein, 1243 aa, Marine gamma proteobacterium HTCC2080
MNGYQAVRIPLAAVAAMMAATASWGQVAPGATPESPPDDEVIVLSPFEVSAEAQSGYAAATTLAGNRLNTDLRDIGNAVSVITSQFLQDVGATNNETLLQYTTGTEVGAAYGNFAGLGDGANLDESGGGGTATRFINPSSNTRVRGLTSADNTRDFFITDIPWEGYNVDRVDMQRGANSILFGQGSPAGIINTASKQAGFKDSNQVTARYGSFGSTRGTIDINRVLIKGELAIRFSALYNDEKFKQEPAFSRDRRLYGALRWEPAFLKRGGARTILKANYEVGNVRSNRPRVVPPIDNITPWFYTGTYAGRNATNADTTYAGLNRETFIPSQLQDDNTGRPNHGQMRATWNFAPVSGNPNPYFQPWLGNFGQQFGGPLAFFDATSNAPASYRVYEPTFNFGLNSAGAIDRSVGGMPYQRPTSIAPYDQFARQARLPFYEFGIYKQRSLTDATVFDFYNNLLDGPNKREWQDFRHYTISLAQTFFDDRLGFDISYNKEDYKNGQLSLLSAGRQAIYIDINRVYGDGTPAGRDGEPFADGTPNPNVGRAFVSDDGQGGNNSYHSTWENARLTAFATHDFTRGGNRNWVTRALGQHTLTALLGKDRQTTDNRGWIQYATDDVYREFVNLPDVNAKFNNGAFVPSTVIYLGPSLISRNSASGAFLPRPQNISTPRSGTVRTFDSHWNRSTVPGNANYVDPAAAWNNEYYTPNNLRDGTPVGAYVSTQSENPGNYVGWRDVPMRLYQSEQGYRDYLTTAARLTKSTVSSKVAVWQAKFWDNALVGTYGVRKDVAKSWQHSQDLNSASSDRYGHLNLGSDVYRLNDDYDTRLDITSRSWSAVAHLTQFIGDRSPVRVSLYYSKSENFQPAANRVDVYGVAIGAPSGETTDKGILLETRDGKYSFKINKYETKSLNQTSTSLTNTWFIGASQVWSGNWVNIFEYDIRDGNNITGRDANPSPTNTRYNYGQAPGETLEDAQAREARVIAAWRTWQRSVDPRFYAAWQINLNDNTRDITSTNPNGFSVTEDSISKGYEFEFSALPTKNWRVTLNATKTEAVRTNIGGTNLTGFINAYETALRTTPAGDLRIWWGGAGNETALFQWNNNVGSEYAQRRLQEGTNAPELREWRFNAVSNYDFDEGRLKGFNVGVGVRYESDIVIGYRPIPSTVQGQANFDLANPFKGPAETNWDFWLGYTRKLTRNIDWQIQLNVRNAFVGDELIPVTTQPDGSPAGFRIRPPQTWTLTNTLNF

SEQ ID NO: 1315 - protein, 478 aa, Marine gamma proteobacterium HTCC2080
MTSATLGLALLAASAPGWAADEQENPPAPDNPSYAAEVQSIPSVAKPIKGQAGATGLVEGQSLTLTTRNFYSRENMKDSFTFRIPKAGGGSQRIHQRNAWVQGTVLKYSSGYTQGTVGFGFDVAAFNEIALERGKGRIGGGGNRTLANSDGEALGEWSKLGVANIRLRASNTEFKAGRFLVNTPVFSYIDNRALPSSFTGFAVTSEELDNLSLQAGSFRKVSPRTGSGDEDMTTEYGTRQVKGDRLNYLGGNYKPLDGLEISLYGSHFQDVWNQYYLGVTHDIGDLENGIALRTAFNGYHTGDTGAREAGYIDNDTWSLAFTLGHRAHALTLAYQQVDGNEYFDYVHETSAIFLANSILADYNSPNEKSAQIRYETDWSYYGVPGLSTGVWYVKGWDIDGTHYDGDRNGAYGNYAEVRAQDGEKHHELGLMAAYKVQNGPIKDSTFKLTYMMHKASQNQIDGSVNELRLVSTFPFNLL

SEQ ID NO: 1316 - protein, 364 aa, Marine gamma proteobacterium HTCC2080
MKKTQIALAILAGTLMSTAAHAQSSVTLFGLMDTGVTYVSNQGGKHNVKMDDGVNGPNLWGMRGSEDLGGGTKAIFELVNQYQLNNGAFMNGSSLFSRTSYVGLVNDRLGKFTAGNQYDFMTDSLYAGGNDPSSVSGHFYGFRAGPFQKLALPSNPTGAFDWDRMAGVSVNNSVKYVTPLFGGLSAGAMYGFGNVTGSVGAGNSTSFGLNYAANSFGANAAYTNVKTYTAGSPQVSVRNWGLGAHYGFGSWFTNALFTTVRNSANGGSVYEGSVGVQYKFTPALATGASYMYMKGNSVVNNNHAHQVAAIADYSLSKRTSVYVMGVYQRASSGGFAQINGMNSSDGASSGQPQAIARIGLHTHF

SEQ ID NO: 1317 - protein, 782 aa, Marine gamma proteobacterium HTCC2080
MNFSKRIAISTSLSIILSSSLFAAEFNIESGTLENAIKTISKTSNMTYLVDTRILEGKKVSKIENIEGIENALKEVLKGTNLEAVIKDNTIIIKKKDILGKGSVLEEVSVNETYSTASNSYTIKETSSAAKLDLSLKETPQSVTVITQKQIQEQNLQDLNEVLTQTPGVTISQMGQFGAGYTSYYARGTTITNFQRDGLPSSEINIGRFNGFVGLEDTAIYERIEIIRGSTGLTNGAGNPSASINYVRKKPTKDFQGDAKISYGSWDTYKGTLDISGGLNQDDSIRGRLVTSYSDGGSQQDRYNKENSLLYSALDFNLSDNTLLTTSITYQKTDVDNASPHGFSSVTTDPISQKQTTFGRHDNAAADFTYTNIERLNLSLGLEHYFNNDWKASANYSYTKTETERLYAVAGSSSFSYITGKMGGQMGYVERNPDTHSIDLYANGDFNAFGREHKLSFGVNGHQSKTDDPAEVRKAFSVDIDGWNGHIANKPVLPKATSRYVFDEKQIGAFTALNLELSDPLHLILGSRISNFERVNNKGTSTEQEQKYNGEVTPYLGLVYDINENFATYASYTSIFNPTSSAKDTSGNYLEPEEGNTVEFGINSEFYDGKLNSSIAYFITKQDNLAVTDAPNLTPEGNTASKSVDGVEMKGWDLTIGGEILPNWDMTGGYTYTDAKDQNGDRLNSGSVPKQTLKFFTTYKYNKLTLGGGLNWQSEIHSSTNNLNKQEAYTVVNAMAKYDIKKDFSVILNANNIFDEEYVLNTVGSQTWGAERNYTLSLNYKF

SEQ ID NO: 1318 - protein, 1027 aa, Nodularia spumigena CCY9414
MAWMLLFCVPCVTVTYAQSFTVTGTVTDSQGGIPGANVKVKGGTAGTITNMDGQFTLSVPSSKSILVVSYIGYTPQEVAINGKNKLDIHLLEDTKTLDEVVVVGYGVQKKSHLTGSVSKMDINNLTDIPVTQVDQLLQGKIAGVNIQNSTSEAGAAPQIRVRGMGSISADSSPLIVIDGYPTPDGLSTLDMADISSIEVLKDAASAAIYGSRAANGVILVTTKTGKASKPKYSVKASTGLKWAYKLHPIMSSQDYCSMIGYESVLKNKTMSQTEEAFGLIDNYTDWQKEGLNSSPQIHQVQLSVSGGKNDITYYISGNYAQEDGIMLNSNYTRLNLRSRINAKLSKRVDFSLNLAPSYTKTETPATNFMDFYRTPSFMPVRHTAATSALTGKPIGSYARGSDFSNVTYTREDGTTFTPSSSPFGSSNNNPRSLMDTEERFREDYNLQANASFNVQLMKGLVFTTSNGFFIKYRQNNQYRDYAAKKDEESAMGTYTNRLYIDLLSENTLNYTGKTGKHDYSVLAGYTAQTTSERTAGIVGLGFPTDYIHTLNAATSFDLDGTYTQKYRTAMMSLLARATYSYDEKYLLSASIRTDGSSLFADGHQWGYFPSVSVGWRASEESFLKQFGWLNLLKVRASFGVTGNNSIPANSYYDLLYPNNYALGEGNGNLISGLAKTSETKGNNRITWEQTYEYNAGFDLSILNNRINLTVDGYYSITKQLLFKQPVLSFTGFNNYWNNIGRIRNSGIEVELNTHNIRTKNFEWESSFNISSNFNKLLELSGEERLISTGERNETYLAQVGKRAISFFGYKTDGIYKSQEEVDAVPHLASAVPGSLRIVDINDDGVINDKDRTEIGNPFPTATWGFTNTLTWKGFDLYVMIQGVHGLDVFNGDGYFTETKKFNRNYVKNRWISADYPGDGKTPSFAANGGVAWEFTDYLIEDGSYVALRNVTLGYKFNKKQLKKIGISSLRLYASGQNLFYIWSKDYRGINPEARKTSGSYSSPLINGYQSGGFPLQSTVTFGFELNF

SEQ ID NO: 1319 - protein, 1068 aa, Nodularia spumigena CCY9414
MKQCKTLPFMFLRSMFVLFLSCLSVNTLGQSLTVSGTVTDEKGEPIIGASVLVIGTTNGSITNFDGIFTLNNVASNAQITISYIGMKSQTLSVNGKTSFKIVLKEDSEVLDEVVVVGYGTQKKVNLTGAVTMADGDVLEDRPIANVTQGLQGAIPNLNITFDGGSPNATAQINVRGTTSLNGGSALILVDGVETNDISLLNPQDIASISVLKDASSAAVYGARAAFGVVLITTKKGTKGEKVRVNYNNNFSWSSPSRLPEGINSSKWIHAINQASVNSGGNGDFSTELVEAIDRYNSDPVNNPSVFIDQTGKYTGIGQWAYAANTNWFEEFYKKSAFMQQHNASISGGTEKNSYYASIGYKGQDGLFAFGDDTYKRINMSFNFTSQLTNWLEITFRTKYNRNESDIPNTYDYMGSSPYHEVYRAFPFIPVYLPDGNFAAVAGSNFNYNIAGIMAQAGRDITSSDDFWYTGAFNITPIKGLSIKGDYTGNKFFKQQKKHQNILYQSQPDGTSIPQGSSNGVNNDKYNDTYQALNLWAEYKKTIKQHSFGVMAGYNQESKKITALKTKVSGLYDNNTPVSDLATTLQSIGEDATVWAVQGMFFRLNYDYLGRYLLEVNGRYDGSSKYKSGSQWGFFPSVSVGWRLSEEKFFEPARNLFDNVKLRASIGTLGNQVTNGNFDYLGYLDNETLSYVMGGKVISGLKAPTLASTNITWEKVTTTNFGLDIAMLNNRLNASFDYYIRNTNDMVISKTYPAVLGSSGGKENLANMRTNGWELSVSWNDKINNVGGSPLMYSIGVGLADSYSTITKFDNPEGALNNYYEGKRIGEIWGYVTDGFIQDEAEAQRMATIQGDISKTWKVGDIRYKDLDGVEGITSAKTIYNTGDQKVIGNTTPRYSFNINASASWKGFDVRVFFEGIAKRDLWIDSPVFWGFPSNSNVWQSAVNDYHVDNSWSENNTNAYYPLPSYSGRSKQTQTKYLQNGAYIRLKDLTISYTIPKAWISTVGIEQLKVFASGQNLWVGTKLFKYLDPDIVSTRQSNSKDNKLVGNLTSDGKAYPFSRTFSFGINLTF

SEQ ID NO: 1320 - protein, 355 aa, Nodularia spumigena CCY9414
DATDVQWWAARTLGTKKTYWPTQSEVPETCENTTSSWNANLCPRVDPEFSYLLPIKTTGKSVYLFDNVVITDYLSFDLGYRYDNIHYQPKYKHGITPKLPDDIVKGLFIPLEKNKNADVKKNVQQNIDYIAKQNKKYKAHSYSFASTIDPTSFLRLQLKYSKGFRAPTSDEMYFTFKHPDFTILPNTNLKPEIAKTKEIAFTLHNDDWGFISTSLFKTNYKNFIDLIFKEKRNFAVGDRGGSTLPFSLYQNINRDSAVVKGIEINSKVFLGKMAKFMDGFNLSYKYTYQKGRMNGNIPMNAIQPKTMVYGLGYDHPNHKFGFDFYTTHVASKNPEDTYDIYAKDKNQSNTSIKWR

SEQ ID NO: 1321 - protein, 671 aa, Nodularia spumigena CCY9414
MREFARHIFFVPLALCGALVGARAQSARLPAGTVPIETVTASYVRTPIADTPASVTVITAAQLRRRGVTTLAQALEAVPGLNVVQSGGPGAQTSVFIDGTNSEDVLVLRDGVPVNDPSVANGAFNFGNSGIGDIARIVVVRGPMSSLYGSGAIGGVINLISKRGHGAPHVDYDLAGGFPGQGEGSVTLSGQSGKFDYAITGSLIEQAGFDATARRLAVYAAHRDPFRYKLGAINLGYTPVAGTRISLIVRARQTGSQYPDLGYPIFDDPYENSFDSNVFFRFGVKSHLFDNRLITELDIAHIQDDRRYLTLLDPADPNQFAGDSGYRGDRTVIQWNNVIRLPDFGPMTDPTLVAGIETTHDTAVENYNASFGGYPYLQSLAASQSTTAGHFGAQATIARRLSVQGAVRADSVSGYGTVVTERGGLVLAVPAIDTRLKASAGSGFLAPSLYDLHGIDSYGYHGNPNLHPEHSVGYRFGFETVLPAFGIPEAVTLRMSYFHQDISNLFEYTSLPDGTSTEENVARARIHGIEAGIGFAPAPWLSGQIDYTRTIARDAATGTALLRRPENAGSLTLSIRPIPALSIEPTVRYVGRFSDYLYANSGYPITSGNPSGVGLAQPGTIANLAVNYRISRALTLFAIGRNLTNSAFEPVNGLQIPGQNFLFGLRGTIGG

SEQ ID NO: 1322 - protein, 179 aa, Nodularia spumigena CCY9414
GLKGGFGTIRVGSLNSPLKNTGSKVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFG

SEQ ID NO: 1323 - protein, 234 aa, Nodularia spumigena CCY9414
MSNIKAACVSVAGLALAFGSTVAHAQSEAAANTLKIGYAEIGFNTKSDDLVGLPGTTPPGIQTHLRNTRTLALVYERKISGPWSVVVQAGAPPLIKFDGAGAGAALGRVGTARAWFPAVLATYTVTDLPGIRPYVGAGVNYTSFANRHVSAGYTGAFGGTGSSSKLKDSWGPVVKLGAEIPIAKNWMLDMAYSRYWIDTRATLTTTTPGVGDIARTIDVKVDPGVFSLMVGYRF

SEQ ID NO: 1324 - protein, 537 aa, Nodularia spumigena CCY9414
MIKILLHSFFILFFAVPAVWAAPPEEDSSTADADRNLQGQVNSVSQLSDIKPSDWAFQALQSLVERYGCIAGYPDATYRGNRALSRYEFAAGLNACLDRVNELIAVGTNDLVKKEDLAVLQNLQTEFAAELATLRGRVDTLEAHTATLEEQQFSTTTKLNAQIITAISDTFGNRVGGDRDESRLYFANRGRLNLESSFTGKDLLRVRLEFGNFTNSNGASQIAAATGTGMTRLNFDNDSNNTLIIPHIRYYFPVGDSLSFVVGPTGIGYNDITNNITPATIADDGNGIPSLFGKNSPLFERGGGGAAANWSISKNLILTLGYLANSPNVPSAQNGLFDGGYNALAHLAYYGEQGAIGIAYSHGYNPAGTVDINAGRGSALSNAPFGNNIATSNSIVGVQGYYRFSPNFQVHSWGGYVRANAKNSGFSDISNGRGGTDSLFVNNGDNANAWFGAIGMSFPDVGGKGNLPGILFGIPPRVSNSDIRQDRDTAYHIEAFYRYRLNDNISVTPGFWVILNPENDSRNDTQYVGVLRTTFDF

SEQ ID NO: 1325 - protein, 278 aa, Nodularia spumigena CCY9414
ELLVGSLSAAAVCACSLLISGSSFAYSGNNDASDVSGVMNGSFYVSGSYSPSFPSISSFAISESDRGGSYVKGYNKNLSTLNVSDPISFTQNDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARFAFQ

SEQ ID NO: 1326 - protein, 1176 aa, Escherichia coli O1:K1 / APEC
MSAKLSSKNFYGGNLMVKCFVALVIFFCSVGNLFAQTETKVTINVDKVLIRTALERLQKETKVHFVYDEENIDQDKRVSLSYTQAPLKIVLEDFCKQTSLRYEVKRNLILILPGKADRNVNRQSFLMKGVVTDEDGESIIGATVMIGGTSKGTVTDINGQYTLEVQSGDLVSFTFVGMTDKVIKAQVNKKMVNVQLESNATALADVVITGYQTLSKERATGSFDKVDSSVLSSRPTADLSTALQGLVAGMQATEKEDGSIDFLIRGSSSLYADKKPLLVVDGFPIQGDFSSINPNDVESVTVLKDAAAASIWGARSANGVIVVTTKKGKKDKVQVDVQAFVRIGTNPDLEYIMNQADSRTMVDYEMRAFENNWKMAAWEYAPIFSKIQNSLTLAQELYYANKYQGLSKEEMEQGLERLRNTSNRQQLKDYLMQTQLLQQYNVSISGGTERMSNYMSLMYEKNDESTIKRGYEKFMINYNNSYKVTKWLTANLITTLQRKDQETSGVTIGEFSNLSPYEMLLNEDGSYATNLNVYNRAELEKLPLEKLPYSDWSYNMLREVRGREYKTTNTMYRVQLGLNAQIIKGLNYDMRVQYESTSSEYKNYDSEDTFYARNLVNSYTEYNNETQEVGVSRIPKGGVLRSGKTEYSNYVFRNQLNYNNSFAEKHEISALAGIEISQYDTEGTVNPYVYGYNKEKNTSSVPPYGYGSNVDSFKNFFGNSATIEGGNTSYSLRCDRYVSYYTNIGYVYDGKYGASFSARGDGSNFVSDDPSLRWSPMWSVGAKWNIGKEEFIKDIDWINYLNLRATYGINGNAEKSTSPLTLVSVGSSVNSTTGTITGNISSFGNPSLRWEKTYTTNIGVDFDLFRSKLSGKLDFYNRKSKDVIGQVTIPSVYGTSTQKFNNAEILNRGVELELTGNFHIPSVDLGIRSTVTYAYNYNKILKLYYPALYCYELVEADTHVEGRPVGSLYSYDFLGTENGIPYVIGANGDKISMNDVSVHNRSLGLDILHYSGTTIPPHTFGWSNQFTWNNFSLYVYLTGNFGGIFRAPTAGSIPSVGSGKTFVSSSIKDFADSDGTLYPTWPLKDESNFYLWDRYTPNLEYFVQDASFIRLKEINLEYNLSKKLAGKLHLRGAKLFVQARNLGLIYCANDYGYDPEWLPGSNKPSATIAFGANINF

SEQ ID NO: 1327 - protein, 752 aa, Escherichia coli O1:K1 / APEC
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYTKDQEALKASPCLSIPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 1328 - protein, 353 aa, Escherichia coli O1:K1 / APEC
MKMKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 1329 - protein, 1376 aa, Escherichia coli O1:K1 / APEC
MNKIYALKYCYITNTVKVVSELARRVCKGSTRRGKRLSVLTSLALSALLPTVAGASTVGGNNPYQTYRDFAENKGQFQAGATNIPIFNNKGELVGHLDKAPMVDFSSVNVSSNPGVATLINPQYIASVKHNKGYQSVSFGDGQNSYHIVDRNEHSSSDLHTPRLDKLVTEVAPATVTSSSTADILNPSKYSAFYRAGSGSQYIQDSQGKRHWVTGGYGYLTGGILPTSFFYHGSDGIQLYMGGNIHDHSILPSFGEAGDSGSPLFGWNTAKGQWELVGVYSGVGGGTNLIYSLIPQSFLSQIYSEDNDAPVFFNASSGAPLQWKFDSSTGTGSLKQGSDEYAMHGQKGSDLNAGKNLTFLGHNGQIDLENSVTQGAGSLTFTDDYTVTTSNGSTWTGAGIIVDKDASVNWQVNGVKGDNLHKIGEGTLVVQGTGVNEGGLKVGDGTVVLNQQADSSGHVQAFSSVNIASGRPTVVLADNQQVNPDNISWGYRGGVLDVNGNDLTFHKLNAADYGATLGNSSDKTANITLDYQTRPADVKVNEWSSSNRGTVGSLYIYNNPYTHTVDYFILKTSSYGWFPTGQVSNEHWEYVGHDQNSAQALLANRINNKGYLYHGKLLGNINFSNKATPGTTGALVMDGSANMSGTFTQENGRLTIQGHPVIHASTSQSIANTVSSLGDNSVLTQPTSFTQDDWENRTFSFGSLVLKDTDFGLGRNATLNTTIQADNSSVTLGDSRVFIDKKDGQGTAFTLEEGTSVATKDADKSVFNGTVNLDNQSVLNINEIFNGGIQANNSTVNISSDSAVLENSTLTSTALNLNKGANVLASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNTWSGSLNAPDATVSMTDTQWSMNGNSTAGNMKLNRTIVGFNGGTSSFTTLTTDNLDAVQSAFVMRTDLNKADKLVINKSATGHDNSIWVNFLKKPSDKDTLDIPLVSAPEATADNLFRASTRVVGFSDVTPTLSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASAGLYSGKTKSWGGGFYASGLFRSGAYFDLIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDGRMLYGVGLNARFGDNTRLGLEVERSAFGKYNTDDAINANIRYSF

SEQ ID NO: 1330 - protein, 1105 aa, Escherichia coli O1:K1 / APEC
MENENAFLQKLDKIGNLTQVVCLSLFLTGVSVQGVSAETGFPISQSVQQTKTVTGQVVDETGEPVIGASVVVEGTTNGTITDFDGKFALQVPSGKKVVISFVGYVPQTIAPKQGKDFRVVLKEDSKILDEVVIVGYGTQKAKNVTGAISTVNPKEIEDLPVGNLGAALQGMVTGLSVSGGQTRPGAAASLSIRQPMTLSKDGGDTNPIYVVDDFIVDATTFNNLDPSEVENISVLKDAAASVYGARGGQGAILVKTKRGKEGDPRISYSGQFGYNDEIARPKMMDSYHYGLFYNAIAAANGNDEIKNHKTDLFQADELEAMRNINYDWLDDAWKGAFSMKHNLNLSGGTQKATYFAGVSYYTQSGNLGTLDYERWNYRAGVDVKLASHFKVGLQASGDYGKNEKTFNKVGGENDENDYNTLLLTPRYIPAYIDGLPLLRYGFSNSQQNNIQQYNYYALEELGNISKNDPQNMRLNASVEYDFDWNKTLKGLKLKMSYSKSISTDKNSRVGSKYTAYSFKTRGGSGNHLYIGDDLTNESNLQETTVKNGNQIWRTMNRTDSYQLNFVANYNRTFGKHTIGALFSVERSERNYEYVRYYREDPLEVNNGEWNTATGKMDGLTERSESGLLSYIGRVNYSYNDRYMMEFLVRSDASTKFAPSNYWGVFPSLSLGWVVSEENWFKEKIQWLEYLKVRGSVGMLGKDNTKAWLWRQNYSYQANKGAVFGTNEQNPVGMGLKMGAAPNADVHWDKSYKFNFGIDTRFLNGRLSFGLDAYLDKNTEMLVQRDGLVPVTIGGALAAENYDAIDAYGVELSFGWRDRVGDINYFVKLNTAFTGTKYRKHDWPDIIGLGDIYKGGPTDMGKWGYDCIGMFRTQQEIDEFVTKNNVTKYMGLNPEQIKPGMLIYRDVRGKQNPDGSWEAADGIIDSNDRIRLSKKNSNPYGFSLNFGGDWKGLSLSAQLSASWGGWAEIPSAARDMSTKKLNYINAPVFWNDVFVPEDVVDDQGNIVAYQNLDAKYPNMGFSVNNETSNFWRVNSLRMTLKTLTIGYKLPSDWVKKINIEGCRFTLTGTNLLSFFNPYPENFCDPLSVYGAYPTLRNVSLGVNISF

SEQ ID NO: 1331 - protein, 980 aa, Escherichia coli O1:K1 / APEC
  misc_feature (857)..(857): Xaa can be any naturally occurring amino acid
MHSWKKKLIVSQLALACTLAITSQANAATNDISGQTYNTFHHYNDATYADDVYYDGYVGWNNYAADSYYNGDIYPVINNATVNGVISTYYLDDGISTNTNANSLTIKNSTIHGMITSECMTTDCADDRATGYVYDRLTLSVDNSTIDDNYEHYTYNGTYNNAADTHVVDVYDMGTAITLDQEVDLSITNNSHVAGITLTQGYEWEDIDDNTVSTGVNSSEVFNNTITVKDSTVTSGSWTDEGTTGWFGHTGNASNYSNTLTADDVAIAAIANPYADNAMQTTVTLDNSTLMGDVVFSSNFDENFFPQGANSYRDADGDVDTNGWDGTDRMDVTLNNGSKWVGAAMSVHMVDEDGDGSYDGYAVGTEATATLLDIAANSLWPSSTVGVDNINTQYDENGHIVGNEVYQSGLFNVTLNGGSEWDTTKSSLIDTLSINSGSQVNVADSRLISDTVSLTGGSNLNIGEDGHVATNTLTIDNSTVKMSDDVSAGWGLEDAALYANTITVTNDGLLDINVDQFDANPFQADTLNLTSTTDTNGNIHAGVFDIHSSDYVMDTDLVNDRTNDTTKSNYGYGLIAMNSDGHLTINGNGDNDNTASIEAGQNEVDNNGDHVAAATGNYKVRIDNATGAGSIADYNGNELIYVNDKNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYXSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 1332 - protein, 294 aa, Escherichia coli O1:K1 / APEC
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKIKYFVPITDLWGGQLSYIGFTNFDWGSDLGDDSGNAINGIKTRTNNSIASSHILALNYDHWHYSVVARYWHDGGQWNDDAELNFGNGNFNVRSTGWGGYLVVGYNF

SEQ ID NO: 1333 - protein, 972 aa, Escherichia coli O1:K1 / APEC
MRAKKTPLASFLQASLQKLNATTTHAAAIGAVTLLSQTAFADGSVSGKLSDKSGSYGIEGALVTVKELNVQTSTNRDGRYNLPSLPNGEYTLELSYVGADTQTRAIAITDNAILVEHFTLSSNATEHVLVIGEAASLNKALNKQRASNNIVSIVNADAIGNYPDANTSEALQRLPGVSVENDQGEGRYVRIRGLGANFNSVTINGSKVPSPNAGERAVALDTVPSELLESLEVTKTLTPDMDADSLGGTINVKSLSAFDRDGRFYKATLETNFDEHTSQASPKLSLTASDLFSIGDGADNFGVAGALSWYERKFGSDNVETGGAWDVADNAADTRLEEFEQRDYTISRERLGASLNFDYQANDVTNLFLRTLYSEYTDAEERQANVIEMYQFERDDLGDIVLDDEGDEETNDGIPASETGAATIARELKDRTETMKIKSLVLGGKSEWDTWVIDYKLGASQSSEHTPFHIDGAVFEADFEEGIGYSAAKQIYLHAPAEVYAAENYELDEIATAQQITKDKENNIQLDITKRLQLAGNPLALKWGAKLSQREKTSDEEVWAYSNLDEVGFTDEQLLLSNYVATNSGEAQIDYQFGPMGQAIASRPLLNAISPLDKSEYHEEIDSAIADFTVNEDISAAYVMGTLDVDKLRILAGVRVEQTDFTAAGMHYNEYEDEGAEIEELTAASFNNDYSHTLPSLHLRYLIGEKVQLRAAWTNAVVRPTFEQLSPAKVREGDEVEFGNPLLKPLEASNLDIGIEYYGGFASYFSAFVFSKDIENFAYAIDLGATADASLVGPGEISEANTFKNGDSATLTGLELAASKQFSELPAPWDGFLVSANATWTSSEATIEYLDDELFAQRDIHLPSQSDFSGNFAIGYETEKFSLRVAANYKSEYLLEVSDPADAQGDAWVDAQTGIDFLARWYASEKVQVFVQGVNLGDQGYYVYSGEGQKDYNFQYEEYGPSFRLGVTITDF

SEQ ID NO: 1334 - protein, 1131 aa, Escherichia coli O1:K1 / APEC
MLMTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGSARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASNGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVRETALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 1335 - protein, 996 aa, Escherichia coli O1:K1 / APEC
MNVSASSLQADKFKVSGIVKDATGEPVIGASVVEKGTTNGTVTDLDGNFNLSVASNSTIVISFIGYSDQEFHISKDNMILNVNLKEDTEMIDEVVVVGYGVQKKENLTGSVAAVNFKDVASMPVANTANMLQGRLPGVMLTNNGAQAGHDSPEIRIRGVGTFEHNDPMVLIDGVESSVSQIAEIPADDIESVSVLKDAASASIYGVRAANGVILVTTKRGGEQKPTITYSGSIALQEATVLPDYVNSYEWAKMYNECWPSKAYTDDMLQKLQNGSDPDHFANTNWAKEMFRTAAMHQHHLSVNGGSKAVHYMISTQYFQQDGILRETANQRFNFRSNLDAQLGIVKLGLNLSGSRQNIDEPTTSVTGEGLMRYLTWFTRPTVPVRYSNGHYGFLDGNPNISQSVFKNPIEALNMGYKDNKHYRFDGKFFGEIDIMKGLKFRSSLAYKYYMNDVTTFNPKNNVRYDAEGNALTTVGTNKLTDYHYLETTYINENILTYDFSVGKHSFNLLAGHSIQATRWDKNEASKQGFATDNIYEMDGGTMNDHVTGSAEESSLQSFFGRLNYNYGGRYLLEMNVRHDGSSRMPKAHRYATFPSFSGAWIMTNEKFMENVKFLHSLKLRGSWGKLGNQEIGNYAYAATLAASGSYYFGDSKQIGMKTAKIPNENIKWETTTITDFGFDAAFWGGKINVTFDWYEKNTSDILMKLAMPGIFLGSLDAPYQNAGKVRNRGWELAANYFDQKGDWAWQAGFSLSGVKNEITDMKGVEDISNNTINREGEAIGSYYGLKAIGIYRTQADLDRVNANGQKILQNNQEPQLGDIMYEDIDNNGNINDADRTVIGNPFPKMQYSFNLGFSYKDFDVNTFWQGIAGVYRYNWDETTISNGGNKTSRWLDRWSESNPDGSMPRLGGTINNNYSSFWLTKGDYLRLKNLEIGYTFRQREFLTKLGVQSLRLYLAGTNLLTFTSLDDYDPEKLSTDSRNDVHPNTRTYSFGVNVKF

SEQ ID NO: 1336 - protein, 468 aa, Escherichia coli O1:K1 / APEC
MRTFSGKRSTLALAIAGVTAMSGFMAIPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGHAKGTMFKLHFTEYDNHSDIPSWGGGYGNIFQDERDVKFMIIAPFTIF

SEQ ID NO: 1337 - protein, 760 aa, Escherichia coli O1:K1 / APEC
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATAYGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEDYWVADAKLGYRVNRNLDFQLNVYNLFDTDYVASINKSGYRYHPGEPRTFLLTANMHF

SEQ ID NO: 1338 - protein, 846 aa, Escherichia coli O1:K1 / APEC
MVMIVRPESTTKRHGINLYASGVALLCFCSPAFAQSEAPAEQPAAQSAAAEAPQSESLGAGEIIVTASKRAESINKVGLTIAAVSGDQLVKQGISSVQDLTKAVPGLTYARSAFGTPVFTLRGVGYFDTALAASPAVSVYVDQAPLSFSALPGIGVGLDMERVEVLKGPQGILFGQNSTGGAINYIANKPTDTLTSGFSLGYGRFSTVEGEAFISGPVTDTLNIRLAGRSTYAGSWQKNYFSRPGDEFGKRREFAGRITLDWKPTDRLSFMASLSGWHDGSEPQIGQYIFLRPATAGQEQFLSPQLYNFETGTLVTPYAPRKARAADWSADAEPFRDDRMYNAALRTDYDVTDNLTLTSITSYSDYKRNSRAADDGTAVQDYDYVANDGYIRDFNQELRLSNDAASRMRVTVGANYQHSKVYELSKLSNGDSIVSNFSQIDGTSTLLPVPFSRASDFSRQTIENYAFFGNVDFDVTDTITVKGGLRYTNSKRHFVGCTFDNNFDPIHGDDTFRRLFDIIHTFARSLVGLGASTPLQPGDCTSAIDPLTDANGNPLIGVENGQRPDAFESILGDTNLNEDNLSWKVGVDFKPVAGSLFYANVTKGYKAGSFPTISAATVSQYRPVVQESVIAYEAGFKQELFDRSVLLTGAGFYYDYRNKQLMGFFDQPPFGTVFALDNVPKSTVKGGELAIVWRPVDGLNLSGAVTYVDAKIKKYSGLNSDSVFTDFAGDRVPFAPKWNASANADYTVPLGASLAVNLGASLTYNSSTQAAIGHDAVTKAVTYIKPFTTVDARIALQDADNAWQVQFWVKNLTNEYYWNNVAFLYDTAVRYAAMPRTYGVKTSFRF

SEQ ID NO: 1339 - protein, 362 aa, Escherichia coli O1:K1 / APEC
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVELVNYFEVGATYYFNKNMSTYVDYIINQIDSDNKLGVGSDDTVAVGIVYQF

SEQ ID NO: 1340 - protein, 855 aa, Escherichia coli O1:K1 / APEC
MKDLNFPAAGALSFVCASVLLISHTAAAQEAPAPASAPSASTESPASATGRSLPAIVVETSRRRAAATSPQRRPSQVSRSTASRRAPNPASAAAQPRPVSAGALQATLPAGFPGDQVARGAGVGLLGNRDVMSTPFSLTSFTEKLIRDQQSRTLLDVLGNDPSVRSNVPAYSGIQGFFIRGFPVFAQDIAFNGLYGVADSFNPALEPIERVEVQHGPSTMLSGMPPFGTIGGTINLIPKRAGDVPLTRFTTGFISNAQSYNAIDVGRRYGTNGEWGIRFNGAYQSGSTPIDNQKQEYGVTSLALDYRGERLRVGLDLGYQKVDFNSPLRNRSVLPGFPIPQAPDLRINQQQPWEYRDSNNKSAAIRAEYDLTDQLTVYAAYGHSEFHQVYFGGLPSIINARGDYRDTIQLTPFQTHSNTGEVGVRGQFDTGPVKHRVGVAASGLWQDTGLTNIPVGGTITSNIYNPVYAPPRSDAGLPRTSPTTAERFNRSIAIADTMSILNDRVELTIGGRWQGIDAKTLSPVTGLVTSDARNDAFSPGAGLVIKPIERLSLYANYIEGLTSTAPPTNAVNLNQSFPATVSKQVEAGAKYDFGPVGVSVAGFEIKQPSGFLDPTTGVFALNGEQRNRGVELNVFGQPIQGLRVVGGVSWIEGGLTKASNPAYNGNTAVGVPTMQLNLYGEYDLPGLARGVTMTGRVIHTASQFYDQANTQSIPAWTTLDLGVRYTTKIDRVPVYTASQRPERHRRELLGHDRSWHSQPRRAADLSGLGELRLLRSQRSGFFSRENRSGSSPSEGCSIGASSVRASGRSAMPGSFGTSRCEVAPRQRSSTALTKCMSLPAAADGTVEIAASLRGS

SEQ ID NO: 1341 - protein, 136 aa, Escherichia coli O1:K1 / APEC
MLSTLGYRFSDLGLLVSLDSGYAKTKNHMKPAVTAPAAAAAKPAYDEKRYFVSPGFQYELMEDTNVYGNFKYERTSVNQGKKTHEQAVLFGVDHKLHKQVLTYIEGAYARTRTNDKGETEKTGKEKSVGVGLRVYF

SEQ ID NO: 1342 - protein, 375 aa, Escherichia coli O1:K1 / APEC
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKEGANKSLI

SEQ ID NO: 1343 - protein, 206 aa, Escherichia coli O1:K1 / APEC
MRLMPFMRLKLTSHTCLFALSSLLVTPAFAAPSGDNTASDAVERGSEPGIWQRAGNNLSDTWHHWQSQELYVPAMTWHNRWTYDKAKTDRYNERPWGAGYGVSRLDRDGDWHSLYLMAFKDSFNKWEPIGGYGYEKRWRPLENQDVQLGLGFTAGVTMRDNWKYIPIPVLLPMASVSYQRLSFQATYIPGTHNNGNVFFAWLRWQF

SEQ ID NO: 1344 - protein, 108 aa, Escherichia coli O1:K1 / APEC
MESKSVDTRSIYRELGATLSYNMRLGNGMEIEPCLKAAVRKEFVDDNRVKVNSDGNFVNDLSGRRGIYQAGIKASFSSTLSGHFGVGYSHGAGVESPWNAVAGVNWSF

SEQ ID NO: 1345 - protein, 656 aa, Escherichia coli O1:K1 / APEC
MRLKKRYLCTVLSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 1346 - protein, 454 aa, Escherichia coli O1:K1 / APEC
MICRQLTRCGTAFACLGFSASTAFSAGFAIQEQSISGLGNAYAGAAAVAEDASTVYFNPAGMSLIDKPQLHTGVHLIFPEAEFTNLGTTTMGVPTQGNDATSKEDAIVPNLYYVAPLNDDLVWGIGVSAPFGLTTDYDDDWVGRYVARRTELKTVLVNPSLAYRVSDNFSIGGGLSYVKSDAVLSNAIDMGLVFLGQYQAGGIPANAQTMALAGDIQANLGSSKYDGGINLEGDGDGWGFNFGGIYEINDDWRLGVHYRSEVDLELSGHADFTVGALEGVLGAAFQDQGGSVDITLPETLAISVFGQVNEKLSVMADVTKTGWSSFQDLTIKFENPSPPDSVIPELWEDVNKYSVGASYKFNDKYTGRFGLAYDESPVPSDEYRSPRIPDEDRTWLAFGLSVAASESMDLHFAYVNIMVDDPVIDNPTHSTGQYLYGKLDASVSLLSMGLTKRF

SEQ ID NO: 1347 - protein, 199 aa, Escherichia coli O1:K1 / APEC
MRKVCAAILSAAICLSVSGASAWASEHQSTLSAGYLHARTNAPGSDNLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSDTSLAWGAGVQFNPTESVAVDIAYEGSGSGDWRTDGFIVGVGYKF

SEQ ID NO: 1348 - protein, 301 aa, Escherichia coli O1:K1 / APEC
MKKLLLCTALVMCAGMACAQAEEKNDWHFNIGAMYEIENVEGYGEDMDGLAEPSVYFNAANGPWRISLAYYQEGPVDYSAGKRGTWFDRPELEVHYQFLESDDFSFGLTGGFRNYGYHYVDEPGKDTANMQRWKIAPDWDVKLTDDLRFNGWLSMYKFANDLNTTGYADTRVETETGLQYTFNETVALRVNYYLERGFNMDDSRNNGEFSTQEIRAYLLLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 1349 - protein, 199 aa, Escherichia coli O1:K1 / APEC
MRKLCAVILSAVVWLVAAGTPASAAEHQSTLSAGYLQAHTDMPGSDDLKGINVKYRYEFTDTLGLVTSFSYANAKDEQKTHYSDTRWHEDSVRNRWFSMMAGPSVRVNEWFSAYAMAGVAYSRVSTFSGDYLRVTDNKGKTHDVLTGSDDDRHSNTSLAWGAGVQFNPTESVAIDIAYEGSGSGDWRTDGFIVGVGYKF

SEQ ID NO: 1350 - protein, 229 aa, Escherichia coli O1:K1 / APEC
METEMDRKWSGLAAAALAMTCAQQAVAADLGSSEPPAAFEVVAPKSPWQIRVRALGVITQDSGSVDGISGSDLSYSDTVIPELDITYFFTDNIAAELILGTTFAKVNGEGTISALGEIGETWLLPPTLTLQYHFTNFGKFKPYVGAGVNYTIFYNQSGKNAQDLNIENSFGAAVQAGFDYMIDDHWGVNLDVKKIFLEPDYDVTVAGNKLHGTAELNPWLVGAGITYRF

SEQ ID NO: 1351 - protein, 377 aa, Escherichia coli O1:K1 / APEC
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYTANGISTDDIVALGLVYQF

SEQ ID NO: 1352 - protein, 2771 aa, Escherichia coli O1:K1 / APEC
MQRKTLLSACIALALSGQGWAADITEIETTTGEKKNTNVTCPADPGKLSPEELKRLPSECSSVVEQNLMPWLVTGAATALITTLAIVELNDDDDHHRNNSPLPPTPPDDDSDDTPVPPTPGGDEIIPDDGPDDTPTPPKPIAFNNDVILDKTEKTLTIRDSVFSYTENADGTISLQDSNGRKATINLWQIDETNNTVALEGMSADGATKWQYNHNGELVITGDNTTVNNTGKTIVDGKGATGTEIAGNNAVVNQDGELDVSGGGHGIDITGDSATVDNKGGMTVTDPDSIGIQIDGDKAVVNKDGDSAISNGGTGTQVNGDEATVNNNGSTTVDGKDSTGTEINGDKAIVNNDGDSTILDGGTGTRITGDDATANNSGNTTVDGQGSTGTEIAGNNAVVNQDGTLDVSGGGHGIDITGDSATVDNKGGMTVTDPDSIGIQRDGDKAVVNNDGDNAISNGGTGTQVNGDEATVNNNGSTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGGSAISNGGTGTQINGDEATVNNNGNTTVDGQGSTGTEIAGNNAVVNQDGELDVSGGGHGIDITGDSATVDNKGGMTVTDPDSIGIQIDGDKAVVNNDGDSAISNGGTGTQVNGDEATVNNNGKTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNAISNGGTGTQVNGDEATVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDSAISNGGTGTQVNGDEATVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNAISNGGTGTQVNGDEATVNNNGSTTVDGQGSTGTEIAGNNAVVNQDGTLDVSGGGHGIDITGDSATVDNKGGMTVTDPDSIGIQIDGDKAVVNNEGDNAISNGGTGTQVNGDEATVNNNGKTTVDGKDSTGTEINGDKAIVNNDGDSTILDGGTGTRITGDDATANNSGNTTVDGQGSTGTEIAGNNAVVNQDGLLDVSGGGHGIDITGDSATVINKGNITVTDKDSVGVLINGDRATFANTGHIDVNNSATGMSITTSEGAISQAGSMNVGDFSTGMALSGNNNSVTLAAKDLNVIGQKATGVNISGDNNAVDITGNILVDKDQTATNAVDYFYEPSIGVNVSGNSNTVSLDGKLTVVADSELTSRIYADFDGSQENISGLVVSGDDNTVYLNGGIQLVGEENQLTDGSTVASNRNGYGKTPVITVDGKSSVYLNGDSTINGDLPLAYSGMIRLKNSAMIEIGADATINMQVDIYDHYARSESQMIFVESGAELVNKGDIDTRNIGFAAISGENSTGSNSGNITLSQYNYGLLANAGVGYFTTKGGSAVNNGTITAKVMEQESVINLGASLGLNEANTFYSDANSMMGLDAFDHGYVSNESGGSIEMYGRGNVGMLAIDESTAENAGQITLDALWVDADDTTTLRSNIGNDARSYGVGMAVGTNTYSGPRKNATAVNKQGGVITVYNAGIGMAAYGASNTVINEGIINLEKNANYDSSLGADSLIGMAAYKSGTAINEQSGVININADNGQAFYSDGSGTILNYGTICVNTNCLTGNDYNETDSYTSLLYTGGDVITAQNETQNLTQKASINDKKEGNVVNSGSLSGADIAISSGELVNTSTGTINNAIIINDGELSNEGSVAKVTLNAGTFGNTGTVNSRMFQTGGTFNNQQGGVVQNGANLSKTAITNNEGTWYLGASSSSDSNNASMMEIYNTAVFNNSGDFILNNSRNAIHLYQSGSFYNTGHMLISGANYSGNAINYWNANNNGRFINSGTVDVTAKALATSGVDASTNHAYFWNQNSGIVNFDKDSGVAVKFTHSNYVAQNDGTMNISGNNAIAMEGNKNAQLINNGTINLGAQGTTDTGMIGMQLDSSATADAVIENNGTINIYANNSFAFSMLGSVGHLVNNGTVTIADGVTGSGLIKQGNSVNIEGVNGNNGNNSEVHYANYTLPDVPGSSVFVSTDNVSDNGGQNNLNGYVVGTSSDGSAGKLKVSNASLKGVSVNTGFTSGTSATSVTFDNVVQGNNLTDADTITSTSVVWSAQGNTDANGNVDVTMTKNAYTDVVTDSSVNNVAQVLDTGYTNNDLYTSLNVGTTAELNSALKQISGSQATTVFNEARVLSNRFSMLSDAAPEVANGLAFNVVAKGDPRAELGNDTQYDMMALRKSLTLTEHQNLSLEYGIARLEGNGSDTAGDNGVTGGYSQFFGLKHQMAFDNGMNWNNALRYDVHQLDSSRSIAYGDVNKTADANVKQQYLEFRSEGAKTFELREGLNVTPYAGVKLRHTLEGGYQERNAGDFNLSMNSGSETAVDSIVGLKLDYAGKEGWSANATLEGGPNLSYVKSQRTASISGAGSQRFNIDDGQSGGGFNSLATMGVKYSSQESALQVDAFHWKEDGISDKGVMLNFKKTF

SEQ ID NO: 1353 - protein, 700 aa, Escherichia coli O1:K1 / APEC
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHHGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMNDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEEGWYAGTEARYMGDIMADDENTAKAPSYTLVGLFTGYKYNYHNLTVDLFGRVDNLFDKGYVGSVIVNESNGRYYEPAPGRNYGVGMNIAWRFE

SEQ ID NO: 1354 - protein, 790 aa, Escherichia coli O1:K1 / APEC
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDYVTLYDSFVPVEFGRFNGGVIDAKIKRFNADDSSVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQTYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFNLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKANAQYISEYSDYKQYVDEKLDSSLTWDTRLSWTPQFLQQQNLTISADILNVLDSKTAVDTTNTGVATYASGRTFWLDVSMKF

SEQ ID NO: 1355 - protein, 360 aa, Escherichia coli O1:K1 / APEC
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLIEYIDVGATYYFNKNMSTFVDYKINLIDKSDFTKASGVATDDIVAVGLVYQF

SEQ ID NO: 1356 - protein, 224 aa, Escherichia coli O1:K1 / APEC
MKIIITREYIMKRKVLAMLVPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGSVCPLPMTLTLV

SEQ ID NO: 1357 - protein, 673 aa, Escherichia coli O1:K1 / APEC
MKMTRLYPLALGGLLLPAIANAQTSQQDESTLVVTASKQSSRSASANNVSSTVVSAPELSDAGVTASDKFPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 1358 - protein, 316 aa, Escherichia coli O1:K1 / APEC
MLPVSLLFFNRAERPRRSRMLYKSSLAVAISALIAGQVSAAGFQVAEHSASGLGRAFSGEAAVADNASVLARNPAAMMLFETAQFSGALSIVDPEVNVDDLSNNQSMKDVAPLQIVPAAYYIRPINDQWAWGLAMFTTYGVATDYPNEIYAGDLAGDTSLMSVNLNPNIAYRVNPELSLGFGLDLVAAKAKLTRHKGGLAPFMGGGNPSDNLIGMTGETLALGWNIGALYELDEQNRIGFGYRSRVKLNFDDGEFSSYDSGIATSAVVPGQLKIELPAIWELSGFHQLNEQWAVHYSYQQTDWSSFEELTATSSPM

SEQ ID NO: 1359 - protein, 642 aa, Escherichia coli O1:K1 / APEC
MGGALGAQNLQGESGFGDLSLEELMSMDLVVSSASRRDERLAESAAAIFVISREAIQRSGAEHIPELLRMVPGLQVARVDASKWAVSARGFNGQFSNKLLVLMDGRSLYNPLYSGVRWDLQSISLNDIERIEVVRGPGGALWGANAVNGVINILTRHAKESRGNQLSVGGGNQHQGHLSYTHGATLEDGSDYRVTGKLNRYEHGYDPQGAHDDWQDAQLNFRLDRALERGAGWMLQGGVTHVRSGQTVQVPDNAAVGLSRDLYEDSRRSNLYLVSHYRGVEQAGRQWNGQFNFEHTALQESAIEIHSTILDGDLQYRFPGGNNHAWTVGGGGRMLLDNLRGSDTISLTPLNDVSFLVNAYVRDAIELQPGRWKLIWGSKWEYHQASGHNLQPNVRLLYTPDRQSSYWAAISRAVRTPARMERDGAIRLAGTGAAYVSLYGDNAYTSEKLTAFELGMRYQPNPRWMWDGAVYINQFKDLRSIESDPADPTRRYVANLLKGEGAGLELALSWQPTAQLQSHLAYTLTKLWLHNEPTSQDTTQALSQEQLQPSHQLHLRLNWSPDGVWQVDPTFRYVSSMAHKGVDAYATMDLRLARALTKQVQLELVGQNLLDAHSREFVTSDLYKTRSSEVSRALFLRMNWAF

SEQ ID NO: 1360 - protein, 365 aa, Escherichia coli O1:K1 / APEC
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYSSTSSASVLAYLQSKGKPGCHHGRNYDDEDILKYVDVGATYYFNKNMSTYVDYKINLLDDNQFTRDAGINTDNIVALGLVYQF

SEQ ID NO: 1361 - protein, 1254 aa, Escherichia coli O1:K1 / APEC
MNMRIISLRKEYLSLLPSMIASLFSANGAAAVIDSCQGYDIKANCQASRQSLSGNMQDWSIADGQWLIFSGMANNASGGAVFLQHSAEFTISPQNETGMTLFADNSVSGEYNNGGAIFAKENSTINLANVIFDSNVAGGYGGAIYSAGTNDTGAADLRVTNAVFHNNIANDGKGGAIYTINNDVYLSDDAFNNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEISIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGAQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGNTSYNRSVIFTDPQQHSEMDVTTDVDTRSATTGQGRNIEMRADGEIHVEDGVDTQWGGLMADSTGQQLDSVSTLTKSGGGTLELTASGTATSAVRVEDGTLKGEAENIIPYVSSLWVGEDGVFETGQNQDIRSIDATSGGDIDITDGTVLRLTQQDTNQALDASLFSGDGTLVNATDGVTLAGELNTNLETDSLTYLSDVTVNGNLTNTSGAVSLQNGVAGNTLTVNGDYTGGGTLLLDSELNGDDSASDQLVLNGNTAGNTAVVINPITGIGEPTSTGIKVVDFAADPTQFQNNAQFSLAGSGYVNMGAYDYTLVEDNNDWYLRSQEVNPTPPPDPDPTPDPDPTPDPDPTPDPEPTPAYQPVLNAKVGGYFNNLRAANQAFVMERRDHAGGDGQTLNLRVIGGRYHYTAVGQLAQHEDTSTVQLSGNLFSGHWGDDGEWMLGIVGGYSDNQGDSRSNMTGTRADNQNHGYAVGLTSSWYQHGNQKQGAWLDSWLQYAWFNNDVSEQDDGVDHYHSSGIIASLEAGYQWLPGHGVVIEPQTQVIYQGVQQDDFTAANHARVSQSQGDDIQTRLGLHSEWRTAVGVTPTLDLNYYHDPHATEIEEDGSTISDDAVKQRGEIKVGITGNISQRVSLRGSVAWQKGSDDFAQTAGFLSMTVKW

SEQ ID NO: 1362 - protein, 448 aa, Escherichia coli O1:K1 / APEC
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRVFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQLESEGKAWLFGTNFNYAF

SEQ ID NO: 1363 - protein, 212 aa, Escherichia coli O1:K1 / APEC
MKKHLALLGAILAAGTLAAPSYAASSPYVSGNIGVSSFNDTAFKSPSTNATLAEMTFKSGIDLRCAAGLDFEDYRIEAELSYQKGDVNRGTEHGGTADMQGFKSVTSLMANGYYDFNPEGINPYLTGGLGCSRVNFDNVKVKGAPYPGLTEHHTVLGYQLGAGIGIPITREVTVDAQYRYSGHSRISMENPDFHYDFKSSGSSFLLGLRVGL

SEQ ID NO: 1364 - protein, 251 aa, Escherichia coli O1:K1 / APEC
MIEMKKVIAVSALAMAGMFSAQALADESKTGFYVTGKAGASVVMQTDQRFRQDFGDDVYKYKGGDKNDTVFGAGLAVGYDFYQHYNVPVRTEVEFYGRGAADSRYTLDTWRSPMGDGGREDTQNRLSVNTLMVNTYYDFRNSSAFTPWVSVGLGYARVHHKATYIDTSWNESGEISDISALHYSGYDNNFAWSIGAGVRYDVTPDIALDLSYRYLDAGKSSLSYKDTEGDKYKSEADVKSHDIMLGVTYHF

SEQ ID NO: 1365 - protein, 682 aa, Escherichia coli O1:K1 / APEC
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDDHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 1366 - protein, 713 aa, Escherichia coli O1:K1 / APEC
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGKSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 1367 - protein, 660 aa, Escherichia coli O1:K1 / APEC
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 1368 - protein, 234 aa, Escherichia coli O1:K1 / APEC
MIIKKCSGRQVWYCLASVIVCAIFTNTAYAWQQEYIADAVSGHTTERYTWDSDHQPSYNDILAERIRSSQNAPGPVLSLADQTPLDATSGMSMGWNFPLAGRVTTGPVASLHYDGSTTSMFNEFGDSVTAQALTDPLWHASVSTLGWRVNSQFGEIRPWAQISYNQQYGENIWKAQSGLSRMTAADQNGNWLDVTVGADMLLNPHIAAYAALSQADNSASNSDYLYTLGVSARF

SEQ ID NO: 1369 - protein, 215 aa, Escherichia coli O1:K1 / APEC
MYIIDGHNALCTLNDNLMEDYTMKIWRSALAGALLMIGSTATACAATPYVSGSVGIAMMEDSDVQFSGIDDGSITYDAGMAATLAAGLDMGYTRIEGEVGYQENGIEESDDVEVAITTFMVNGYYDFELPASPIKPYISAGIGVADVNAEELSLGDDSSLVLAGQLGAGVGFAVAPALTLDARYRYLMTTEAEFNGDTDISIGSHNVMLGLRLGL

SEQ ID NO: 1370 - protein, 739 aa, Escherichia coli O1:K1 / APEC
MKYMILGLFSLLATGMYAQVRGTVKDSTGEPVPGANVFWMNTGQGVTTKVDGTFSITKPSKSHILVVSFIGFQNDTIHVDSKKQELEIVLRDGVELKEVNVVSRKLGTMKLRNSVMNEDMISSAELSRAACCNLGESFVTNPSVDVSYSDAATGAKQIKLLGLSGTYVQMLTENIPNYRGAAAPYGLGYVPGPWMQSIQVSKGISSVKNGYEAITGQINVEFKKPQLPEADWVSANLFASTTNRYEANADATLKLSKRWSTSLLAHYENETKAHDGNDDGFVDIPQVEQYNVWNRWAYMGDHYVFQAGFKALSETRSSGQSTHGGMYSSELYKVGIDTERYELFTKNAYIFDKEKNTNLALILSTSWHNQDAMYGRKLYNVDQTNTYASLMFETEFNPQNSFSAGLSFNYDAYDQHYRLNNNADTPLKASDKEAVPGVYVQYTLNLNDQWMLMAGLRGDYSSKHGFFVTPRAHLKYNPNDYVHFRLSAGKGYRTNHVLAENNYLLSSSRKVEIAKNLDMEEAWNLGASVSTYIPVFGKTLNVNAEYYYTDFRKQVVVDMDSNPHEVAFYNLDGRSYSHVLQVEASYPFFKGFTLTGAYRLTDAQTTYKGQRMEKPLTGKYKGLLTASYQTPLGIWQFDATLQLNGGGRMPAPYELADGQLSWSRRYGSFEQLSMQVTRYFRRWSIYVGGENLTNFKQKNPIIDAANPWGDNFDSTMIWGPVHGAKAYVGIRFNLARNGE

SEQ ID NO: 1371 - protein, 160 aa, Escherichia coli O1:K1 / APEC
MRKVCAAILSAAICLAVSGAPAWASEHQSTLSAGYLHARTNVPGSDDLNGINVKYRYEFTDTLGLVTSFSYAGDKNRQLTRYSDTRWHEDSVRNRWFSVMAGPSVRVNEWFSAYAMAGVAYSRVSTFSGDYIRVTDNKGKTHDVLTGSDDGRHSNTSLAH

SEQ ID NO: 1372 - protein, 204 aa, Pelobacter propionicus
MHIRLIACAVLALSAAVPAVAADLTYETPAPAAEQISSAYNWSGFYLGGQGGYSWSQTKILGSDENIDGGTAGLHAGYNFQSGNIVYGIENDFNYNFKKNDDANLEWDASGRARVGYALNRTLFFATAGVAAGGGKVDIPTAGKKDGILIGWTAGGGIEHAVTDHILVRGEYRHSDFSNKDFGSAIGDVGAKQDKVLFGTSYKF

SEQ ID NO: 1373 - protein, 525 aa, Pelobacter propionicus
MKHNSKPFKMIKENLMTQSQKVRFLAPLSLALSLSFNPVGAEEDGGFMTFGYELGQVVQQVKNPGKIKAEELAGLLNSNTTNNTNINIAGTGGNVAGTLGNLLMNQLGNLIDLYPTLNTASIRQCGAGATTAATTGSTNHSPCFQGNLTLYNEMVSSIKTLSQDLKNNIFQGNNNTTSANLSNQLSELNTASVYLTYMNSFLNANNQAGGIFQNNTNQAHGNSVTAQQIAYVLKQASITMGPSGNGGAAGAFLDAALAQHVFNSANAGNDLSAKEFTGLVQNIVNTSQNALTLANNANISNSTGYQVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 1374 - protein, 1097 aa, Pelobacter propionicus
MQQEKICETKSFINVKQKSVEMKNKCFVWLMAILLMVPIGLSAQEITVKGNVTDSTGEGVIGASVVEKGNAGNGTITDINGDFTLKVSGKGKKLVISYIGMQAQEIDAVAGKTLSIKLQDDSKMLDEVVVVGYGTMKKKDLTGSVSSMNDKVLKDIPVTSALQAMSGHLAGVNVTVTDGSPDAEIKVRVRGGGSITQDNSPLYIVDGFIVKNINDIPPGDIQDISVLKDASSTAIYGAKGANGVVLVTTKSGKAGKTVVDVNSYVGIKKTYNLTDVLSPYEYVYYQKEIDSSPNVSSAGFYSMYGMWDDIDLYKYREGIDWQDQLYGNTGVQKNFNVSLSGGTETMRYNISYTRDDEDYIMLNSNYVRDNFNIKLNKSFGKVIDLDVTARTTNTVIDGPDVSGGRKLRDGVKYAPVKSITTLSMENLVGTSEELDWAESASMLNDPIYNITNEFKKQYSFVNSYNVGLTFHIIKGLDYRVQGSYSYEKAHTDNIWLKKTGESNANGGQPVAKREYTDGYRFTIQNHLTYDFTVAKDHRFNIMFGQEIFSGKSDKMTLQSKFFPKDFTAEQVLAMWNYGEPLPTYNDIGEPSRTSSFFGRLNYTLKDRYYLTFTAREDGTNVFAPGKQWGFFPAGALAWRLSEEPFMEATKSWLSNAKLRLSYGQVGNARVGSYWRQQYSFESSANRLYYIGEKVQSGLKPTNTLRNENLTWETKTSANIGLDLGFFNDKVNVVIDAYKDVTKDLILAVDIPTHSGYGTQYRNLGQTTNKGVELTANWYAVETKDFNLSLGFNISFNRNTVDKLDGSDSMIATSGWGVSIGSDDYRAIVGKSIGQIYGYKQDGFYSFDDFTFNEETKRWIIKPGVADCSDIIATSGNWFGPGHMKLKKLTDDGSDKVTTNDRTVIGNAMPKHTGGFNINADYKGIDFGVQFNWSYGNDILNANKIDNTTYAGSKKYQNLSSDMALDKRFTTIDPETGYNIMYGEYANPARLQEINQNATIWHPLMNSTVMTDYAIEDGSFLRLSNLTIGYTLPKAWTKKFLVEKLRVYFTGYNLHCWTKYSGQDPEVDTRRSTPLTPGVDYSAYPKAHSFLFGINLTL

SEQ ID NO: 1375 - protein, 437 aa, Pelobacter propionicus
MSVVKGLLYPLPLLIGFACAPSALGAFLKDSKLNLNLRNFYINTDYREGHAGTSKAEEWGQGFRLLYESGYTDGKIGVGVDALGLLGVKLDSGKGRHQGSTTLTSDGDHAADQWSRFGATLKLKASKTDLRVGTLMPKLPVLVFTDTRPLPQTYQGGMVTLRELDDITLTAGKITQVTGVASADRTGMAVAGGRRQSNDFRFAGVDYRTRDNFLLQYYQAALEDYYSQQFLGVSHIWKVTEGRSLKSDLRYFRSRGIGANAAGEPGYQIAGYTPDHRGEIDNDTWSLAFTYAVGGHSFMLGYQSVSDDSDFVHLNQGSLSGDLGARGASTYLIAERLQSYFGRAGQDTQIAQYSYDFAAKGIPGLNVTVAHQDSEGIQSFAGSSLRERETDIILTYAVRSGPLRGLGLGLLYGELNSEVTPDQNQLRLMVSYNVELF

SEQ ID NO: 1376 - protein, 217 aa, Pelobacter propionicus
MRKLMVATLLAGVGVATPALAQDVGSTFTGPRVEAILGYDHVGAGSDVDNNNGRDDQSIDGLLYGIGAGYDVNLGSAVVGVEGEWTDSTAKSDRYDLTDQFGFGRVSQGRDLYIGARAGILANPATLVYVKGGYTNSKLNILAGNTDETTDRSFKLDGWRIGAGVERAINTNTFAKLEYRYSNYTDAHIDYMDGATSADFDVDTDRHQVVASVGWRF

SEQ ID NO: 1377 - protein, 858 aa, Pelobacter propionicus
MPFNIYLKQASLKEFTAKIEQLSEYSFIYGEEVVLKHPITLDLKETPLTTILQTAFIKQDISFEITKHHIILKKTTSLPIKQHFTLNGYVLDEISKETLIGANIYDQQNKQGTITNPFGFFSITLPEGNTELNFSYIGYGSKQIALYLCKDTLLTVQLKNDNTLEEIVVLSDKMETGFQSSRMGANNIPLTHIKNTPALLSEADVLKSIQLLPGIQGGITGTSGLYVRGGSPDQNLYLLDGVPLYNVDHTLGILSIFTPESVKKVDLYKSSFPARYGGRLSSVIDVRTNDGDMRNYHGSLTIGLLTSRMHFEGPLWKDRTSFIISARRSYADLIIKPFMDKDTKGGYYLYDINTKLNHRFSDRDRLFFSFYHGKDHASFTNTSSYYFEEEKETDTRERQVMAWGSTLGALRWNHIVSNRLFHNITLSYNRFRFNIKNNFTSANKHLDSQYYSGIEDWGLTSDFDFHPSPSHFIKFGGNYLYHTFRPETQHTFVHSPNEQEQPDKTYTIGGNEATHSHEISLYVEDDFKWNEQWKTNIGAHFSLFQVQKHTYASLEPRITVSFKTSPNLTFKAAYTHMTQYVHLLSSSNLSLPTDLWVPVTQKIRPMRACQFSIGGYYTGIQGWEFSVEGYSKITKNVLEYKDGNTLVGNSIHWEEKVEMGKGRNFGIEFMLEKKTGRTTGWINYTLAKADRIFSKGNVNGGKRFPYKYDRRHSVNITINRRLNKKVYMSASWIYASGNTATLPKEKATIILPEGSYGWGHMGNTGNGVVFPIEYSSSRNNYRLPASHQLNLGFNFHKKTKHGERIWNVSIMNAYNSLNPNHVFIDYYTDEQSEGKKIPVIQKVTLLPFLPSFSYTYKF

SEQ ID NO: 1378 - protein, 1072 aa, Pelobacter propionicus
MKQWTLNMSKYHRGILDSKKGLQCMMLCIALLAPSYATASTNVGNEQKSFYEVTQPLSMMKETSNVSPIDNSVRGTIIDEKGVPLPGVSVAIKGTSTGVISDINGYYIINAKAGDILVFSFVGFKSQEITVGKKPALDIVMKEDVHELEETVIVGMGKQRKASVIGSISSVSIKELEVPQRNLTNALSGRIAGAVVVQRSGEPGQDNADFWVRGISSFGANQKPLVLVDGVERDMSDLSIEEVESISILKDASATAVYGVRAANGVVLVTTRKGVAQKPVIEVKLETGFSDLPTMPKLLDGVNYALLANEALGTENYTPEYIDNLRSGTNPFLYPNVNWMDQLFRKYSTNTNAAINIRGGGERARYYISASFIEDNGNLKNNPEADYKSNISLRRYNFRSNIDLTLTKTTNLSLEIGANMTDMHQPGLGNEYVDNRWFSPVELLYYYSYLSNPLSAPVRVPIGKDAFGNTEWGWGAPSQVGEVNPAERLFGSGYNKSFRSQIMSQITLKQDLSFLLKGLDIQASFSFDANNQTIQNRRKNSSTYNITGVDDETGEFQVAEITKGNEFLGYNVTPSSNRAEELKVQLNYNQIFNETHRIGAMAMYYQRDYVDQTAGSSIKSLPYKKQGLALRTTYAFKDRYFAEFNMGYNGSENFPKGKRFGLFPAGALGYLISNESFWPFKAINVLKVRGSVGLVGSESLPDNMRFGYLSYFGEGLGGYYFGMAPSFHEGIGEDQIGVADLTWEKGFKKDIGIELKMFDSMVSLDLDYFHEKRSDILIQRQSVPATMGVIKQPFANMGVMVNQGIDGTLEFNHSIGDFRYKLYGNFTYTHNEIKEMDEAQKKYAYRMQTGHRYGQHFGLIALGLFQDQKEINESPEQKFGDVRPGDVKYLDYNEDGVVDEDDKCPIGYSSVPEIVYGFGAQLFWKGFDFGIFFRGQAHVTYGLGGDTFIPFNKGVGKGNLFEKALDRWTEDNPNPNAFYPRLSNGASSNNWQSSTRTIYNGRLLRLADLELGYTFKKNWIAPIGMKSLRIYCLANNVALFAPWDMWDPETASFNGSKYPLPRKVNIGIRASF

SEQ ID NO: 1379 - protein, 1007 aa, Pelobacter propionicus
MNFGPLVPVFLAIFLCAAPLWAQRSAYVFGRIFDPSGASVPEAAITVVDQENGFRRTTQSDPDGSYMVASLEPGLYKVTVRKDGFVGMMRFDVKVSALAPAHADFSLKVGAVQETITVEGTAPLLSQEESSIGLRVFREDIQRIPVNGRGILGLLEFSPGTNITPATRGEAGQFSANGQRPNANYFTVDGASANTGVTAGGTPAQATGGVLPAMSAFGSLDSLLPLEAVDEFHVQTATSVSEPGRLPGASVSLSSRSGSNEFHASMVYRLRHETLAANDWFANVTGESRGPLRLHDLAPSLGGPLLRNRTFFFVSYQHLSLRGSYVFRQPVPSDETRAAAPDWVKPALDLYPQANGDSLGNGLAFWSGRNIRPSQLDTGTARIDHALTSRATLFARYNDSPSFNEFGSTEVNRLDLRFRSLTLGVNYRPGANWTIDFRANESQAEAQSSWAKPGGPILSGCDLEPLTSYLFPSAGSCDALVRFSIGGVGQVVTGREGTRRQRQFQMVESTGWKRGAQSFRMGMDFRRMKPVRRDATGVLSVIADDLSALADKRTLWLGSSPPLNTEADVTELSLWLQDTWQVSSRLTITPGLRWEFNPSPEPAGTTSFFHPETGTVFSDHRPLWPVVYNNFAPRLGAAWRVRKSGRTILRAGGGIFYDSSLSIATDLINGGPLSVTQFTNGRFGIVTSLLSYAFAPRLLLPRLGEWNFTLDQQLGTHDALSVSYVGSVGHRLLRREIGGIGNSITAQFAVTTNHGASAYQGLQAQYRRRLPQGLQVLVSYSWAHALDNDSSDSFLVWTGVGSPAARDHASSDFDLRHTATATLTYDFPVRHSGAGRWVGGWAIDSVARVRSGFPISVVENEQYQGVALANAFRPDQLLNQPVWIDDESAPGGRRLNVAAFLPAAPGVQGSLGRNSITGFGMSQIDLAIRRDFRWKERYTIGIRLEAFNVLNQANFADPVRYMSSPVFGQSTSMLNLMLGTGSPGSGLAPTLQTGGPRSLQGSLRFRF

SEQ ID NO: 1380 - protein, 690 aa, Pelobacter propionicus
MAMPVMAEAPNDANIERINVTGRTFNDYKVGSASGAMRGDIDLMDTPQSVNVIPDFVTDEQLATNLAEVLVNDSSVTAGTTRWNRQVFSIRGFELDSGNGYLINGHQQWSHYVQPIETLQQVEVLKGPSSMLYGQSGPGGLVNMVTKKPTYDSMLDLGFDTDGYGSTRAQLDAGGSLNEAQSIRYRGVLVKQDTKYWREYSTTDENQERDRWLGYLNLEFDISDDLLLSVKYDHTQDKAGIDAGGWLDKQGNVIGERKTVWDAPWAFTDNTVSNLGADLTWQMTNDWKVKVGYNDQQFNRQRLDSAPSLIEGSEDPFKDGYNIKPFDRYDDWQHKTAYVDFTGEFSLAGMEHQFLIGANYLDYFYQQQIQKGKSQRVIPGQPIIQQDLDYHQGQLSNPSEYKYYGFYLQDLMTLNEQWKLLAGVRYDEQKKDTAGGNSYAVSPKFGVIYSPMDNGSIYVNYSKSFTPQGSVTSSEDVNQGANLKPEYGTQYELGTKWELFNDSLLLTAALFDITVSNVTTVLDIPVTSDGDKTITTQGGEQHHRGFEVGAQGQLGDSWFVTSSMMYLDAEYNTGAGKIGGKNLDGKTPIDAPKWSANIWTRYEVTDNFAMNFGAIYVGERFANDVNTITKDGYVRFDVGAAYTTDIMGKDVSIRANVRNLFDTEYLDGGSDKMVTIGQDRNFSVALEAKF

SEQ ID NO: 1381 - protein, 287 aa, Pelobacter propionicus
MDSKRPSKSSPRRSSTALRIRVEFADQFSIGMRNMVPLWGQDWSTDVTLSRIESHDGFAFVRGNRLPDGAFFQPGTISGAPTDGPNGYSAIVLGTNGVETGNTQLALQVEKPFDEASGWGLTVAYTYSDAKENRQFGEHYALDRERIQDYGWREAGGIPNNRLVVTGIYELPYEITLSGKLSLASQTARYGQNCLAGNDQCEIIQFKPDGTLGDKEFSIAANKEWDTGGGVKFNVRADILNVFNWVNYATFNGDTGTLQDLNTAYGTPTGVLASPMRTFRLAFGLNW

SEQ ID NO: 1382 - protein, 689 aa, Pelobacter propionicus
MRWRCPCTHGKGCDMRVWWLKAMWSAPSLAMACGMAGHAQAQDAALTLGKVQVNAQTTRGQSAASVLSSVDVIGGALLHDQHVDYSWELLMRAPGVQVTPFRMGTDAGRFSFRGFNGEGRINAVKLLIDGIPSNDNAGGMPYLDAVFPQDISAIEIVRGTNDARYGLHAIAGSVDVLTRTGGNDGRLSVTAGSFGAREVQLGKGIEHGAWSQNYVLAWRDSDGYRDHADARKRSVAGKWFYTDPGGAFRAGLTTRYYDNHALEAGYLDAASARAAPRSSPAYAQDDRSERTLRQTALHADGTLGSDAQWSAKAYRNEYHNQRWVRFSEAGQQQERDTDETHQGMLLRGNWQPGWQALPTTLEAGLDAQWQDNQSQRYRTVARVRSAQLRDWDYDLRMRGAYVQAVLKPTERLQLVPGYRIDRVDGELRDLRAGITAPSYDYGTIKQPKFSASYRLAGQSSAYANWGRTFQIGTGDGAYRRQPGNLGPSINDGWEAGFKFAPTAVLDGRLAYWEQRASGEVATILGVNGVAGVGDVANVGRTLRRGWDAQLNLQPAEHWRAWLSYSRQKASIATPDPSAPATRGREIENVPHWLATAGVEWQLTPAVQLSAWGNAQGDYYLERTNTLGRTGGYALLNLGARWAVDARNTVSLQLRNATDRSYVYAWYDSGSSGYSPGDGRALSLSWDWSF

SEQ ID NO: 1383 - protein, 871 aa, Pelobacter propionicus
MKKQIRTLSLTTTILFAGAVGIAPGSAQGVGPDPEGGADIVVTGSRFGSRSIAESPTPIDHIGTEELNRGGRVEIQEMLKTAVPSFSTPRPNASGVGDFTTPPTLRGLSTGQLLVLVNGKRRHSSGDLSTSNGIGRGDVAYDFNSIPSAAIGHIEVLRDGASAQYGSDAIAGVINLSLDKSEGVSGKVTTGITKQGDGEYVDVGAGFGLAIGDGGIIRTTVQYQNRRGSNRADPDTRQQYFGTNAAGAPTAISSFYGSGVGLTPSNGTLDPREATVDRDTSYEGTAPFTMKAIFVNSELPVGDAVTLYGFGGYSDLDGKTANFFRRAGQDQTVRSLHPDGYAPYGEFGLRNLSAFGGARGDDLAGFGWDLSTGFGKSLINSDISNSNNPSLGNASPTEMRISRIRFSQWTTNLDLTREFDVGDSTPLKFAFGGEYRKEVWRLLAGDPASYVNGGVGIIGGPANGAVAPVGAQPNPGVSPADATTGKRNSKAVYGELEKEFFDRLTLNGAVRYEDFSDFGDTVNYKLSSRLKLVEALALRGSFSTGFRAPHLAQSFFNSSLTNFINGAPVLIRNFPVDSAAGRLIGATPLKPEKSRNISIGAVAKLSSWTITLDGYRIKLKDRIVQSSTFQDARLTNLLAANGFPGIGGAQYLTNAVDSTTHGVDLTVSGSIDLDDFGKLAVLLAGNYNKTKLDRVAGTPAPLAALGITTPLFDLTQQVRITDSQPRSKVLLNLNWSSGDFTVGLTNTYYGKVSAVAFTTLTPAQIAVLTQNYDVTLVPVSATSPNSQVIQHFKGKLITDLQLSYDMTKEVRLTVGVNNLFDIYPSQNIRSTVASVAAGTNGSDNGGTFPYNAISPFGFNGMSFFASASVRF

SEQ ID NO: 1384 - protein, 801 aa, Pelobacter propionicus
MRLPLIFLLFTFCSVAVQAQTIKLLDKQTKSPVTNAALYNSARSTYVVSDEEGNADVSAFTKSETIFITHVSHITLKTTKAAIVSEGNVVYLEDNENQLNEVVLSVSKFEQESKDIAQKIVSLDAEDIEMKNPQTAADFLSQSGQVFVQKSQLGGGSPMIRGFSTNRLLLTVDGVRMNTAIFRSGNLQNVINIDPFTIDQTEVILGPGSVVYGSDAIGGVMNFYTKKPAFSFEEGTAFSGMALTRYATANNEKTGHIDFNIGAKKWAFLTSVSYSDFDDLRMGSHGPEDYLRPEYVVTENGVDTVVENDDPNVQTPTGFDMINLTQKVRYMPNSIWDFNLGLHYSATSDYARYDRLTRTRNGQLRSAEWYYGPQLWFMGNLQIDKKGNGDFYDDAKLTAAIQYFEESRNDRDFGDSILFTTQEQVNAYSLALDFTKKMGSNQLFYGLEYVYNKIGSYGKQIDINTGDQAATATRYPDDSSWQSLAAYLSGQFNLAESLTLQTGVRYNHILIDATFDDTFYDFPFEKADVSFGNFTGNAGLNWQTAENFNLKLNLGTAFRAPNIDDIGKIFDSEPGSVVVPNPDLKAEYAYNAELGAAWRIDEKLRLDVATYYTHLNNALVRRDFSLNGATTVDYQGEPSNVQAIQNAASAEVYGVEAGLEYLFNKNIKLTSQIAVTEGSQEEEDGSEAPLRHAAPLFGNTHLIYRMKRWKFDASAEYNGQFEYDELAPSQQGNAYLYALDADGNPYSPRWYTLNVYSEYQIAQNWKATAALENITDQRYRPYSSGISAPGRNLIMALKYTF

SEQ ID NO: 1385 - protein, 828 aa, Pelobacter propionicus
MNTKISLGLTICCLCSGLVAPLPILAQINNSGAQTKIQAQVGSILVTGVNLKSTEKGLELELANNSPIPVQPLIYPQGNLLIIELTDALLDIPGGEFNQENPSPQIAAIAITQGENNIVRITVTGVDNNLPEVTVSSVDQNLVLSLTSSSTAIAPENPESEIEVVATQEGQGEASYFVPSASTATGLDTPLLDIPQSIQVVPQQVLQDRNVTELGPALQTVPGVSPAGGRGTSVFGPGFLIRGFPVNNSIFRDGIPYQSLAPLNTTDIEQIEVLKGPSSIVFGAGEPGGSINLISKKPLDEPYYNAAVSLGNYNDYRLDVDLSGPLLPEAIDTVNYRLNVSYETSGSFRDFVYGDLWVVSPTLTWNIGPDTKLNIYGQYTTNRETLDEGIPAPNIADLPSNRFLGERFSKFEQDQYLIGYTFNHDFNENLKLRHAMQYLAYAPVRYAPLFDFFDEDTGELNRFEYYGGGNYQRFFTNAELIGEFYTGPVKHRVLFGLEYRNDTETPEFQFSNTFAPINVFNPVYTNTPFPIAPEFFRDDQVNRFAVYLQDQMDLFDNLKLLVGLRYDSATQNRSTQSITDPREEFNQTDNQLTPRVGIIYQPIPTVSLYGSYTTSFNPSFAASLNADGSTFDPQTGRQFEVGVKADITDKLSVTFSAFDIRKQNVPTIDPANLLFTIQTGEQTSRGVELYLGGEILPGWNIVTGYSYLDAFVSQDNTDIVDNTLSNVPSNQFSLWTTYEIQSGNLQGLGFGLGLFYVDQREGDLDNTFVLPSYFRTDAAIFYRRENWELQLNIENLFNTQYLAESNDFDLSVYPGAPFTVVGKIGVTF

SEQ ID NO: 1386 - protein, 724 aa, Pelobacter propionicus
MRRRGTNEVAFALLAGTAVAVALPARAQPLVPVEASPAAVALDELAVEGLGRGALRLEPQGGVTVGYLGKATRSATKTPTPLLDTPQSVSVITREQILDQGFQSIGEATRYVPGVIQAQGEGNRDELIIRGQRSNADFFVNGIRDDVQYYRDLYNIQRIEVLKGPNAMIFGRGGGGGVINRVLKEADGVPTREIVAQGGQFANKRVALDVGDRVSDSVFFRMNGVFEDTATYRDFVDIRRYGVNPTMTFLLGPQTTLRLSYEYFHDDRTTDRGIPSQFGRPYRYRDNRTTYFGNPFLSPTYVNAHIATAQLDHVFENGVVMRSQSRIADYEKFYQNVFPGGAVNAAGTAVNISAYNSQTDRTNYFNQTDFTYQFLTGPVKHTLLGGFELGYQEGLSVREDGFFATTGTQTLVVNPLAPLTRVGVNFRNIASGANSTYDLGLAAAYVQDQVELNDYVQLIGGLRFDHFDFAATDRRTNITNARVDDLISPRAGLVVKPLPNLAFYTSYSISYLPSSGDQFSALTPGLVIAQPERFENTEVGVKYDVSPVLQLTGALFNLDRTNQRIADPNRPGFFLTSGQTNTQGAEIGANGYVTDWWSIAGGYAFTDARIANRLSDTIVAGNFVGLVPLNSFTLWNKFDIDPSFSVGVGFINQSHSFATSDNTVRLPSYSRFDLGLFYRISENARAQVNIENLFDRNYIVSAHNNNNILPGAPRTVRAQIIVRW

SEQ ID NO: 1387 - protein, 1083 aa, Pelobacter propionicus
MKRNLQKGILVTSACAAFLLGNVQQAYAVAADAIEIVQQNKKIAGIVVDQNGEAVIGANVIQKGTTNGTITDIDGKFTLEVPAKAVLTVSFIGYQSQDVALKGNETQLTVTLKDDTEVLDEVVVVGYGTMKKRDLSGAVSQIKSDDLMKGNPTDLSQGLAGKVAGVQINAADGAPGGGVSIQVRGTNSFSTSSQPLFIVDGVPFDAGSTPASDANQNSNNTSNPLSFINPHDIQSIEVLKDASATAIYGSRGANGVVIITTKRGEAGYEQVEFSSNFSFSRIANKVKVLDAATYASYINEQDLNSYQYDGKPYAQLSYPGMWSYPSLPNGTLDYENGKYLPSPKDYRNPGYYTDEYGNQTWVGGADWQDLIYQNGFSQEYNLSVSGGSEKGWHAFSGNFLNQDGIIKESGFTRYALRANIGRKMYKWLEMGMNMNFTHTETDFSKTNSNDYGVIRSSLIFPPNYDPTHMDQTTNDELSWLASNPYAYINDTKDHLKAINVFTSSYAEVKLFPFLKFRQNLGISYTNHNRGTYFGQQTQEGSGQNGINGKAGQSDNWYMGITTESLFTFDKTFGVHGINAVVGFTAEKTNWGSKSMSATGFPNDLTQDYDMSLGTKPGKLQSDRGDAALASFLGRINYTLLDKYIFTASYRTDGSSKFTDANKWAGFLSGAFAWRMSEEKFIKDLNIFSNLKFRASYGETGNQGIGSYRTLPMLSVANYPFAGGINSGFAQVDWRGPVADDLRWETTAQYNVGLDMGFLNGRINLTVDYYHKKTRDLLQEVKIPLSTGFANMMVNSGYVTNEGLEISGKFYLLQNTPLKWNIDANISFNKNQIGGLEADQFATRLWYKADEVFLQRNGCPIGTIFGYVEDGFYDNLAEVMADPDPAVRAKGQKMIGEIKYRNFDDNPAITNADRVIIGDTNPDFVYGITNNFSWKNFTLSFFFQGSQGNDIFNGNLMDVKMGNVANIPQAAYDTRWTPETTAIAQWPKAVSSYERNMLISDRYVEDGSYLKLKNLNIGYNWANPFKGIKNLNFYASATNLFTITDYSWFDPEVNAFGSDASRRGVDIYSYPSSRTYSIGMKVTF

SEQ ID NO: 1388 - protein, 681 aa, Pelobacter propionicus
MKMMTKKPVVVALTMAFSSTAYAQQVEQVTEFDEVLVTATRIAEKASQSSRSVAVVDEEELQEAQPASVAEALQNEANVTVSNGPRASSQGVEIRGLGGQRVLQTIDGARQNTASGHRGTYFMDPELLSSVEVVRGPASSLWGSGAIGGVVAQNTKSAKEMLDEGESFGGYLKQGYETNGDNVKTSGAIYGVADRFDWLINGSYNDSNNIKIGRDQTLANSASQRSSGLMKFGWEPSDEQRLQFSARFSDTDELVPSNPAAEVGSSVPLVKRKTKDKNFTLEHSFNPSSNPYLDIKSTLYWNSTDYDEDRVTKGQIDSTEYETLGFSINNSSIFGGTTLTYGVDGYQDKIKTVRDDAGQVGQRPGDIDGETSVWGAFAKAQVTLTDSLSLEPALRYDTFENESKTLSKSSDDTAWSPSLGLVWNTSSWLTLSARYDEAFRAPSFEEMYSTGTHYCIPPIPGFLPGGLCNTFEINPDLKAEKAKNKELKADLHFTDLAGNDELGITLNVFRNDVDDFIEQSVSNPLMGIPGLEQTTSWNNVDEARLTGFEFKTRYRFNQTRLTLNYGQTEGKDKRSDEYLSNIPAKKFGVDLSQGIMEGDMKLGTRVTHVAQQDQLPSENKQDYDSYTLWDVYLAWEPAMGTFEGLRVDFAIENIGDEEYRQAWQTLYEQGRNMKLSARYRF

SEQ ID NO: 1389 - protein, 397 aa, Paracoccus denitrificans
MAANQYHTGTARLTDQYFRTLSMNLTARGEFETGPVTHNWSTAFDRVIRQRKTINGSGNGNSKIEVKANENIANQLASFKADYPNSWANSANLDANIKVNSLALSDTLGFVDNKYPLTLGGRFQAVEYTDKKKSQSGDAKRFSPMLMAAWVPQPDLVVCGNYMEDLERADIKTDDSGETTMAKPRVSRQFEIGVRKNWGDFVTTLNAFQIKRPGYWRGNTKKGTDFAAYKAAGGAAGDEQGMERNRGIEFNAYANLLNKTLRPTFGVMYLQSSVKNYPNARDMLVNGVQVANPRVIVKTGVERDTPFAKGLSLNGNVSYFGKSYQDTQKQYAFPSYTLVDVGARYKTKLGKNTLTVSSSVENLFNKNYWQVQRGQFDRSFAVVGLPRTYWLKAELDF

SEQ ID NO: 1390 - protein, 715 aa, Paracoccus denitrificans
MCAVGRYWPLTSCYAAVFGCFAGYNTNRKQVLLGIVMIDQHFMGKRSQIARAMALVLIIAPQAYAQEGEAEQKNNASQEDQLVVTASGFKQNKKYAPASISVIDQKTLEKQNSHDVAEAVQDISGVSVSNGAGTEVSGDVMIRGMDSSYTSFMVNSIKQNTGESRPYGQNVGTEAGFLPPVAAIDRIEVIRGPMSSLYGSDSIGGVVNVITKKPFGVREWMGSIAANSFLQQHQEFGNTQQTNLFLMGPLVPDVLGLSLSADYLDRREDEKPNSFSKNNKKSIDMTLGFAANETNLFDLNLVKGEKKRSRTEKGGGTPWGWDFDRDALSLTHSGWYAEDSVATTSYFQYEKGESTFHTSTLAPQHIQSENYVLNSQAKLSLGEHNLTLGANYSRETLNDDFYADSKRAPGIEPVTKISRDGWALFAEGQWNIDDFSLTTSARMDRDNYFGTHISPKLYGNWILDSAWALKGGVSSGYKKPSLRENSDQFITPRGSNPPYPYLSVGNSELKPETSLNTELGLYWNNNRDLSFDATVFYTDFKDKIAEVNICEASANHPCVVNGYSAESIDKYFNIGKANVYGLELNADWQATDLLSFSANYTFNKSEQKNGVNKGYALNDFPKHMANLSAKWAATSALDVWSKVNYRSRNEETGDHTRYGAYALLDSGVIYHFDKHTQVMAGVYNIFDSAPKRTTSWGEYPQLEGRRYNLGLRVDF

SEQ ID NO: 1391 - protein, 159 aa, Paracoccus denitrificans
MKRIITGCLLLNFAMAAQAECNISSSIQNIDYGKRSAAMRQVDRGKTTQLADRTITLVMQCDQDAHIRVQLNTANISNNGFGFGPNGSLNLIASDAFSGSNNLDLALASGKNDNPGSTGTASIREGANKRGNSSRLTQSFHFFMFEPIFSPVNALNQPI

SEQ ID NO: 1392 - protein, 363 aa, Paracoccus denitrificans
MKKVFYVLAATLTSSFAFAQEDETSTPPATTWGGSADAYYKYDFSKQMNGLTSFTNSQDSFELGMASIEASHTFGKASVFVDLGFGKRAGEFSYNETTDKDINAKFLIKQLFFTYQITDEFKVVAGSFGTHIGYEVLDAVDNKNYSMSYAFSYGPFFNTGVKAQYTAGKFTAMLGITNPTDFKSAMDAGSSQKTYIGQVGYIGETGSAYLNFTSGSTNPTPGSLIPVSNENKTQFDLTASKTISDSFGLGLNATYAKTKHDFDSTLDGEWFSLVGYANYSFSPSLLLAYRMEYFDAKDAAPSLGTLTGSSVFANTISLNYKVGKLTIIPELRYDAASEDIFLDKDGAPTGGSFFGLIATTYSF

SEQ ID NO: 1393 - protein, 875 aa, Paracoccus denitrificans
MVQARVILKKNFSGRRKALTLCITLILHIDTAFGQEEPQNFEFDESLFLGTKYASGLTQLNKKNSITAGNYDAVDVLVNNKLFKRMSVQFIKDANSSEVYPCLSDELLTAAGVELGRENSTPPKEPHVTEANTPITETHAPTNQCLPLSTRVKGASFRFDQAKLRLELSIPQALLQKRPRGYIERAEWQEGEKLAFINYSANAYRSDTRGQQKRTSDFGFIGLKSGINLGLWQVRQQSNVRYASNDSGSDTQWNSIRTYVQRPIPQLDSQLTLGETFTDSTLFGSMSFLGAKMATDQRMWPVSMRGFSPEVRGVASTNARVIIRQNGREIYETNVAPGPFVINDLFSTSSQGDLNVEVIEANGSRSTFTVPFSAVPDSMRPGVSRYNAVIGESRDFTNIDNYFTDFTYERGLTNQLTANSGVRLAKDYTALLAGGVLGTPVGALGLNATYSHAKVENDKTQDGWRMQATYSQTFNQTGTTFSLAGYRYSTKGYRDLNDVFGVRSMQKNGGTWDSSTYKQRSQFTTTINQDLGNWGQLYASASTSDYYNDTARDTQLQLGYSNSYQQISYNLAVSRQRSVYTSTLYNWDSPDTDETATTTRYGNTENIATFTVSIPLNIGSNNQYLSMSASRNPKSGNNYQTSLSGTAGERNSFNYALNAGYDDSNFGSSSNNWGANVQKQFPNATVNGSYSRGNNYTQYGAGARGAAVIHRQGVTLGPYLGETFGLIEANGAQGARIDSNGFALVPALTPYNYNTIGLDTKGINRNTELKENQGRVVPYAGAAVKVKFETLTGYAVLIQAEGEGLPLGADVYNSKDELVGMVGQGNQIYARIADNKGTLDVRWGESSGDQCQLPYAFNRQDTEQDIIHITASCRR

SEQ ID NO: 1394 - protein, 803 aa, Paracoccus denitrificans
MRVTMRLTLLSKLIVGALIGAPLVSYANDETSASDVGERQLEVITVTAQKRTQSVKEVPLSVATVSREAIEDMNISNTEELSSRIGNFSVSQSGQGFNIYMRGLGSGPNQGFEQTVGTYVDGIYRGRGHLMRSTFLDLEMVEVLRGPQGTLFGMNTTAGALNLTTAAPTDYFSGYLNGNYDMTDQGLTFEGAISGPLADNFQARFAFRAVDSDGYMTNSVTEQNEVQHETLLGRLSLAWQPTDRLSIDLKLQEDKDEFVGDSNTKGILEPALAAANPALAASLGDYGVSLASAKTTPSLGEVEGGEFTASHQTLKIEYELDEHTLTAISGWQSYQVDTSNDGDRTPRPLLFRSVSDEEYDQFSQELRLASQGGETFDYILGAYYQDSELNYDEHFLAYALQFDGVRQFGTDSEVMSVFGKFDWQLDDNWSASLGLRYTHEEKEGSRDLTLVDLVSGEPISQVPLITPPALKPALDQFGLPAIPGSVYSLMLGADYPYLDPLLLGSNTQNIANPIYRTGADHSIRAERTEESFTPALSVRYQLEDAMFYASVAKGAKSGGFDARANLPENFEFDDESVLSYEIGSKLTLDSGAADLNLALFYMEFSDLQTSTFDGNTGFFVENGAKATSYGLELDGRWAFADDWMWSGSLGLLDFSWDEFSGAKCFTSLSQTSTNIEANGSSCDLSGQPNALSPKVSGSTWLEYRSELSSDYDIRVMAETVFKSSYFTNADLNPFTEQEAFVKYNAQIALINTNSDWQLGLILKNLSDEITINSSYDMPFTPGGYVVYTEPGRTATLQFSYKFD

SEQ ID NO: 1395 - protein, 327 aa, Paracoccus denitrificans
MFHSGAYAENKSTMISAKEVAESDAFFYLGAKLGVNHYQNGCQPWNVSCDKTDEAGGVYGGYQFNQYFALEAAYLHLGDAVAVYPVNGLNQTYTGTMQGLELSALGLLPITDRFSLFAKGGVYNWHATNDGPHQRIKESGLSPTAGLGLSYQLSISWQARLEYQYFYELGNEEVGGSHGQLTTLGIAYQFGRIKPTPVVQNIYMPVQLETFSFAIIFDFAKSEVLLKNDLQQVVTRLNKHPQATVELTGYADAKGTEAFNLTLSKARVKHVSDYLIEQGVKAEQITEHHLGEAEPVIGNDTDEHRHLNRHVQVLLPAVTIYPTLEAQ

SEQ ID NO: 1396 - protein, 480 aa, Paracoccus denitrificans
MKIRHKPLRTLVSTAVLGVLATGTLNAGGFSLYTEGAGYTTGNFAAGVAAEAADASTGWYNPAGLVLIRDQQAVFAGVGVFPTAKLSGVSTYSTINPPPFPSFVYSEVFNNINGAEDAFVPSFHYALPLGENATFGLSVVSPFGLATDWGPDSPVRYQATFTELITTNISPEIGGRLTEHVALGAGLDLQYARVKYNRILGVPNILNVLPPFNPMLADSLTYNKGHSFGVGFHVGVLGMFNDNHTRLGANYQSSMRHEFYGYSRLTGPLASPGNILAPFLFPAPGIFQSDDLFSNSIDFPDVVTISAYHDVNDKLALLGSLVYTAWSSYKTVQLSNAAAGRPADNGNVSQAKAISISPQNYNDTLRVAIGANYHVNDKLMLRVGGGYDPTPTNNIDRDVRLPDTDRWALSAGAHYQATNNIGLDIGYTHLFTSSDPVINRTDAFTATTRYNVTASGTAGANLVGVQATWTIDKEPPAPTK

SEQ ID NO: 1397 - protein, 666 aa, Paracoccus denitrificans
MSRTLLASASVLALSSLAWPGIAGAQQKEETTVLEPITVTATKRVQEAFEVPATVAIVEAQELQDRGIASAGELDRAFVDTNIRSRSNRAYTNVTVRGQSSVDYYEPSVQLYVDGLPQDPSIFSQLLPAGLDSVELLYGPQGTLYGRGAIGGVINVVTRKPDNELRVDTAGALHTQGGDASLLLNTPIIDGVIYGDAALTFRREADQYTLLGSGQEIGGTDDLNGRIRLRYAPDDSPLDVMVSTQRGRVDSTEEQFVMESMFNDRIALPIDSRYRLDTASFGVNASYDLDFATITALTGYQDRKLDRTTLGFQTPEDQTTFSQELRIASDPELGNALDYVVGVYGQRLDFERRTPLIGQVSQQTIDSYAIFGDLAWHATDRLDISPGLRFDYEKARARADGAVTIAGERSFGGVSPKLGASYALDDEWRVHGLFSTGYKAGGFTRNVTPENIAFTYDPQNTYNGETGIKYRALDGSLEASLSAYYNVTKDYQLFVGDVYLKYLQNAGEVTAKGINLAFRANPTERLGIAGGLGLNRTTFTKYENSVNPGIDYTGNRVPYAPEFTANLALDYAFDLAEGWGQLIPRAGMTYAGSVFFDETNTIGQKGFFLVDLGLSWKVSEQVVADVFVNNVFDETYAVYGFTEATYGNLYQLGTGRAFGGRVSFKF

SEQ ID NO: 1398 - protein, 371 aa, Paracoccus denitrificans
MNRSKILLALSATAVINTSSAMAAGLSLSQIGTADSVATAGAAGVTNNSDAAATITNAAGLSGIEDSNMMLGGQLLDVRSQFEPKEGESTQSNGLQFIPHLSYAKRLNEDWVAGIALHSPGGLGVAYSNGIAGGAQNIVKENKITMLSLTASAAYQINEQLALGASIITNYAGVEASVFDRTVTGKQLAPTFALSAQYQLNEKTRIGANYQHGSEHDIEFDEALLGIQGMAINWPATFDIGIDHQLTEQLNIMANAKWQSWSDYDANYQDTYSAGIAAGYQAGHWLWQAGFSIDSSPVDAEYRDIVLPLDKQWRLGIGAEKTLASGAKLGIAYQYQNLGDAEIISQGRELLRPSGEYSENRVHFITLSYQF

SEQ ID NO: 1399 - protein, 691 aa, Paracoccus denitrificans
MSSSSLFRLTGLSVALMSAMAAHGQDTSDISIERMIVTTKATAPSTTKGDFSLLKAPQNIQILSKNFLDDQGVVHLEDALKNVAGIQPGGYYQGYDYFRIRGFDASQNIYLDGLRLNDNGLGANVEQSNLETLEVMKGPSSTLYGAGAISGMVNLVTKRPTQTDMGSVSLQGGNLGYRELDADINRVLSDDGDIFGRVGLAYREAANSVDHIDGQHRFFIAPSLTFNLGEDAALTLLTSYTKDDNQLGMPLPAMGTVLPSPLGELDKDLFYGNIKDPGAINDETYRLGYELRWDLTDNLQLRQNVRFQDASSDWHNLYYPSSYDADTGDLNLYKFSYRTQWKTWALDTGLNGRVMLGETEHLFTAGVDIFMSDLYTSGALGSDFPTINLYQPDYSVFPDTEVNQFGPESKVENRILGLYAQDQINLGEHWSFTLGARFDRYKQAYVEDYETKLSPRAGVSYAFNDDWVAFASYSEAFTPQSYVDSNGKVLDPEEGQQWELGLKSRAFNGDLNATVSLYELTKKNIALANVDAGGNFTYSASGELQSRGIELDLQWLLTQDLQLIGHGAYTHAVDTEHDKWVANVPRYALGGWLKYNLDDMLDGLSVAAGVNHYGKQQGNVQAVLTDSSEGDFYLPAYTLVDLNLTYSWDQYDLRFIVNNLTDEDYFSGSDSLLRVLPGSGREVKLSFTANW

SEQ ID NO: 1400 - protein, 607 aa, Paracoccus denitrificans
MAFPLHSFFKRVLTGTLLLLSSYSWAQELDWLPIPYVYVAKGESLRDLLTDFGANYDATVVVSDKINDKVSGQFEHDNPQDFLQHIASLYNLVWYYDGNVLYIFKNSEVASRLIRLQESEAAELKQALQRSGIWEPRFGWRPDASNRLVYVSGPPRYLELVEQTAAALEQQTQIRSEKTGALAIEIFPLKYASASDRTIHYRDDEVAAPGVATILQRVLSDATIQQVTVDNQRIPQAATRASAQARVEADPSLNAIIVRDSPERMPMYQRLIHALDKPSARIEVALSIVDINADQLTELGVDWRVGIRTGNNHQVVIKTTGDQSNIASNGALGSLVDARGLDYLLARVNLLENEGSAQVVSRPTLLTQENAQAVIDHSETYYVKVTGKEVAELKGITYGTMLRMTPRVLTQGDKSEISLNLHIEDGNQKPNSSGIEGIPTISRTVVDTVARVGHGQSLIIGGIYRDELSVALSKVPLLGDIPYIGALFRRKSELTRRTVRLFIIEPRIIDEGIAHHLALGNGQDLRTGILTVDEISNQSTTLNKLLGGSQCQPLNKAQEVQKWLSQNNKSSYLTQCKMDKSLGWRVVEGACTPAQSWCVSAPKRGVL

SEQ ID NO: 1401 - protein, 1266 aa, Paracoccus denitrificans
MRRLPGILLLTGAALVVIAALLVSGLRIALPHLDAWRPEILNKIESATGMPVEASQLSASWQNFGPTLEAHDIRAELKDGGEFSVKRVTLALDVWQSLLHMRWQFRDLTFWQLRFRTNTPITSGGSDDSLEASHISDLFLRQFDHFDLRDSEVSFLTPSGQRAELAIPQLTWLNDPRRHRAEGLVSLSSLTGQHGVMQVRMDLRDDEGLLSNGRVWLQADDIDLKPWLGKWMQDNIALETAQFSLEGWMTIDKGDVTGGDVWLKQGGASWLGEKQTHTLSVDNLTAHITRENPGWQFSIPDTRITMDGKPWPSGALTLAWIPEQDVGGKDNKRSDELRIRASNLELAGLEGIRPLAAKLSPALGDVWRSTQPSGKINTLALDIPLQAADKTRFQASWSDLAWKQWKLLPGAEHFSGTLSGSVENGLLTASMKQAKMPYETVFRAPLEIADGQATISWLNNNKGFQLDGRNIDVKAKAVHARGGFRYLQPANDEPWLGILAGISTDDGSQAWRYFPENLMGKDLVDYLSGAIQGGEADNATLVYGGNPQLFPYKHNEGQFEVLVPLRNAKFAFQPDWPALTNLDIELDFINDGLWMKTDGVNLGGVRASNLTAVIPDYSKEKLLIDADIKGPGKAVGPYFDETPLKDSLGATLQELQLDGDVNARLHLDIPLNGELVTAKGEVTLRNNSLFIKPLDSTLKNLSGKFSFINSDLQSEPLTASWFNQPLNVDFSTKEGAKAYQVAVNLNGNWQPAKTGVLPEAVNEALSGSVAWDGKVGIDLPYHAGATYNIELNGDLKNVSSHLPSPLAKPAGEPLAVNVKVDGNLNSFELTGQAGADNHFNSRWLLGQKLTLDRAIWAADSKTLPPLPEQSGVELNMPPMNGAEWLALFQKGAAESVGGAASFPQHITLRTPMLSLGNQQWNNLSIVSQPTANGTLVEAQGREINATLAMRNNAPWLANIKYLYYNPSVAKTRGDSTPSSPFPTTERINFRGWPDAQIRCTECWFWGQKFGRIDSDITISGDTLTLTNGLIDTGFSRLTADGEWVNNPGNERTSLKGKLRGQKIDAAAEFFGVTTPIRQSSFNVDYDLHWRKAPWQPDEATLNGIIHTQLGKGEITEINTGHAGQLLRLLSVDALMRKLRFDFRDTFGEGFYFDSIRSTAWIKDGVMHTDDTLVDGLEADIAMKGSVNLVRRDLNMEAVVAPEISATVGVAAAFAVNPIVGAAVFAASKVLGPLWSKVSILRYHISGPLDDPQINEVLRQPRKEKAQ

SEQ ID NO: 1402 - protein, 822 aa, Paracoccus denitrificans
MSSFPSKPSRLACHHAVAAAIALLAVQLSPAALAQAAPVTAASTDFHIPAQPLDQALAQLARQAGLQLLAAPELVQGRRAPAVEGRLSTAAAVARLLRGSGLEGHVSQGTLVVEKPAGTVALPEVTVSAVGETTTTEGSGSYTTGLMSTSTKLPLSIRETPQSLTVVTRQKMDDQGMLSIDDVANSATGITINRWSDDRARYFSRGFVIGSFLQDGVPVSYETDTSTYDTMAMYDHVEVVRGPTGLMTGVGDPSGTINFVRKRAPRTTQRSVTLRGGSWNQAVGEVDVGGALNEDGSARGRVVASAQSRDHFIDGYSSRRQLLYGTAEFDLGRDTMLSVGGSYVNEDNPGSQWMGVPMGFDGSFLDIARSRRFSPSWSKWDKKEISLFADLEHRFDNGWKARLAARALQAKSALDGAYLVSGGLDDQGRTRYDVAGGLYDYDRRQLSLDASAQGPVRLFGREHDLAFGVSRRTIRWSDQGYSYLSPTGEWLIANGVDPYTWNPDSLDRSGLLAEDLWTRRQKTTLTSAYATGRFLLAEPLNLIAGTRLDWYDFTNVQRQGSWSREREFSEKAHATPYAALTYDINKTYSAYASYTSIFRPQDFLDVSGSMLAPVEGRNFELGLKGSYLDERVNLAVAVFKTTQDNLPQAIADINSCTVKTNCYRSVGKVRSKGLDVDISGEILPRLNAGLGYTFTQAEIASDSTEGAKGAPYASYTPRHQLKLSAMYHLGGELGAWRVGGGLRYQSRTTSESLTSAEGYAIRQSAYAVADLVIGYRVNRQLDLQMNISNLFDRRYFETLGTNNGGNYFGVPRRLLLTAKYQF

SEQ ID NO: 1403 - protein, 851 aa, Paracoccus denitrificans
MRRGLLSSASIAPFALGILYIPLAHPVEAAAGMHQHGASQAQNEGSPQDTAQGAAQDGTVQDVVVVGEEDRGEQKMEEVMMHTPRSGDVVTGKQAQEQQFTTLNDYAQKIPGFRPNITTPHFSRMAIRGLGSAMAGATSAGYQSETGFVVDNVPWIQPEYQAGDWTNIESFEISYGPSGTSGGKNTDVGTIYITTPLPSFARKTQLETSIGSYGHVIQKVDATGPVIDEALAYRVSGYYERARGWIRDAGNGQDYGDINRQGIRIQLLGVGENFTDRFIFSFNNIAEYTGYGQGAGGGSATAPIGDSFLVYANGTRPASTYFQTFANRLGKPIQTTNPYQPYLGHPGLDYARVGTISNELNYQLGQHTLTSITAFGYFNAPMYDCTDNQSAWIGAGTCNMDNYGMQVSQEVRLSSPKGEQFEWLAGLYTLYESNWARMHHTELGPYAAQWLNNPAAMQGLINWFNTGVRDTQVAGYASGTLHFTDKFSITAGVRNSYDMRYQTTTWVPQLVSGSPYSYAQQISALIAGGGGGNVTTGGHTNNHNGVTALLNPSLQVNDNILLYGLVGRGDKAPTANGTAGPVTPGNLANGFTPFFNKSTRSLDYEIGLKTNWFDDQFVSNVNFYWNDLWNFQTPQSLLYTTSAGILASTSYMGNAPHVRLRGVEFIERWAPNFIPGLQVHATGAYTEARYISYDQAPAPADYTYPGGPSTVSLSNTRMTGVPWWSFNVGVDYAHPVGQVFRELGEALHDTSAWTTTSYTAFGYGNVAWFNKSQLTNPRSVYQYWQPAYSLVNLGAGLRTDDRNYAVTFWVKNLFDARPFSAFTVGNATAPAAVSLTMQGPRYFGVTFSAAL

SEQ ID NO: 1404 - protein, 851 aa, Paracoccus denitrificans
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQVCVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQTTLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 1405 - protein, 381 aa, Paracoccus denitrificans
MFKRTLMAAAMAAVPFSAQAAQSAEDLQKQIDILAQQVEALQKEQGASSNPFGKVSIGGYGELHYNHFNKDPEFGGKQQNDEVDAHRFVLFFGYDFTDKVRFFSEFELEHGLAGEGKDGEVELEQAYIEIDTTANTKLKLGQFLVPVGIINETHEPNTFYGVERNRLESAVIPATWWEAGAMFSQDLGAGLTYDIAVHSGLDFQGSTTSIRGSRQKVSEAAANKGAATGRLRFVGIPGLDLASSVQYQQDVNQDLGPEDVSARLVEAHARYTIAGITATVQKARWDFNGFNTAADRQDGELYELSYKATEKLGVFGRYENINLLAEDGTDNEASMISTFGVNYWIVPQVVVKADMQNVNYKNSTEDDKADDSINLGIGWSF

SEQ ID NO: 1406 - protein, 364 aa, Paracoccus denitrificans
MKLRPLALSLWLAVPAFASAQSVTLYGVVDTGVEYVNHIGTAGSSVVRMPNLSGTVPSRWGLRGTEDLGGGTKTLFALESGFATDTGTSNQGGRLFGRQAWVGLSNDNWGQISFGRQYTMLFWATLDTDLLGPNAYGSSSLDSYLPNARADNAIAYKGKFGGLTVGATYSFGRDTVNAGPSPSGTNCAGENPADSLACREWSAMLMYETGRWGVSAAYDSLRGGPGAFAGLTSSSLKDDRLALGGYALFDNARIGLGWIGRRNGALATPRSDLFYAGAAYDVTTALTVAGEVFHLRYHNSANKAWLGAVRASYALSKRSSVYATVGYLANGGNLALSVSSAATGASPAAGGSQLGAMVGIKHVF

SEQ ID NO: 1407 - protein, 791 aa, Paracoccus denitrificans
MCIRRISFFILLCCLCWNVFAAEYQIKGVVIDKSTRQPLEFVNVLVVGLGIGASTDANGNFLITQVPPGIYRLQASFLGYKTELTPEYRVNHVTPYVQIELEEENASLNEVVVTASPFQKVPESPVSLRVIGLQEIEKAPGANRDISKVVQNYPGVAFSPIGYRNDLIVRGGGPSENRFYLDGVEIPNINHFSTQGASGGPVGLIDADLIRSVKFYSGAFPADKGNALSSVLDFSLRDGDMERNSLKATLGASEVSLSSNGHIGDKTSYLVSVRQSYLQALFKILGLPFLPAYTDASFKIKTRFDSHNELTLLGLGGIDRMKLNLGIEGEDAEYMLSYLPEINQETYTVGGVYRHYSQRHVQSIVLSQSYLNNRNVKYRDNDESSEENLTLRLGSIEQETKLRMENTSSWSVWKVKAGFDLNYSRYKSNEYRKVFANVLREYDYHTDLSLWRWGMFASVDYAAPDKSFTASMGVRTDGNNYSDKMKELWRQLSPRLSVSYRLIEGLTLSGHVGLYYQLPSYTALGFKGEEGEYVNRHLDYISVSQESLGLSWTPNENMELSVEGFYKLYGHMPFSLSDQIPLSCKGNDYGTIGNEALSSEAKGRSYGVELMFKWLLTQKLNLSSSLTIFKSEFKDGEQGGYVPSAWDNRFILNMSGTYNFPKHWSLGAKVSCIGGSPYTPYDVEKSSLVEAWNVQGRAYYDYSRYNQERLPVFGQLDVRVDKTFYLKKCMLGFYLDIQNITASKLRQPDALMSTGQIENPSAPLSEQRYVMKSIRQESGTLLPTLGITFEY

SEQ ID NO: 1408 - protein, 811 aa, Paracoccus denitrificans
MPDQRPRYFNHLLCRALLPQAVFLACLGGAVSAPAFAQTPAAAQVETLITFNIPAGTLDQVLNGFAASAGVMLAIDGTLSAGKTSQGLSGTYTRKAALEKILAGTELDYHLSEDQVITLVKRKSVGQLKTVKVSAGAIHTGTSAEGYRATNTQGIGPLAARSLQDTPFSISVVSEELIENTASGSFDQLFKMTPVVQNNAPFTVFGYPTLAVRGFAQSTGVVDGVKLSSYTYGLSTEELERVEVINGLTGFMYGAGNVGGTVNYVLKRPTYDRLTNLTIGSYGNQQGYVHADLSDRMNEDGTFAYRVNALYSDGDTAKEGQSIERKLLSGALDWNLTKDFLLQFEAAHTTLHVDKPDTRFYSAGISYWPDAFDVSETYTPDWNYNDTRTDRASIKASFAINDSLSFRSAYLYKEDERHHIIIYPIYSETGWTLYNPGKAAPYTVVSEGAYAYMDSLFNTGPVQHNLTFGISGDTSTQNTHVTSYVYDSSFVVPTNLTLEQFMDLEMPAGLRSTDYGPRYKSNDTQNTNIMLGDSITFNEQWSSIVGLNYTTIKTKNFSAAGLTTSAYDNSALTPTASVIYKPIQNLSLYVSAIEGLEPGSVVPDDPAIYNNPGEILDPFISTQYELGAKYSINEHILLSSAVFNIAKANSFDERTADGKITRNQDGEQVHRGIELTLTGKVTDNLTIIAGGTLMDLSVEKSTNANLEGKKPIGAASTMAKLYSEYSVAQIPGLTLTGGMYYTGKKYKDSMNTQEIDAYTLFDVGARYQTQLSRFPTSFTLNITNLTNEDYWSSYWQLGIPRNIAFSMRTEF

SEQ ID NO: 1409 - protein, 1013 aa, Paracoccus denitrificans
MNGQKQNFFRIFLAGVLILLSFAVYAQENTVTGKVYDVSGEPIIGASVVIQGTTQGTITDMDGAFQLKAQPSQTLVVSFLGYKDVILPIGNKNNFKVTLEEDSKKLDEVVVVGYATQKKVNLTGSVASVSSKDIQDIPVANTATLLQGRLPGLVLTQNGAQAGNDNPEIRIRGIGTFGNNNPMVLIDGVEGSLSQISEIPSADIDNISVLKDAASAAIYGVRAANGVILITTKRGQASSRVKVSYSGSYTLQTPGIVPDYVDSYNWALMKNEVNPDTFSPEALQKLKDGSDPDHYANTNWLDAVLRNASMHQHHLSVSGGSENTHFMASVAYSNQDGIMVKTGVERFSFRSNLDTRYKRFTFGLNLSGNKNNVTAPAVAPSGEGGIMRFVSWFTRPTVPVMYSNGHYGYVDGSSMSAEMVKNPVELMSLGHRSNEYWRFNGKAFAGIELWEGLKFQTSLAYAFDLNATKSYTPKSPARYDADGNIVKAAGETNKEEDYWYRNATWTNENLLTYNKQFDKHNINVLLGHSVIGSRFYKTTASIQGFPTENIYELKGGTINPGATGESEEYKLQSFFGRVNYSYDDRYLFEFNIRHDGSSRMPKANRYATFPSLSAGWVFSNEGFMKDYRNFSLGKLRLSWGKLGNQEIGNYAYAATLGASGNYFFDQGADKQAGMVQTSVPNENIKWETTRSVNIALDLGFFNNRIQTTFEWFDKKTSDILMQLAMPGIFLGSLSAPYQNVGAVRNRGWEWTVNYSDSRGDWAWNAGFNLSRVKNEILEMGELEEKIDGNIINRIGNPIGAYFGYKAIGIYRTEADLQRTNSKGEVIKQNGVAPKLGDIMYADLDDNGNITPEDRDIIGNPFPKYSYSFNLGASWKNFDLSTFWQGVGGIYRYSWETSTDIRGNLTSRWVNRYSADNINAPMPALGNTMNDSYSSFWLEKSDYLRLKNLEFGYTFRQAELAKVGISSIRVYFAGSNLLTFTPLKNWDPEKSSGDTRNDVHPNMRTYSFGLNIQF

SEQ ID NO: 1410 - protein, 472 aa, Paracoccus denitrificans
MRRASGLRGWNAAVPRPATRVGRPAQSASWPGATLCGRLRTADGRAISDVTPFRPRASRYRAVRAAGHHNRPNMRRVLARPARLRRSDMKKHALFAAALAAFAAPAFAQDSVTLYGLIDEGFNYTNNVNVNGVGKTNYQLASGYAQGSRWGLKGSEELGGGLKAIFTLENGFDVNNGRLGQGGRMFGRQAFVGLSQSRFGTLTFGRQYDSVVDYLAPLTANGNWGGTLFSHPFDNDNTDNSFRVNNTVKYASPDWNGLTFGGTYSFSNSTGFSTNRQYSVGAQYSLAGLQVAAAYLQANSPGAGNAGAIAADDANFVADRLRIFGGGINYTFGPATVGFVYTKTDVKNPVSTVYLPASTFSGLGLTATKFQNFEVNGKYQLTSDFYLGAQYVYTDGKFDAAAGSFKPKYHTVGLMADYSLSKRTDVYLQGAWQKVAGDKTGTAADGGYVVGTDGPSSTSNQFSVRAAIRHKF

SEQ ID NO: 1411 - protein, 774 aa, Paracoccus denitrificans
MMFSSKLMLSATTALALLPSAGALAQKAGPAAVEAAPAEAAPRTSDAEIVVTAQRRQQRLLDVPISVSAFSASMIEKAHITEAKDYLALAPNISFTEDGEKGNRSINIAIRGVSNVDLGEQSTQQSIGYYIDELSTGSSANGTLNPQLLDIERIEVLRGPQGTYFGRNASGGAINITTKKPTDSLYAEGGLEYGRFDTQKVYGIFNAPLASNLFFRGLASYEKSDGLIRNLDPRGTPNSGYKNLHLRGAVRFVPTENLTWDLSVDYARDRNGMDATVPSGVLDLDTKSIFGSDFQAIDEGEGFYPANQRNVRHNTREWNNNSATIINNRLTWKGDDFSIHSITGYIDSSNSRQFDQDNISVDALYRHNRNSGRSFSQELRVQSEGTTAIEWVVGGLYANDRIRQFNSIRAGTETSYTYPDGTVIGLLPPIPPEFRVNENNKIFKTESIAAFADATWHVSSKVDLVAGGRYTHDKISNRNFGVVAFESPVPDIAGSKSFSDFSPRLLARFKFNRDNNVYASVSKGYKAGGIDINSGFASPFRPETLWNYEVGLKGDLLDHSVQYGLSFFYLKWKDLQVQTNYLAIPGDISSATELTLNAARATNKGFEFDVHARLSSTLRWNAAFGYLDSTFKSFPDAVLAGGNQVDLTGYRLPKTPRYTISTSLDYDAEVADGVSLYLHPEINFRSAAPGDLEGVAAVPLALPSFPYQPKAYAVVNMFGGVRFGRFEIGGYVNNLFKEDYYTGTADNFGLGGIRLRPHPRTFGATAKVKFGADG

SEQ ID NO: 1412 - protein, 268 aa, Paracoccus denitrificans
MVTCLLSGGGLPLHRVVLRSCVRSRPNRRGQGVFLQWRHSPKRDCMKHVLTFTALILTASGSALAADNFYGAVRINSANYKAHDMDSSARPGLGQFVPGDDSRRATGGSLALGYQLPSDWRLEAEYTLPRSNEFTSGSTRFPTSFNHHSIRSQRLMINAYKDFPLNAQFSVYGTAGLGLAHLQSSGWQGNPNRQYFSDSQNNLAYALGFGVSYSPIQKVSIDLGYRYVGMGKTHSGANNFTNVRGLQDEQMRAKLSSSEISVGLRYSF

SEQ ID NO: 1413 - protein, 365 aa, Paracoccus denitrificans
MMKRKILAAVIPALLAAATANANAAEIYNKDGNKLDLYGKAVGRHVWTTTGDSKNADQTYAQIGFKGETQINTDLTGFGQWEYRTKADRAEGEQQNSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGADGSADLAKYIQAGATYYFNKNMNVWVDYRFNLLDENDYSSSYVGTDDQAAVGITYQF

SEQ ID NO: 1414 - protein, 802 aa, Paracoccus denitrificans
MKFFSLVFGLLLSFQLQAQQCDFKISGVVKDFHDGNVLPNSTLSINGYDIYALSDLDGKYELSGLCKGTYVVTITHPECEVAQFTVEVTDNVQRDFKLEHHTEALNAVTVQGENTNRGTVSGTQTRLESGVLENYSNASLGDALREVAGVSSLNTGSTVVKPVIQGLHSSRVLIINNGTRMEDQEWGVEHAPNLDINAAENVTVVKGASALRYGGDAVGGVIVTNAPKAPAKDTLYGKTILSGATNGRSLGVTTSLLKAFESGFYVQGQGTTKYAGDLESPDYVLSNTGLREHDFSIGFGLNKFTYGFDAYYSFYNSEIGILRASHIGNLSDLIRAINSGAPNYVRDFTYDINAPKQDVSHHLAKINFYKRFEKAGKLSLDYSYQQNNRKEFDIRRGDDRDQASLDLQLTTHTLASNFLYDAASNLKANFGVEASYQENFPNPNTGIRRLIPDYEMYTAGAYATADLDISPKWRIDGGFRYDFMQIDAQKYYLTSSWENRGYESEFGDLVVQRLDNQLLVNPVFDYHNFSGTLGARYRIKSNWDLKLNLSSASRAPNPAELFSDGLHHSAAIIELGDLRLDQEQSYKASLELNGQTGGLTFGINPFYNHISDFIIMEPNGLQYTNRGAFPVYQYGQVDARLFGVDVRANYTFDANFNLQTVFAYVNGQDLDRNRPLIDMPAPNINTTFGFRKAEWNNLNIGLRNQTVLEQTRFPNNDFEVTYINDSGEQTTETVAVSQPPSGYSLFHLTSSVDFDVFKQSTLTLGFFVDNILNTAYRDYLNRQRYFTDDLGRNFRIQLKLNY

SEQ ID NO: 1415 - protein, 753 aa, Paracoccus denitrificans
MPIEALAEDAETDDRKEEVSGGTRVKSARDTIVVTGQSLSGSDGATPLPVTVLSGEALVHRRRGTLGETLDGLPGVHMDNFGAGASRPVIRGQTLPRIEILSDGANVFDAASVSPDHAIVTDPLLLDAIEVQRGPAAIRYGGSAVNGAINLIDSKVSKALPDGGITGATEVRYGTADQEMTTAGRITAALGPIALHAEGSYSDHEDYDVPDSYGSGRLADSFAESSSYAIGASWVTDKGYIGVAYTRQDAQYGLPGHSHANGVCHLHGYPFPAPGRIDLHCIGHGNYQNPLTNPDSDTALIDLRSERVDLRGDFVDLLPGISNVRIRGSYTDYQHDEVDGPILYSRYANEVWDGRIELTHKPLFGFTGTLGVQYTDGTFSGLNLIDLHVPPTASFGFAGTQEYRTENIGVFLSERRSFGPVDIEIAARKDWRTIKTPIPGEFYINLEEEYWGYYIDNYGDDWRQDVERERRESFIASNPDRKHNPFSISLGATWNVTDGYSLALSLAQTERAPNVRELFADGSSLATNSYEVGLLATGFVQDHLPQDLFSYDDDVMERARAINLTFRKAGGPLEFEVGAFYQDVDNYIFAHLLETEFTTGQRHDFLLYTTADAEFYGVDGEVSYQFDESSQVTVFGDYVATNLTNDDHNLPRIPPGRLGARYAYAAGPISGDIEYYRTFGQDKVALYETPTDGYNMVNATIAYKIDMARGADLELYARGTNLSNELAFVHTSFVKDQSPLRGRSIVFGLRTQF

SEQ ID NO: 1416 - protein, 767 aa, Paracoccus denitrificans
MSKIASTSFLALGCVGALAFSGAAQAQTQGDETARKLGGMTVTDTAIDEPAIKVDKPESPKYVRPLLDMPQTITIVGNQTIQKQNLLTLRDVLSTIPGITFGAGEGGGGYGDNINLRGQSANTDISIDGVRDSAQYSRTDPFNIEQIEVTNGANSVYGGSGAIGGNINIVTKRPKGYDETLVQGGIGTSDYYRATIDSNVRVSDFAAVRLNAMYHENDVPRRDVDRYERWGVAPSVKLGLEGPTSLTLLYTHQEDQNTPLYGVPYYKNAFHDGILPGVPYSGYYGYRNLDKQDQTIDQATAIFDHRFSDVFSIRNLSRWQRVEQELIVNPPQGDYCLASGLLANGDPCSDTQVPGTYYPRGPRGGFRNTENQTLYNQLDLTFAIPGGHSLVIGTSALQEDYTLDSGNVLRNVGGALPNPTLDPIDISNPDAIYTGPVNPIRTRRDDGDLFNVAAYAFAAVKIVEQVELNGGIRWEHNRARFRSDSIATPALGGAYSAGARQQSTDDLFSYRVGLVFKPVDYASLYVAYGNSKNPVSTTVRSGCGLADEGNNFTDPCNIKPEQAVNYEIGGKIDLFDRQLQLSAALFRNERTNYRVTSNDPLVGDLAVNDGRNRVNGVTLGATGNITPAWTIFANYTYLDTKVIQSISDYQKSQGVVDLQAGNSMTNNPKHSGSLFTTYTLPFGLQLGYGLTYQGSWYLSNATGAPMYKTDDYLVHRAMLSYPVTESLTAQLNVQNFTNEKYFTSVRNNGWANPGEGRSWVLTLNYKI

SEQ ID NO: 1417 - protein, 501 aa, Paracoccus denitrificans
MRPVYHGGVSARPGTSLEFYRLPLSPSPMPLLFPRQIARPLPRHTERAAARRLRNTLAALALGLGLHGTALADPAAPNAPEPAATQDLPEPQPWNLHGQFTSVTQWHPAFSARYSGPNSLAPASEDRATTDLTLFLGVRLWKGAELYANPEIDQGFGLNNTLGMAGFPSAEAYKVGKNDPYHKLPRLFLRQVIDLGGAPQAMESAPNQLGGTRAADNLTLTIGKFSVIDIFDTNAYAHDPRGDFLNWSVVDAGAFDYAADAWGYTHGAAVEWTQSWWTVRGGFFALSKVPNSATIDTSYKQYAWVGEFEARHQWLGRPGKVKLLAFANRARMGGYGDALSLAQQTGDTPDTSLVRHLAWRAGIALNVEQELAPDLGFFARASMNDGSKETYEFTDINRSVSAGFSLKGDRWGRHDDTVGVAVVVNGLSRAARRYFEAGGLGVLIGDGALNYGTERIAELYYNWAAMRHLTLGLNYQYVVHPAYNRDRGPVSIVGLRVHADF

SEQ ID NO: 1418 - protein, 273 aa, Paracoccus denitrificans
MDAATQGKGLSAAQIAAIKTKKTNEALAKLQQRVNDLSQNGLSGDIDSKREAWGYGFQLGVNYKVNDKLNLAARYDSRIKMNFKAKGHEHQLETTDILKQTIGLSTFYPQYTINSKIRRDLPAILSVGASYKVADNYLVSTTANYYFNHQAKMDRVTTFGEHEHGRDYKNGWEIAVGNEYKLNDKFTLIGSLNYANTGAKTASYNDTEYALNSFTLGGGIRYQYDESLAITASVAHFIYQGAEGNFKEKYGVTENQKYKKEITAVGLSVTKKF

SEQ ID NO: 1419 - protein, 947 aa, Paracoccus denitrificans
MPRHLCRATLLALISVGSVSTAGRAQGRTELGPALTRLAVERNVQILFQPHLVEGLVANPVRRGTSLDQAMTMIIGRQGLRIRKVRAGIYAVEPEIRSISPPASLSKEDSPSVVAPLIVTAVYAASLERTLALKRDATHGLDAVSAEDIARLPAANAAEALQLAPGVSLERHRGVGLYVSVRGLGPQFQNVLLNGRSIAINDLVENGGFRGRQFRFEVLPSDVIDRIEVIKTTTADMDEGALGGNIDVRTFKPLERGPRAVLSARASQGQAGKPDPAVSGVWSWVSPDGHLGLLAAGMAERRQIRNDRLYQTGWNLDRFTNVLPAGLYTPTRTRPTIELEDRRLMSGDFALQWRPSPDWRTDIDLLVTRLDAHYDEFGLDIYPDDTTFAHPAFVAGSQRVVGDTVQAGQIDNVRWMASRETSLNRHDLAAFGVRQSWTPGAWALDIDYAYSRARSYHPDGQGTVRARAAFFAPLIYDFGGGLHSAPTLKTTIDYTDPARFVGQAFDYTWKDSRDTDEALKADLARSLGAGKLSLGVEGHRRVRDYRRRDWILNTVVGAPLTSLGGEYYGQTPVSDYLAGTRGELPRHWVALDARAFYEQLFTEEIAALPPTVSDRRNSFVVEEKILSAYARGDFSARWFGLPVDGDVGVRYASTRQISTGVLSSGAEPIPAQWRKAYGNWLPSANLRVTLTPDLLLRLAASRVVNRPNVVDNAPRITLARDTPTANGGNPDLDPFLATQLDASLEWYFPSGGALTGAVFDRRLDNYITAQNTFIQVPGRGEILLSTNVNGGDARIQGLELAYSRTFKSLPAPLNGLGMQGSLTLVRSQANYFAGDRVIRNALLGLSRTNYSLLAFYERGRASVRLGYNWRGAYLTTIGSSITAPATTAAFGSLDGAASWRVNRRATITFEGVNLADARRFVYGESRDQPMEIHHWGRYLSTRLRWAF

SEQ ID NO: 1420 - protein, 391 aa, Paracoccus denitrificans
MNKTFTYSLAATAIFTSLNAFASGLFLQEAVVANAGTTGAGDGVYTRSAAAMWTNPATMSHMGESKTTINTMAFDLEMKYQDNGDKQDGKAHSIMPSFGAFHAHQVTDKLHLGIALGAVGGSSLDYGSEWAGAPLLEDITLTAMQVNPSLSYKLNDQWSVGAGVQFSWGAFQQTTSGFTAKQDTDWAYGYNLGVMYTPTDKLKLGASYRSKLEHEFNNDVKGLGSVNSLSTDLALPEIVDLSASYALNSQLDLLASIQFHRWSEWDETVLDFGVTDRDGIPIKRDWDDVWKFAVGADYQLNSDWRLKAGFSYETSPQDDPSMQWVDLPVGEQYRYSVGASTYWDDILIDVFYEYADLGSVDMNRNLADSQVNLLNGSFDGRIHFIGVSATF

SEQ ID NO: 1421 - protein, 699 aa, Paracoccus denitrificans
MLFRRLAIPAAASSLLLPAVASHAAEDVATLPSVTVSAAGDGQADIGFATRRAAGVTKSGESAADAAQSITVITRDLLDSQQAQNLSDALQNSAGVVTNTFGRRGWDDFIIRGQRASESIFADGLLVDSNNRVAQQLFGVERVEVLKGPASILFGAVQPGGLVNMVSKRPRAELFGELGLTVGNYGFRQMTVDVGAPLARDSKAAFRLNGLVMNSDDPTDFVWYRNRWLAPSLTLDLGARTDFTILASHNQRNYVRQQGLPVNGTLVPNRNGVVPANRFIGEPNAPSYDGEQNRIGYALTHRFDSGWTLNQNLRYQTSSLTGTLVSAGTMALNSQSMNRSGTQQSFSGDSFGVDTNVQRTFAFTGHAHSVTFGVDYRHTKEDRLQKTCRVAALNVYNPVYGASINCPSAYSLDATDTLDALGLYLRDQVRVGERWTVTGGVRYESARTGTTDRLASSRTDNDSNAVTGSAGVMYDLTHWARPYASFATSFLPNAGTDASGATFKPEKGRQYEVGVKFDMPGKTGLLTLAAFDLTRANVLSSDPVNTGFSVAVGEQRSRGLELELTQDLGNGLSVSAAYAYIASEVTEDTTAANVGKPLNSVPRHSFSVWSQYRLRGALAGWYVGAGVRGESAKRGYSFNYTVPGYAVADLAVGYVASHWRAAFNVKNVFDKMYYAGGLNNNVLPVGNPRVAMLNVTMNY

SEQ ID NO: 1422 - protein, 1045 aa, Paracoccus denitrificans
MKTQIRKTALSLAIAACVGVSGAAIANETTSAIKGQITGPNGNPAAGTKITILHVPSGSVKTTETNDAGYFTAKGLRVGGPYRVVVDSDTYADQEFNNIILNIGNDYPVNASLENISNIEQIVVTGAPISAMSGGTGPASTFTLTDLENQPAINRDLKDIIRIDPRITIDDSRGSINCGGGNPRYNSLTLDGVRMNDNFGLSSNGYPTIRAPFSFDSIEQVSAELAPFDVQYGGFTSCNINAVTKSGGNDVHGGVFFDYTNDSMKGDEIEGNEVDNGNYTEKRYGFNVGLPLVEDTLFLFTSYEKLEGVRQFNYDGLSSGSVTADDVSRIQSISQSVYGYDAGGMPSSMPVEDEKILVKLDWNINEDHRANLIYNYNDGNTISQSDTGSSRVSLSNHFYNQSAEFTSIIGSVYSDWSDDFSTEIRLGKSELDATVQSLDAASSFGEMQIRTDNGGTVYIGPDDSRQSNDLDYDTTTFKVAGTYYLDQHTITAGYEFEELSVFNLFVQHTQGEYRFDSIEDFEAGQAARIYYNNAAGTNNPNDAAASFKYAQHTFYVQDEYAFSDLDATIQFGLRYDKYTSDDVPNLNKNFTNRYGFSNQSTFDGIDLLQPRVGFQWYATDELEVRAGLGLFSGGNPNVWLSNSYSNDGITNISTQFRGVDLFNTANVNGGTPGFDVPQEMFDIVANTEIGVGDATVNAVDPDFEIPSEWKYSLGATYTTEDEYVISVDYLYSKKKDAALMRDIALQDSGETTFDGRPIYESIEGRSNEYLLTNVSGDSGDSSVISAAVSKMFDNGINFSFGYAYTDADDVNPMTSSVAGSNYGNIALTNPGNPGVASSDYEIPHRFTMTLGYKYEFVDGFETRFNLYGEAYKGLPYSFTFDGSDNTDANRNTTFGDNNWNGNRQLMYVPLENDPNVVYNMSADEINEFNDFIASEGLKRGEITGRNQQNADWFVKFNLKVTQELPGFMEGHKGEAFFVIDNLTNMLNDDWGVLKKGPFVGASMISTSIDDQGRYVYSGFNGNNANTSVQTGASVWEMRVGVRYTF

SEQ ID NO: 1423 - protein, 375 aa, Paracoccus denitrificans
MTDSYFHKKDGDDMKLRFGVLTMLAVAQGAWAQSSVTMFGLIDSGITYVSNEGGGKNVKFDDGIFAPNLFGLRGTEDLGGGYRATFALVNQFSMANGSIVGTGIFGRNAYVGIESDRFGSITLGNQYDFMVDALFSKGNAISRDISGLYGFRNGPFQRLALPGNPTGAFDWDRTAGSKPIANSVKYSSPTVAGFSGGVMYAFGGVAGSVGADNAVSAGVNYELGAFGVGAAYTNEKYGPAPGVPSTSVRNWGVGMHYDFGVVTAKALMTTVRNSFNDAGVWMAEAGGLWRIRPDIVLGAKYMYIKGNEAVNDNHAHQISVALQYLLSKRTMVYVSADYQRANSGANAQVNGVLDPNGASSSASQAVARMGLHTVF

SEQ ID NO: 1424 - protein, 287 aa, Paracoccus denitrificans
MRRRTKVLALARSLTLLASVGVPCLAQAADLLPPPPMPEPLPEPEVFAGGWYLRVDGGYGSLDLRKSIAEDVSHPPKPYDYAVVQDKVSNQYFIGGGVGYQINPWLRVDATGEYRFRSKWTFVAEDKTFGDTGGYNLTSGKFDSIVGLANGYVDLGTWYGVTPFVGAGVGVAHHSFGGVTDKGFGAYEGGYGIGRHNERTNFAWALHAGLGYAVTQNIRFEAAYRYLNMGEATTGVVTCAPDCPKTVYRVKELDAHDVKVGLRYLFGAPVAVAAVDYAPPPPLVRKY

SEQ ID NO: 1425 - protein, 728 aa, Paracoccus denitrificans
MLATPRVGALACALLTCAPWALAQQTPPPVAPPAATPSDEAASTLPEVKATSQAETATGPVPGYTARRSATATKTDTPLNEVPQSISVIGAEQVRDQNSLTIQEVLRYTPGVRAEMYGLDNRGDYYAMRGGSEGSTLLDGLRLPITGYWGSVRNEPYAFERIDVLRGPASVMAGQNGPGGVVNLVSKRPSAEAQREVQVQLGNDDHKQVAADLGGALVDDGRLAYRVIALRKDSGSQVKYADQERTLFAPSLRWQPLAGTSLTVYGEYQKDRSLNQNGFFPIAGTLNKAPNGRRIDPEVFVGEPDWDTYGGTRKRFGWELEQQLNAQWTLRHHLRRDNVTGHLATAYADWSQYVGADGQVDTVDPTNNTYLNRYGYVADDRSRINNADLLLQGKLAFGRTTHTLLTGVDYMSHRMLHIDRGSFLMTPLDPFDPVYGTSPLPALDPAQSFVSDSRVRNVGLLIQDQVKFDERWVLTAGLRHDKAKTDAAKDSANSKNLGIVYLADGGWSPYAGYSESFQPVAGTTSPARGGRPFEPSRGRQLETGVKWMPADAPVSASAAVFRLKESNRLANDPADVNYSIQVGESTVDGLELDATATFAAWQLLANYSYTRARLTGAIDVNRGEQLSSIPKHAASLWAVHRFGAAGMPGLRAGGGMRYAGPSWDGSGNNRVPSVTLLDLLVSYDTGPWTLSLNVNNLTDKTYIATCLERGDCWFGTQRRAVVSLAYRW

SEQ ID NO: 1426 - protein, 951 aa, Paracoccus denitrificans
MNSLSLTAKAVRYGIFAAASLTTSTFVYSEEQTEIFERIEVTGSKIKRIGELAPTPVTVISGDGLIDAGVVNVADLLHKMPNTLVGLSPETTNNTVFASGLNNTDLRGLGSDRTLVLVNGRRFVAGAPGSGAVDLNNIPTAMVERIEITTGGASAVYGSDAIAGVVNIITKKSFDGISVDVSTTQPTEDGGEEKYASITFGSEIGKANFVTNLSWARQEQLSFMDRKFLRDAPIVVRNPNATGPDDPQSIVWGHGQQVLASYSKTGTFVSNGTRYSFDENGNVRPMELGQPLPPLTSGRVDYLGGEGYNFAENSFIKTPLDRINFFSVMNYDINDDHKMTMEATLSKTDAYGESSPAFLSFKVHDDNGFLSPEAAALIAAEEARLVNAGKAEPGDGISLGYLASDFGNRKYSQERTTARIALGFEGALSENWSYDTYATVGHVQADTEWYGEMFEQRFYDAVDTIKNDKGEVVCRSESARNNGCLPLNIFGRGMYDKNAYDWVSTDAIRRSSITQSALGASVSGDLFELPAGFVSSAFSLEYRKEQADTLPDPAMREGLLFNNQSQPLKGEFDVTEASAELSIPLLSDITLVQDLTLETAFRYMDYSTSGSDTAWKVGLNWAVFDDLRIRLNRSKSVRAPNIGDLYSPPGQTFRSIKDYCASSYRNQINPEYLDNVLANCAAQGIPTDFEPSQEWYGSTRPGFIVGNEDLKNEVANDITIGFVYTPNFIENLSFTVDYWKFDMENVINSFTGPDVVKYCYQSSTLDNPFCPLLERDPDTHELTNYYEKPVNSATSITSGVDIEANYKFESSFGDWGFRLFSTYLEERSFNSTGFAEDEIKETGEQERPRWRHRFTTDYTYGDFSAVLTANYRSSTVLSNDWSPNQNNYNDIPSYITFDLTSRYNITDALQVRAGILNMFDETPPRQPGVYNQGAYYDILGQRITIGVNYTF

SEQ ID NO: 1427 - protein, 1033 aa, Chlorobium phaeobacteroides
MNRIFVIFALLLAFVAQVHAQKEQSFMLTGTVFDEFNEPVPGANVYVKDKPGVGITTNIDGKFRLKVNIYDIVVVSFLGYENYEQRLTNKIDNVKVTLKPATENIDEVVVVGMGTQRKVSVAGAITTMDPAQLEVPATNIVNTLAGRVAGVIGVQSSGEPGKNISEFWVRGIGTFGANSGALVLIDGLEGSLSQIDAADVESFSVLKDAAATAVYGSRGANGVVLVTTKRGLESKLKISGRANMTISHLKRLPEYVNATQYAEMANEASVATGLSPIYNKTEMDIIKYGLDPDLYPNIDWQDVILNPNSFQQTYYVSAQGGSSVARYFASLGMSKESAAYNPSKDSKYNKGVGYDTYNYRLNLDIDLTKTTKVYIGTTGYMSVNTRPSMGEYSRGVSLTDWLWSSQAKTTPISYPLRYSNGYYPAAGTKDEISPYVLLNYTGNAREQNTRNLVTLGITQDLSMITKGLSAKVQGSWDTQSLFGEARYKMPELNEALKERNPNGTLSFEKIADEKTVTYSSAAWVWRKLYLEANVNYDRTFGDHRLGGLLFYYIEDTSETGADKSMNAIPKRYQSLSGRFTYGFKDTYFWDLNFGLNGSENFEPGKQYGFFPAGAFAWVPSSYEFIRENVSWLNFLKLRVSYGVVGNDRISSRRFPYLTLIKEENASNPWGGTGSLTEEQVGANNLMWEKAKKFDVGMDLHLFKDKFTLTLDYFKDTRDGIFQERKQIPDYVGLIQMPYGNIGRMKSWGADGNMEFYQQIGKDAHVILRSNFTLSKNKILNWEDTKKPYTYLENNGYANNVQRGFVAMGLFKDQQDVEMSPTQFGTVRPGDIKYRDINGDGKITDDDKVPLFAYSGVPQLMYGIGAEFRYKSWTLNVLFKGTGRNKFLYGGSDGRNFDGYMPFNQKDKGNIMTIAYNPENRWISAEYSGNQATENPNARFPRLYYGKNENNTKPSTFWMGDARYLRLQELSLAYNLKVPALQRILGINSMNIQLMCENLAVWDSVNIFDPEQATSCGQAYPLPARYSLQLYLNF

SEQ ID NO: 1428 - protein, 434 aa, Chlorobium phaeobacteroides
MKKVLLTGIGLVASALIATPSNAAPKFYFGEGKELEIFFANQLWGVYTMDRVEGGQKYDNRMDFFLRRSRLGFQGTITEDLSWRVWFAYDNVGLDQHTALAKSNNNVGLVSSNGSIANNNQNQQFYIWDAMFTYALHKNWANITVGYFRPQVGRESITAGFEVLSFEKALTNFYLRQHLVGTGPGRETGVNIGGLYNDEKTKLGLNYNFGVFNVDKFSGGTGGDNLLYTARVAVSYGDPEMKKYGMGYKVNYFGKRNGITFAVNYAYQGRGKDSNTFPLADTTIWKLTYYDSSAKTVKVQFKNNQMLGFDILANYKDFTFNAEYDELKRSFDVSSLDYKDKVWHVRGGYNFTLPNKTILEPAITYAEWQGDKASLNGNGNFKTTDVGLNWYIKQNNMKLNLHYVKQSGSSKSAYNPNGNSKAGDYIGVGLQLIF

SEQ ID NO: 1429 - protein, 222 aa, Chlorobium phaeobacteroides
MKKSLSLLAAFLVAGMWSAPVQAADHYVSAMAGMSWFQDSDIEHVYADTDYKDVATVSFDSGLTAVGAIGCDYGSTRLEAEIGYQKNDVETDSDYLSGDVQVLSLMANGFYDIDLGGVDLYAMAGVGVAQVNVDIDGERYSHRYQTWVDTNYEASEVTLAYQVGAGLAIPVGDGVMIDARYRYFATTDFTAGDDGAASWMGSADYNTNVSSHSALLGLRVNL

SEQ ID NO: 1430 - protein, 615 aa, Chlorobium phaeobacteroides
MKKTALATAVVSLLSHAYTSPVFAQNTTTETDETMVVTANRFEQSTEDVIAPMSVVTKEEIVQIQAKTMTDILRLQPGIEVASNGGIGQNASIFMRGTNSDHVLILIDGFRMNSSIKSGMNINKIPVNQVERIEIIRGSGAVMYGSDAVGGVINIITRTSSDNQSKSATIGAGSDRYKEGNFAANTKVGENGHLKMAAGFTQTEGYNVNPQPGLNDGDKHGFENSQFMLNYEHQLSSYVSLFTGVRWFNSTSEYNHYTNTKSRSESESTVYSSKLSFHKDAVSSNLSISYQDDQTLEYHENGDLDSEQKIDQLNMQWANQIKLTNDWLVNAGVDWTDAKVKADITDWSNKVIINEGESRTSTGVYLGTQYQLEQLKLEANTRFDKHDKYDEYTTWGVGASYQINDIYKVSTAYNTAFKAPSFYDLSTAPDLEPETSKNIDVSLAAVYSLVNVNLSLYKNRVDNLIVYYDAPNFAGYSANVDADIKGAELELLFDTGVISHTLIAEYKDHEDTEGQQLARRAKQNYKWMGNVSLGDLDLNLSYIYTGKRSDLPSAPGVETAYLDPYSLWSVAAAYWVTSDLAVRGRVENLFDEEYETAGGYKPAERSYYVSLDYQF

SEQ ID NO: 1431 - protein, 189 aa, Chlorobium phaeobacteroides
MKKIVLILALWVGLLGAFEPKKSHIYFGAMVGLAPIEITPKPVSDSSYTAFLWGAKGGYQFAFFKALALRGEFSYLMAIKPTALHTINTSLLSLNADALSDFYTYKKYSFGVYGGLGIGYFYQSNHLGMKNSSFMGYNGLFNVGLGSTIAHHHRIELGAKIPFSSTRNSFKNSYFLESVFIHAAYSYAF

SEQ ID NO: 1432 - protein, 763 aa, Chlorobium phaeobacteroides
MQSTHTINFTSTPVSSSAGHSCSTRILRHSALALMVSAALSGTSLHAQENSAQAQKEAEPYERVIVTSRKRSESMNDVPISINVVGEGLIENLGAADFTDLLGVVPSLTAYENGPGRTRLSIRGVANGGGNDNDTQNQETVGIYLDEIPISMGGMNPELALFDLKRVEVLRGPQGTLFGAGSMTGTVRLVSNDPDLSKFEGKYELSASKIEHGSNNKSVKALVNVPIIENELAVRVSGYYLDNGGYIDNSLTGEKNLNDGLSKGAKIAALYIPTNELSIELSYLHHDYSDDGRPVDIDSTPLFVRDYPSFDGYDDTMDIGNLTLTYDLDWAELTSSTSYFDRSIVNPRSLDLLFESALPPGITPHELVDLTDSEVFVQELRLASTTDSDLQWTVGAYADKKDVFYENTFPVPGADAILGVPSSAFGAPEDHLFYGFDDLTVKTYAFFGELYYDIGDLSITAGLRYFNWEQEIEFYQSGLFNGEANSDTRPKGKVDGYNPKLNVSYHLNRDNLVYVQAAKGFRYGGINGAIPESVCADELAQVERDGGDTRFFDPDEIWNYEVGVKGSDTQGTVSYNATYFHIDWSDMQTSRSFECGFGFKENVGDATSKGLELEVTVKPLDGLVLSAGGAYIDTTLDADVPNLDAQKGDPAPFVPEFSFTTSAEYSTELNEDLEGFGWVNVQYTDDRSTEFSEQNSNYRKMDAYTVANMRVGIRFSGYEISLFANNMFDDDGVVRAIGRPPFDPPASIRVTPRTIGMTFRGGF

SEQ ID NO: 1433 - protein, 709 aa, Chlorobium phaeobacteroides
MFSKKPLALVIGAVLASPAVLAEAVKTDEHMVVEGRDYGYKADTNTTAMRMEATQLETPGQVTIISEQIIDEQRASTLGEVLKNDASISAGSKSTNRERFNLRGFSLGSSSGYLRDGVQHWSHYRQPVELLERVEVLKGPAGLLYGKSAPGGLVNMVAKKPTYETQVSVSQDIGSDSYTRTTADVSGSLNDDQTLRARLIVSQENQDSYRTRFDGTDVETDRFVGGLFVDYDINEDVMLSAHYDRTQELGDLDNGSKIDTKTGKAITPNTVNDQRFAQTDNDVANYGVAVTANLSDTWAVKSGISRQFYERRRTESDNVIDSKKDRKTKKTLGYGYKVSDRHDEWTFDTAYVDFTGDVDAFGVNHRLLVGANGLHYDYKRLYVSDYACFNASEADTMKECGKGFDMPADIHYNNDDSVSHSKSQHYGLYLQDLVTFNEQWQALAGVRFAYDDTTSSSGKEESYNNILPKFGAIYSPAPNGSIYAVYSESFEPVSEISDKDDVNFGQSQDAKKGTLYELGSKWELFDERLFVSGAVFQITQTNMQVTEDLPASHAKDTRTTQVGEQVHTGVELAATGYVTDAFSVSASTMFLDAEYKNDPALNGKTPADVPEFTASIWSTYAFNNGTDVNLGVYHVGERYTESANTFKKDAYTRVDAGVAHTIKYDENLDFVARFNVDNLFDTDYLEGGSTRGVVVGEGRNYMATLQVKY

SEQ ID NO: 1434 - protein, 631 aa, Chlorobium phaeobacteroides
MYGAQYMSISFQPTRLVGAIAIAMGFSSTTVFADDSTDATKLDPIVVTASKSEEKVSQVPARITVISKKEIEKNPISNLSDVLQQDASIYIKQNGGLGQVADLSLRSGRSGSTLLLKNGARLNTQNSFGPVSPEFMDLTDVDQIEILKGPASVQYGSDAISGVINLISKTPTKSGVNLTGIYGENNTYKSILNADYVDASGFYTQVGGQRLESDGTRILSSQNKNDKAGFDQKGYHAKFGYQKNAVDTSISISENQGTNVYWDSTIDSNTGIRDFKNQLINWLGSYQLNSDIKVNARYSNIKNISESTDTDWQTFQPATSHYNTETNEGDLNAIWKFTAHQNILAGVTYSKSEYDSSSSPEAVRNINTTGYYLQHQYQNNGFNTQAGVRLEDNDWFGTHTVGQIAARYQLLPLTSIYANIGTAFKAPTLENLYGSYGNTFYSNPNLKPEESTSYEIGVDQKLNYGLSAYISAYSTDVKNLISSGKIDGKTTYINVNKATIQGGEIGLKWALDNLFANAEYAYSKAQNKATKSDTSYRPRQTYTLTLGYDDGVYGVNTALISRSKANTSAANVKVSGYATIDLNAFWNVNSNVKLFTNIQNIGDIQNIVVNDFGSEYVNGGRLASVGVTLSY

SEQ ID NO: 1435 - protein, 782 aa, Chlorobium phaeobacteroides
MNKKHTLISLAILTALYSQQSLADLHEQCLMGVPKFSGEVVTGDVNALPVYIEADNAEINQPNDATYQGNVDLKQGNRHLLAQSVQVKQSGNQSTPLRMAYVRNGFDYKDNQINMLGKDAEFNLDSHDGNLTNSEYEFVGRQGRGKADNITLHNNYRVMKNATFTSCLHGDNAWAVDASEIRQYVKEEYAEMWHARFKIHGVPVFYTPYLQLPIGDRRRSGLLIPSAGTSSQDGLWYAQPIYWNIAPNYDLTFTPKYMSRRGWQANGEFRYLTSIGEGKVAGEYLGKVRYSEYASDNRKRHLFYWNHNSSFLQNWRLNINYTRVSDKRYFNDFDSIYGRSTDGYANQYARIAYYQPNYNFSLSAHQFQIFDDIVNIGPYRAVPQLDFNYHKYDLANGWLNFKLHSQAVRFDNDSKLMPTAWRFHAEPSLNSLMSNKYGSLNIETKLYATRYEQKKGSGKNAEDVQKTVNRVIPQFKVDLQSVLARDITFLKEYTQTFEPHVQYLYRPYRNQSNIGSTLNNDYLGFGYDSALVQQDYYSLFRDRRYSGLDRISSANQVTLGGTTRFYDIAGEERFNLSAGQIYYLSNSRIDENPANKTPTSSSAWALESNWKISNKWYWRGSYQFDTHTNSTSLANTSLEYNPEKNNLIQLNYRYANQEYIDQNLGKSANAYQQDIQQVGLVVGWEIANNWAVVGRYYQDLALQKPVEQYLGVQYNSCCWAASVGVKRNVTNHQNQTRNEIVYDNSIGITLELRGLGSNDHQSGIQEMLEKGKLPYIRAFSLD

SEQ ID NO: 1436 - protein, 640 aa, Chlorobium phaeobacteroides
MSLRLYIAAVVALAACEANAQTKASAQTKATEEIETVLVTGARIEGASAASAEVIDAQTLTLQNSATALELLRNRVGIDVVQPGGPGGITELFIRGAESNFTVVTVDGVRMNDTTNSRGGGFDLSTLNPDEIERVEILRGPLSSIYGSDALAGAINIKTKSPRNAAPFSARVEGGNHGYARVYGGVAFGGGNNTAASGPAVNLSVAHLDAGEPVPGSSATTESYAAAVDWVDNSERAVDTTIRKVSRERTGYPSASGGYEFAASDELERAQADDLSVGFSWREQVSNNAKLNLNFTHYKRDEYVNTPAVDGGVLGSPIPAAVSDSALARTKVVGYSSFTLSPTLQMVAGVSAEKEKGENNTVYDYGFPLPAEFDLQRDTQSVFAELNYSKPQAIDVFISTRFDSAEQLDKQTDELSSKLAFSYPLFANGRVGVSWGQAFKLPSFYAVGDSLVGNPELKPETSTTSEAFIEHFYSNGKLRVSGAVFKSEYKNLIDFDFATFKMVNLDEVDISGVEVETLARLSPNFEVGGHITYTSFDVQSGEPLDGRPNWRGGVFGEWRSSNWSARLHWAYTGERPSTSTATGQVELAGFNRMDFAVARVLSKRVTLSMNIDNVFDSAYQDEVGFPSPGLGGRLGVSYSH

SEQ ID NO: 1437 - protein, 794 aa, Chlorobium phaeobacteroides
MFFTFLTSSLFSQEYEIQGKVVSTNSEPIWLSNVLLLSVIDSIIIDGTSSDENGAFKINNIPPGDYFIKASYLENESDYLKLKINSDTIIGPLIISNYAQTLQEVVVTTQKPRVERKVDRLVFNIENTALSDGDIWEALKRAPGIVVINNELSVKGSKDIGIMINGRKVNLPRADIINLLSGTTASNVESIEVITNPPVKYSAEDGMLINIKMKKNLISGYNGAIFNRYRQGIYPKHTFGMDHYFKGKKAGFSANYSFTNEKWFTQYTDITNFVDDGIISSSWTANEDYVRRRKRHNFNTFFDYVFDDRNSLSLSTLNQWNPSIGRVYDTKTQINDEEGTPLSSFNTINDSDSEQLNVSFYLDFVHKLPKKGAEVSINSHYTYYDFERGQELQTDFLDIGGNLTGENDFSTSSTQRIKLFSFQADFISPLGKNSKFETGMRYAGIHSESIIDQEGFDRDQPGINPTEMGLFHYDESIVAGYLGIDNKWGKLKAKGGLRAEYTRTIGELNITNSIDKDNYFKLFPSFSIQYTPNRKHDFNLNYYRRISRPRYDNVNPFQVFQSYNSVVEGNPELLPSSRHYLVSGYTLNRNYTFEVFYRNRTNQNQRLVFQDNQNQLLRFISSNIDKDFAYGFNLSVSKNITNNWYFYFMASTSYIESKFTDLDSDEQVENGLWNTYIRSNSSLSFLEDNSLKADVSFLYSSPVIQGNSRQEEYSRMGIALRKTIFNKAGSISLGVDDIFNKAKLFNTRNYLNQNNTSFYRPESRMLVLGLRYKFGNTKIRTNKKSRKVEERNRI

SEQ ID NO: 1438 - protein, 791 aa, Chlorobium phaeobacteroides
MKKRNTASPTLGLSFKKRLFFTNMLAINSALFMGATTVPMTVYAAGENDTVAFSIPAGDLQKGLLAIANQSKQTLSFNPALVANYQSAALNGNYSTRQAILRLLQGTPLLLTTTGNGTLTIVSSRANDADVAQASDKTLPAITVSAGSEDETVLNPGTSSSALRTSTSLQQTAQSVQVISNKLITARQATSLEEALKNSGSVVTIQSNRGTPTYWMRGYAVTSGATDGLSGSSNAGIGQGTAIEGVERVEVLKGPQSVLAGSSSAAGTINVVRKKPVTEPLHVLKVEAARYGEFKTAIDLGGAITDDKAFSYRLNASTMKSQHSFPDYNGNHGDYLAPALTWKNDNTRITVGAEVNQARKSGPAGTIYANGRIQKLPEYRLGDKDDHNKMKTTNAYYELEQKLVDDWTFNSKAGFQSTASQMKMNETLDIAANGNKISHPLAYKSTNQTWSQQNDIRGKIETGPVTQTLLVGHDYKHERYASYDGSFILMTNGNVYNPDSLVFPSIGEPNSRTYTSKLIQSGFLFQDQIDVFDRLHFQLAVKRSTWNNSYLVGTRASTYTATKWIPNYGISFDITPDVTIYANLLNSFSGSAQVSRSGVQLPPTTGQSKEAGLKFNLLDDNLTLTTAVFSIEQKNLAVTDRNGFPIATTGRKSEGFDVDLNGSLLPGWDVTASYTYSDNKDPTTVRSTITPRHSGNVWTSYEVQSGRYQGAGASVGISGSSKTQNGPSNNAFNIGSSASTDASVFYRQPDWSLTLGVNNVFDRDIYYTSTTPLYIGVKEGRTWRLTGTYSF

SEQ ID NO: 1439 - protein, 319 aa, Chlorobium phaeobacteroides
GSNYVMLTWRRPQYHDTGFIHNDGPTDENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLVNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDG

SEQ ID NO: 1440 - protein, 250 aa, Brucella sp. 02611
MNIKSLLLGSAAALVAASGAQAADAIVAPEPEAVEYVRVCDAYGAGYFYIPGTETCLRISGYVRYDVKGGDDVYTGSDRKGWDKGARFALMFNTNSETELGTLGTYTQLRFNYTSNNSRHDGQYGDFSDDRDVADGGVSTGTDLQFAYITLGGFKVGIDESEFHTFTGYLGDVINDDVVAAGSYRTGKIAYTFTGGNGFSAVIALEQGGEDVDNDYTIDGYMPHVVGGLKYAGGWGSIAGAVAYDPVIEE

SEQ ID NO: 1441 - protein, 355 aa, Brucella sp. 02611
MNIKSLLLGSAAALVAASGAQAADAIVAPEPEAVEYVRVCDAYGAGYFYIPGTETCLRISGYVRYDVKGGDDAYSGVELGGWVKRARFALRTHTATETELGTLRTFTENRFQWDAVPGNLGDTGFEGYGADRQSTTLQFAYIELGGLRVGLDESSFHTFTGYLGDVINDDVVAAGAYRTGKISYTFTGGNGFSATVALEEGGEGYVVNDYVPHVVGGVKYAGGWGAIAAVVAYDSVIEEWAAKVRGDVNLTDQFSVWVQAGYSSEESNDQMYGQWGGDWAVWGGLKYKASEKAVINVQAAYEDWGKTAVTANVAYQLVPGFTITPEVSYTRWDDDHPLRVTKDAFQGMLRFQRSF

SEQ ID NO: 1442 - protein, 916 aa, Brucella sp. F599
IKKLILSSLVFACINTSVEALENDGSKPNDLTSPKEASQESQKNEAPKNEVQRNEAQKETPQSNQTPKEMKVKSISYVGLSYMSDMLANEIVKIRVGDIVDSKKIDTAVLALFNQGYFKDVYATFEGGILEFHFDEKARIAGVEIKGYGTEKEKDGLKSQMGIKKGDTFDEQKLEHAKTALKTALEGQGYYGSVVEVRTEKVSEGALLIVFDVNRGDSIYIKQSIYEGSAKLKRRMIESLSANKQRDFMGWMWGLNDGKLRLDQLEYDSMRIQDVYMRRGYLDAHISSPFLKTDFSTHDAKLHYKVKEGIQYRISDILIEIDNPVVPLKTLEKALKVKRKDVFNIEHLRADAQILKTEIADKGYAFAVVKPDLDKDEKNGLVKVIYRIEVGDMVYINDVIISGNQRTSDRIIRRELLLGPKDKYNLTKLRNSENSLRRLGFFSKVKIEEKRVNSSLMDLLVSVEEGRTGQLQFGLGYGSYGGLMLNGSVSERNLFGTGQSMSLYANIATGGGRSYPGMPKGAGRMFAGNLSLTNPRIFDSWYSSTINLYADYRISYQYIQQGGGFGVNVGRMLGNRTHVSLGYNLNVTKLLGFSSPLYNRYYSSVNEVVSPRQCSTPASVIINRLSGGKTPLQPESCSSPGAITTSPEIRGIWDRDYHTPITSSFTLDVSYDNTDDYYFPRNGVIFSSYATMSGLPSSGTLNSWNGLGGNVRNTKVYGKFAAYHHLQKYLLIDLIARFKTQGGYIFRYNTDDYLPLNSTFYMGGVTTVRGFRNGSVTPKDEFGLWLGGDGIFTASTELSYGVLKAAKMRLAWFFDFGFLTFKTPTRGSFFYNAPVTTANFKDYGVIGAGFERATWRASTGLQIEWISPMGPLVLIFPIAFFNQWGDGNGKKCKGLCFNPNMDDYTQHFEFSMGTRF

SEQ ID NO: 1443 - protein, 699 aa, Aspergillus clavatus
MNLRLSLITAALLPLFGASVTANADDTDLERIVVTGDFQRESIQTLSASASLFSEDEVNLRGATYLDEMLGSTANINFASGASRGRYIQIRGVGLRSQFVDPINPSVGLVIDGINYSGLGGSALLFDIDQVEIYRGPQGTRFGADGMAGMIQMQSAQATSDPSLKLQVGAGTYNSREAGLAASTGLTDDTSARVSYFRRKSDGYVDNLYLNKPTQGQDEQVARFKLNSQITANLRTELNLHYIDINNGYDTFALDNGRNSVADEPGEDNQLSYAIGLNNTYTGFDLFDVNLSLSAIDSELFYSFDEDWVCNDPSKPQLCAAGLHPDGYSSTDVYSRDRDDQGVDLQFKSKTGNWVAGLYYQNRDVDLERQYTWLASPFNSTYETNNVAVYGQLATPIGPKTTLITGLRVEQYQGDYTDNNGFIEDTDDIMVGGKIALEYQVIDRTMIYTSITRGYKAGGINSEALAKAKDEGLNLDAEFFKQHTSFDPEYLWSGEFGVKGSSLDDKFILRLAAFYMHRDNIQLKSWQVQDQKFTGYVDNASSGSNYGLELEGSYQLTDDLLITGSAGYLNTKINKFVTKAGLNQDGRDQAQSPKYQYALSARYNLTNELYAMVGVEGKDDYYFSDSHNAQAPNSNLVNVSLGYEADSWAVRAWARNVFDETVPTRGFEFGNNPLDGYADHTYTQLGEPRVAGVTFTLNL

SEQ ID NO: 1444 - protein, 330 aa, Neisseria meningitidis
MKKSLIALTLAALPVAAMADVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRHKF

SEQ ID NO: 1445 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 1446 - protein, 376 aa, Escherichia coli
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGAAVSSSKRTDDQNGSYTSNGVVRNYIGTGDRAETYTGGLKYDANNIYLAAQYTQTYNATRVGSLGWANKAQNFEAVAQYQFDFGLRPSLAYLQSKGKNLGVINSRNYDDEDILKYVDVGATYYFNKNMSTYVDYKINLLDDNQFTRDAGINTDNIVALGLVYQF

SEQ ID NO: 1447 - protein, 693 aa, Vibrio cholerae V52
MYKKSLLSSAIMLALVPSAYADDYASFDEVVVSTTRLNTQITDSAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDNNANNLLVKLQYQLNPKHRLEFSGNYIRNKNDLENLEFSGYKNASGTDETTQYQLGIKHIWDAEFSLADRITWQFDVVGKEETGITDRTSKSNGNIQKKDYLYSDKGFSFDSQLDKSFMVSNTEHYIVYGFSLSDKDIENTNQEFNSIGKNNVIFYIPNASEKRYGFFIQDEIAFDNLIVTPGIRFDSFETKPGDTSANPSLNDASEYKKYSDSALTARLGTVYKLNQENRLFAQISQGFRAPDFQELYYSFGNPAHGYVFKPNPNLEAEDSVSYELGWRYNADSVSNELSIFYSDYDNFIDSQIVSGSFKTRDAVHQSINIDKATIKGIELSNQFFWDRFMPIVGFSSRIAAAYTEGKDGNGKPLNSVSPWNAVTGINYDSENNWGTAVNLTYTAKKKASEINGDYQPISSATVIDVTAYYKPIKDLTLRAGVFNLTDEEYYNWNDVRGLPSEDKDKTQAKRNFGITAKYEF

SEQ ID NO: 1448 - protein, 784 aa, Vibrio cholerae V52
MFVGARSLKSLLQIVDNNYQLHQYSCFIFDKDQIMQLKPLFTLLPVVLSSVVQAQENTEQAVDETVTVHGQSIPSDQRTRSDLDKVRGIANADIFSGITSVQSNNMHNEAGALDIGIRGVQGEGRVPIFIDGSLQSTHTSRGYQGVSDRTYIDTDFLSSLTVNKGATIESSPYASGAVGGVVNATTLGIKDIIKDDQAFGVVLKARANNHNRTPDVSSDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFIASNSVLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 1449 - protein, 367 aa, Vibrio cholerae V52
MQKTLFSLSLPLFLFLSFGIAEENGAYASVGFEYSISHAIQHNNPFLNQERVQIISNAQNKIDKLNQVKNEITSMPKTFAYINNALKNNSKLTPTEMQAEKYYLQSSFENIEKIVMLSGGAASNPQLVQALEKIQEPTNSPLEFEENLKNLEAQFAQSQNRMLSSLSSQIAQISNSLNALDPSSYSKNVSSMYGVALNVGYKHFFTKKKNQGFRYYLFYDYGYTNFGFVGNGFDGLGKMNNHLYGLGIDYLYNFIDNAKKHSSVGFYAGFALAGSSWVGSGLSMWVSETDFINNYLTNYQAKMHTSFFQIPLNFGVRVNVNRHNGFEMGLKIPLAINSFYETHGKGLNTSLFFKRLVVFNVSYVYSF

SEQ ID NO: 1450 - protein, 217 aa, Vibrio cholerae V52
MKQTICGLAVLAALSSAPVFAHQEGDFIVRAGIASVVPNDSSDKVLNTQSELAVNSNTQLGLTLGYMFTDNISFEVLAATPFSHKISTSGGELGSLGDIGETKHLPPTFMVQYYFGEANSTFRPYVGAGLNYTTFFDESFNSTGTNNALSDLKLDDSWGLAANVGFDYMLNDSWFLNASMWYANIETTATYKAGADAKSTDVEINPWVFMIAGGYKF

SEQ ID NO: 1451 - protein, 640 aa, Vibrio cholerae V52
MLYKKAKGLQKEKIYSASRMLESFTDAPVSATVISSQTIEKTGVTNITEALRLAPGLLVQQKTNGNYEVHIRQSNSLGGLMQDVHNQQILLLIDHMPQYDYLFGGITWETLPIDIQDVERIEVIRTPSVVFFGGMAINGVIHIFTREQQDNELKINLNSQAGVMSTADSPSLANSNLSGSHRGDLSFGLSDKLRFRLSGNYHFMNRSQDEFFLLSENRYIVSDSLWFFKQNVPQTNLNTTLARENLGVNVFTFYKPSKKVSTSAQLFFQQSQAQTIYTDDTLALAHRESKSYGINLNTHFHKFHLNMSHHEGEKDYALGYSGNNFNFSQTQASLNHRFHYKAVDLHSGGGFLSSAATSTTPVDSIRPTQHQFVNYYTFLKANFNILPKWRIMASVRGDKYEQITPIYLSYQLSTSLKLNQHLIRGAYTYNEGAALIRQLHQQTTRSVLPGINPNKSQSFELGWTAKIVSNINTSITTFYSNLDFNTVYQPMVNQGDTQNYRSTLVQAGTTAQLQAWFNKFQLEGFITLQRSAKTLGELQSGYLQSTPQFYGGFQLNYAGFLSKLNVNIQGHFYEGYQFNTTYGQVYIPTRMLLNSKISYKVWQKHSVFINVRNLLNSAQQEYAFADTISGLYLLGVNINL

SEQ ID NO: 1452 - protein, 519 aa, Vibrio cholerae V52
MAVLASFARTSSRIRSEPLRSVLMGLFSVSMLAATVDSAQAQSDPDPNSARNRVSRAAALSSPAPQNSETPANGGSNTPIMQNTVSGFAQTEGDPGPYFSAPMGSQHFLGDWGGVQPWLLKRGIHLMAAINEEFAGNFTGGKERAYSDAGQFGIELDIDWDKLAGVRNFWTHTLIVNGHGQSVSRNFGDSIAGVQQIYGARGNVVAHMVAMYGEMSFVHNRIDVSAGWIPVGSFFAASPLFCDFMNVAMCGNPAPNKYTEGNRDWPSGNLGAVVRAMPTMDTYIMAGLFAVSPHSYNGGISGWSWAQSGLGKFSTPVEIGWTPKFGHNQLQGHYVIGYSYDNSRYVNLYEDIHGNSWQLTGQPRRYEAGRNSAWLILDQMLVRNGPGNTNGLIAMAGAMYSDGKTVAMRDHEWAGLVDTGSAWGRPLDTVGAMYQHFDMSHTAALQQESSLALGLPYQDNQWGAVYGPQSHENVYELFYSAHIARAMALQPDFQYIQRPSATTTFHDAAVLGVQFTVVL

SEQ ID NO: 1453 - protein, 212 aa, Vibrio cholerae V52
MKKLAAAALILSTLSTGSVWAHEAGEFFIRAGTATVRPTEGSDNVLGSLGSFNVSNNTQLGLTFTYMATDNIGVELLAATPFRHKVGTGPTGTIATVHQLPPTLMAQWYFGDAQSKVRPYVGAGINYTTFFNEDFNDTGKAAGLSDLSLKDSWGAAGQVGLDYLINRDWLLNMSVWYMDIDTDVKFKAGGVDQKVSTRLDPWVFMFSAGYRF

SEQ ID NO: 1454 - protein, 331 aa, Vibrio cholerae V52
MKKAAIAVAVLSAVVSGSTLAATVYDAEGTSLKVGGRLEFRGDFNGDDKGKEIEGTMLNKSRVRLNVAGETDIGAGMKGFGFWEAEQGVKSSAGTSTEQETTFKQRYMYVGMKGDFGSLSFGRQNTAGVQISDMSDIGTFTGDQKAFVSAGNEQINNTIAYGYDFESFKLKASYIADDEKNADGYGLSGIYSAPFGLDIGLGYAANDLGTDKGSADQIIAGLGYTVGDLYFGATYTTGDKDDKADTEFTGIEVSAQYKITKEFRLIAAYQNQEEETKNVTKDKADFFELTGRYDFTKNFRSYLAYKANGLDDKDAGYKVEDTIRLGLRYDF

SEQ ID NO: 1455 - protein, 299 aa, Vibrio cholerae V52
MRFLSLLCPPVERAAVMRPPYTTHLQRVPLMRKSLLALSLLAATSAPVLAADYSDGDIHKNDYKWMQFNLMGAFDEKGAGPESTHDYLEMEFGGRSGIFDLYGYVDVFNLTSDKGSDKNGAEKIFMKFAPRMSLDALTGKDLSFGPVQELYVATLMEWGGNSGVNTQKVGLGSDVMVPWFGKVGLNLYGTYDSNQKDWNGFQISTNWFKPFYFFENGSFISYQGYIDYQFGMKDDAKYQSSNGGAMFNGIYWHSDRFAVGYGLKLYNNVYGFKDGEALPWAPVADSSGVGHYVAVTYKF

SEQ ID NO: 1456 - protein, 680 aa, Vibrio cholerae V52
MSHFTRSRTWVSLAVFAACAPAHAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLDADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHSEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTHKEETISSNSLSPRLGVVWTSVQEHALYASYSQTYSPVGGGVIGITPGDKHNHLDPEHSRLYETGVKSDWLEGRISTTLSVYRLEMYNRRMRDPNDQERIILTGLQRTDGIELSSRALLTDEFSLRGGIGLQDAKYVEADANEQGKRPTNVSRLNGELFVAYQSASDGWFGETGFVAVGDRYADRTNTTKLPGYARFDARLGYQWQAWRTQLSVENLLDKDYYLSATSSTQIQPGAPREFYLTASYQF

SEQ ID NO: 1457 - protein, 160 aa, Vibrio cholerae V52
MKKTLLALALLGASSTAMADSWIYGGASVGQSDYEGKHGTAYSVHAGTGILPFIGLEAGYVNHGDFEINATQELSASSLYFAVKPSMDFGPLHVYAKGGLHSWDKDINGGKIDDGIDVMYGIGAEYFIIGPFSVGASYMNYTMDSTDVGTLSFNATFHFL

SEQ ID NO: 1458 - protein, 182 aa, Vibrio cholerae V52
MVRFCGWLMVFCCFALPAYAGNSPYSFSLSTGFSRIDNPSSSDEAWVTQFGYNYQFSPFIGLDLGYSGMIGNGAEMLNTQKQKIDVKVEGFYFGAFFEQPINNLTILYARGGLSQFKVKERYELGAIGDNRQFSGTNPYIGIGTKVQSSIDKSLALTMELSYYPLEQDYSSLSFTVGGQYRF

SEQ ID NO: 1459 - protein, 718 aa, Vibrio cholerae V52
MRKINTNKNDSQIYSRGFIMRNIRPSQLGQYIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPLGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPIYGNYTPIDESSAADRTITKEQASLYAQYQIKLDQQWIGLIGGRMDWVDTENESQKNAQRKSRSDAEFSFNAGLMYLASNGVSPYLSYSQSFDVLSTIDSAKGELYKPLKGEQTEVGVKYQPEFYDGYINLAWFDITQQNALVTNPTTFVATQTGEMTAQGIEVESVGYVTDSLKLTASYTFTDAKTDETGGKGTQQAGLIPKHQASAWLDYDAAQLGLQGWTFGSGVRYIGESKDNPRSSDRTVPSVTLVDLMAGYEITENWQVQLNINNLFDREFVSGCDYWCYYGQSRSAVLSANYRW

SEQ ID NO: 1460 - protein, 181 aa, Vibrio cholerae V52
RLQYNGEILPLYTKVNGITNAKGKEKDSPLTRSFIAGGGAFGYKMDDIRVDVEGLYSQLTKDATVVFDNKAADSVTAFSGLVNVYYDIAIEDMPITPYVGVGVGAAYISNPSKDDAVKDQKGFGFAYQAKAGVSYDVTPEIKLFAGARYFGSYGASFDKAAEGDTAIKNVVYSTVGAEAGV

SEQ ID NO: 1461 - protein, 867 aa, Vibrio cholerae V52
MMSTLWTVAAVCLCLGGHPCSETSELKKAIVRMQDLYHVNFVYDSSLEMIRLSGIFSSGKSLKENLQTVFSGTGIKWEIKGSYVLLFKSSRYTFSGHVCQDNGESLLNVTVYDQNMHIGTLTDEHGFFSLTLPEGKHTLRFSYVGYEEVVKELDLRSDYSGTIYLKESSTALEGVVVTADLNTSLFTTQTGKISLTSEQLNTEFSLFSSPDLVKAIQQLPGVSAGTELLSGLYVHGGKNDENLFLLDGMPLYQVNHFGGLFSAFNTDIVKNVDFYKSGFPARYGGRLSSVTDVRMKEGDLKEFHGMVSLGLLDGRLRFEGPVIKEKTSFVFGMRRSWLDVLSAPALRIANRFFPEEDINARYAFHDINAKITHRFSNESRLSFSVYSGRDLFKMKDKQLFPSGNLLHQEKEQTTDEYHIRWGNLSAALSWNNQFNHKLTGNFSLVYARNLSKYDFRSDDSFYKGEDDKEYSVDRMQRDSYSTIDDVGFRMDFHYLPTASHHVRFGSDYLYHIYCPQHTLSQDIRGTEEMTDTLLSSVESHYKGNEFSFYAEDDMRLTRKLRINLGGRYTMYQVSGAVYHSLEPRISASYRLFSRTTLKVSYTEMSQFVHQLSNSYLNLPTDCWVPSTSRIRPMHSRQVAGGVYMELPWRLRLEVESYFRTTNRMLEYEAGGSLTLPAGNWEQVVRVGDGKSYGLETSLVYHDEQNLFQAGYTLSWSKQKFDDFYSGWYPSKFDNRHKLNFVYRRKFSHRMDVYAAWTYRSGDHATVPTQYVENPCLPGTSQLSDLEPMYGKPNNITLPAYHRLDVGINFRRTTKRGFERIWNVSIYNAYCRMNPFYTKIERQVDGSFRGKAIGLFPIIPSFSYTLNF

SEQ ID NO: 1462 - protein, 423 aa, Vibrio cholerae V52
MKTNKTLLSCAVAFGLASVSTFTQAAGFQLAEYSATGLGRAYAGEAAMADNASAQWRNPAMLTYLEGTQVSAGAIYVNPNVDVEGTVIHQQLGKTHASSNDFAHDAVIPNFYLSHQLNEQVALGFALGTNYGMETDLGTEFAASHFGNQASVISKEANLNIAYQILPQLSIGGGVRYVMGEGHFGATAPAKNALKLPQGTTLKYMEGEDNSWGWQVGSAWQITQDHRVGFAYKSEVVMDFEGHAEGVSYGSYKPGMMSVTLPATAELASFHQLNDQWAIHASINWTDWSSFKELTAVFPEKSDLIKSENWEDNYRFALGTTYQYDAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 1463 - protein, 428 aa, Vibrio cholerae V52
MNNMRLFKKSLLAVTVTLATQQAFAAGFQLNAQSATGLGRAFAGDAVIADNAAVMSRNPAAMALFDEMALSLGFETITTMIDVKDVSYRGVLGNSVSVQDTDDVGGTSVAPNIHLIVPVNDQFAWGVNAYSNFGTKTEFSDSYPASEYGGLTDVKSFNLGLAGSYRVNKEWSFGAGLDLIYGQGTMKRIAGTSFPASTIVVNPTTVIPARGTSLLNVDKADGWAVGFNLGTVYEMDENNRFGLSYRYSPEFKAKDDYGQEITLPLPDIAEFSGFHKIENTQFAVHYSVQWIGWSAFDKIEFRNLVTSRSSVGALTKGSYDKMYEWQDGWHYSIGGTYYLNSDWTLRAGYMYDTSAQDSRTSISVPDSDRQWLSAGFTYNIDDKSNVDFGFTYLMGKDVAVSENDAGSKLTATTHADAILLGLQYSRTF

SEQ ID NO: 1464 - protein, 652 aa, Vibrio cholerae V52
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDEIEHGYGDKSLRSLTSKLNYQLNPDHQLQLEAGVSAQDRENNVGKSAQSSGCRGTCSNTDNQYRRNHVAVSHQGDWQDVGQSDTYLQYEENTNKSREMSIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSKGGNIYGNPDLKPETSVNKELSLMYSTGSGLAASLTAFHNDFKDKITRVACPTNICTDGANQWGAAPTYRVNIDEAETYGAEATLSLPITESVELSSSYTYTHSEQKSGNFAGRPLLQLPKHLFNANLSWQTTDRLNSWANLNYRGKEMQPEGGASNDDFIAPSYTFIDTGVTYALTDTATIKAAVYNLFDQEVNYAEYGYVEDGRRYWLGLDIAF

SEQ ID NO: 1465 - protein, 713 aa, Vibrio cholerae V52
MKLSPVSAAVLSVLAAGFAHAETEPSHYEEVVVTANRIEQPLSEVAGSVAVLEGETLEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFSHHYWLNDALRLKTHLEYFDDYAKRREGTSSIQKDDKWDLVSFYEYQRSQTRLASVGADYTANLSWMDTLEGKFYWRSTENITQTNRLMANDRSGAGILSYRRELRDEGFNDEALGATLNAQKEWQQGEWLHQFAYGMSVDGHDYQRPKSIRRMESSGDDLQADEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFIIKPNNKLRAETSDSFELGSKYDNGQTQFYVAVFYSIFDNFIDVKQVGYDNATGSEIQQYQNIAGVKTYGAEMSVMHRLDDRWSVENKLGYVDGKDGENQYVRTLTPLEGSVQLNYQRERWDAYSRLNWASAMSRVPTCTTEQGKETECATTTGWVSWDIGLNYQWNAQLSASFNVVNLLDREYTRYQDVAGVTPSDTLYSTEPGRYFTVHAKYVF

SEQ ID NO: 1466 - protein, 341 aa, Vibrio cholerae V52
MDNKLGLNKMNKTLIALAVSAAAVATGAYADGINQSGDKAGSTVYSAKGTSLEVGGRAEARLSLKDGKAQDNSRVRLNFLGKAEINDSLYGVGFYEGEFTTNDQGKNASNNSLDNRYTYAGIGGTYGEVTYGKNDGALGVITDFTDIMSYHGNSAADKIAVADRVDNMLAYKGQFGDLGVKASFRFADRTENTVTDKYEDNGKDGYSLSAIYAFGDTGFNVGAGYADQDEQNEYMLAASYRMENLYFAGLFTDGEKAKDVDYTGYELAAGYKLGQAAFTATYNNAETAKETSADNFAIDATYYFKPNFRSYISYNFNLLDSDKVGKVASEDELAIGLRYDF

SEQ ID NO: 1467 - protein, 659 aa, Vibrio cholerae V52
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDNQQGSLTVYGQLSETVDAMVYGQGISRDNFEDGAGKETFGVKGDTYNVLAKVGFEPAVGHRFQVSYDVYRDQGDYSPRPDMAGSANEGLTKNRLIPTHYDRDTITGSYELKQDKHRGKVTLYSSQTEIDRDESVMAGAWPGNRVSRNTATNRNVGINALFQSDYELAAHRNQVSYGMDYVDQTSKATYGSTPFMEESAVSTAVFAENKLYINDVWSVTAGLRFDDFKRKAMTGKKNFDEVTWSLGTEWDVTSDWTLFANARSLFKGPELLETFVRYQDQARLADNIKPETGLNTQGGVRFDKTYGDHFVGANFTLFKTQIDDHIRTSNSYLISNVGDMEIKGFELSTTYAYQAASAKLSYAHSDANDVTNGGPMLNSVGSSADMGDSIALSLGYQADSIDTLFGWTSIVVLDEDNVVAGTAKKEGYDVHNLYAQWTPYSVPNLVLTFGVDNVFDELYTSHASRLGVARGFTLDDREPGRSYKLSAAYQF

SEQ ID NO: 1468 - protein, 743 aa, Vibrio cholerae V52
MYKVYYCILLLLLSASLNAHHIRGRVADPDGNPLEAAAIYHPATGSYVYADAAGYFELDNVDVGDRLLLYSLGFASDERTITALHVEKGITVVLQPAAVGLEQVVLVARLNPLNNLARADLAVNPVRSSQEILRRVPGLVIGQHAGGGKAEQIFLRGFDIDHGTDLAIDVEGMPVNMVSHAHGQGYSDLHFIIPETIENIDFGKGPYRAGVGNFNTAGHISFKLRDRLPQNRVTLEAGQFNTLRGLGMIRVADTDHSQAYLAGEILFSDGVFEASQNFSRVNLMGRYRFDNREDESLTLTASHFQSQWDASGQIPERAVVSGQISRFGAIDSTEGGRTSRTNIWMSHRKQYSPHQSLRTSAYVTGYQFDLYSNFTFFLEDPVNGDQIRQQEKRLLLGGQTVWRHSFHGEGTPRKGYLDLGIGFRYDDVDEVSLSRTANRKTLLERLAYGDVDEFNGFAFAEASWKLGRWTLVPGLRLDHLRFEYRDRLPQTYARAVEPGWFLAPKFNALYQASRKVQFVGKAGLGYHSNDTRVVVARGGEETLPGALGLEVGSVYRPLDRLVLSANLWSLFLEQEFVYVGDAGIVEPSGRTRRLGLEAAIQAQITDHLFARGDVNYTYARSTEAPAGADRIPLAPELTSSGSLSLRDLGPFSGGIRYRFIADRPADESNSLVADGYFVTDANLNYTRGAITLGLTVENLFDTRWKETQFATLSRLAGETQPVEEIHFTPGTPFFVRANLQLRF

SEQ ID NO: 1469 - protein, 886 aa, Vibrio cholerae V52
MLNSTFAKNLNTNLLSTKLFFMKKLLLFMTLIVAGITSSYAQGTVTGQLMAVDENQPLSGANVIEFGTTSNGTISDFDGNFTVAVSQNSGSIKISYIGFNTKVVEFNLENGKADLGVINVTTDENSLDEVVIIGSGVVDLANSRKTPVAVSTIKAAEIQERAVGNVEIVEALKNTPSVHISGQTGFGDSQFYLRGFDQTNIAVLLNGQPINGMEDGKMYWSNWAGIADIANAIQVQRGLGASKLAISSVGGTTNIIMKAAEKEEGGYARFMGGNDSFFKGTVAYNTGLSESGWAFSVLLDHWQAHRKWSEGTYGEGQNYFFSVGYEASENHSFNFLLTGAPQLHGQKWSQSREINDADPKYNQHWGYTENGIESERQNYYHKPVMNLNWDWNMSEKSDLSTVLYASWGRGGGTGDRGNGRIRTEDPDGDGPLSGQLDYDAIEANNAIIGIGGDYSNPDGAGYIRRSSVNNHQWFGVVSNFNHDLSDSFSVNLGVDGRNYTGDHFRQVTDLYGLSGWSNDRPDDAIVTATYDATPWAALTNFADEGDRINYDYSETINYIGGFGQIEYAQNNFTAFVQGAVSTQSYQREDRFAEVTSDVVNKGGYNIKGGISYKIEESNSTLFLNGGHYSRQPYLDNIFAFNETNADIISPAVDNEKITSFEGGYHYKSGVISANFNAYATYWDDRTISNLDESDNGTPDDDTDDFDISLLQRGVNQFHAGAEFDLGVKAANWLTLNAYISGGNWIYKGESSLDIYNLDTQELISTEDAIDRNGVKVSTAPQFTTGLRARATITGSLSVDGNINYRDHHYEFTDPSTSAEGYEAAKLQPYSITDLGLSYNFNLGSNDLTFRANVYNAFDYIGESNSDAFGYYIENGRTYNASLRYAF

SEQ ID NO: 1470 - protein, 653 aa, Vibrio cholerae 2740-80
MQLKPESRFSHHHFPHSKVYRALLVTGLLTLPALAQAENAADEKIVVTATQTKHTTLSAPASVSVITHAELEKMSVNNVSDAVKKLPGININPSTSYGRNEIKIRGMKADYTLLLINGRRVNSRDALAGNMGNDFDLSAIPISAIERVEVIRGPMSSLYGADALGGVINVILNQPSNELKGEIGYNFEAPTEGSGGDHNRLNGYISGPLIENTLLGSLLADGGKRDAWKTEQSVNQNTDALEKRDNYSVMGNLTWLIDAQQSLDFDATYTKDDRDVRWNNYGTAVRNIQKMERLGLGLTHNGSWDNVDTRLRYFYENVELMDNSQLNNGKADITQDNHTVDGQASGYLGDHLLTGGGEYRLTSLKHSMNLPNSTIDVSQGALFLQDEFKLSDLALTFGGRVDKHETYGTEFSPRAYATYSLTDNWVVKGGVSKAFKAPSIAQSSESYAIAACRGRCQTVGNPDLKPETSISYEIGTAYEAERFGAGVTLFNNDIKDMIQVQTWDRVATRLTYENVNKARIQGIETSFWVDVTDDLNWTTNWTIVDAEDRTTKMRLKQTPKNTVNTQLNWQTLDNLSTYIAYQYTGNQYLFDKEVSKTRGFNTVDIGATYTPVKNVDLKLGLTNLTNEKRDYVATNNDYFLSGRTVYGGVSYKF

SEQ ID NO: 1471 - protein, 266 aa, Vibrio cholerae 2740-80
MRKSLLALSLLAATSAPVLAADYSDGDIHKNDYKWMQFNLMGAFDELPGESSHDYLEMEFGGRSGIFDLYGYVDVFNLASDKGSDKVGDPKIFMKFAPRMSIDGLTGKDLSFGPVQELYVATLFEWDGTDYKTNPFSVNNQKVGIGSDVMVPWFGKVGVNLYGTYQGNQKDWNGFQISTNWFKPFYFFENGSFISYQGYIDYQFGMKEKYSSASNGGAMFNGIYWHSDRFAVGYGLKGYKDVYGIKDSDALKSTGFGHYVAVTYKF

SEQ ID NO: 1472 - protein, 405 aa, Vibrio cholerae 2740-80
MSLCFKRLAASLALAAAGGAAHAAGYALIEQNASGLGNAYAGQAAAASDASTIYFNPAGMTRLPDRQIVVAGHLIKPRAEFSGTSSAGVTGGQGGDAGDWAFVPNAYVAMRLTPDLHLGLGLNSPFGLKTEYEPEWIGRYQAIESELKTINLNPSVAYKLSETFSVGAGLNIQWIEATLTHRQPLGPPPFPAPLLKIKGDDYGWGYNLGALWQATPATRIGVSYRSEVDYTLEGTSSTSDPVVNPLNGPVTAEVTLPDSASLSLFHTLSPQWDLLADVSWTGWSDFDDLPIRGTVDSTTIENWSDSLRYSLGATWHANEKWSLRGGIAYDEAPVSDRYRTPRIPDGARTWVALGGQYRVSKRSALDFGYAHLFVNDPGLQPSTTTLDGEYDSAVDIVSAQFTLNF

SEQ ID NO: 1473 - protein, 687 aa, Vibrio cholerae 2740-80
MAALCPARVSVAENKKFKLHTLSAMMMGLFMGSLAYAETQTTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNALIGARYYQSSQDDMYIDAASAYPMDGRTKAKSVFAEVTYALTPSINVNLAGRFEREQVKRNVSHPRYKLDYDETSSVFLPKLDVAYTPVQGQTYGIKAAKGYNAGGAGLAFNSMQFTGFRPYEFEQESIWNYEFYTRHRFSHSVEVLTNLFYNDFDSMQMTQTTSSGDVFIANLDEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDKTTLYLSTNNTLDQLKQQPRMIGASVQLNF

SEQ ID NO: 1474 - protein, 525 aa, Vibrio cholerae 2740-80
MSHFTRSRTWVSLAVFAACAPAHAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTHKEETISSNSLSPRLGVVWTPVQEHALYASYSQTYSPVGGGVIGITPGDKHNHLDPEHSRLYETGVKSDWLEGRISTTLSVYRLEMYNRRMRD

SEQ ID NO: 1475 - protein, 643 aa, Vibrio cholerae 2740-80
MNYTRLNGADRIALVCLLSGIPFIALPAVAQELHRPITDSEVSHSAPNLLAQVPAPSSLSSIQMGSESTKPALGVNAVSDLVLEVPGATANQVTSVSQLSDVRPTDWAFQALQSLVEKYGCIAGYPDGTFRGNRAATRFELAAALNACLDVISDRFATKEDLATVRKLQEELAAELATLRGRVDGLEARTAKLEAQQFSTTTKLQGENIVAFEAAGGGGYGFNGVDIVKGEDPNPIVVYRTRLNLVTSFSGKDALITGLQAFNFGGDLIGGNSVQNTLFPGTVINSGSTNLSFQPQFAGVDPQVLGSGAYNPNTLALYKLLYVFPIAGKFTGFVFPKAETTDAFPQIIPWASEGQGALSRFAGVNPIARLSGGTSGVGLASGLGFIWNPNKTVNLTALYGSVTAPVATVQPGVTALGSGFFPNDENSFIAAAQATFKPLKSFDAAFNFAYAQHALNILGTGLSSNGLLGALGAGGGDIFTLPGLALDQRVQLFGVGGTFTYRITPKIALSGYGAGIFVNAVGGTSGLSGNSVSNVKAGATYTSFMGGVYFQDALLPGNTAAFIVGQPLYLESATGIAGDADEVFANGTRVFNKARPFQVEAYYRFKVNDNISVTPGAFVIFNPESNSENNTTAVGLVRTTFTF

SEQ ID NO: 1476 - protein, 217 aa, Vibrio cholerae 2740-80
MKQTICGLAVLAALSSAPVFAHQEGDFIVRAGIASVVPNDSSDKVLNTQSELAVNSNTQLGLTLGYMFTDNISFEVLAATPFSHKISTSGGELGSLGDIGETKHLPPTFMVQYYFGEANSTFRPYVGAGLNYTTFFDESFNSTGTNNELSDLKLDDSWGLAANVGFDYMLNDSWFLNASVWYANIETTATYKAGADAKSTDVEINPWVFMIAGGYKF

SEQ ID NO: 1477 - protein, 401 aa, Vibrio cholerae 2740-80
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDNQQGSLTVYGQLSETVDAMVYGQGISRDNFEDGAGKETFGVKGDTYNVLAKVGFEPAVGHRFQVSYDVYRDQGDYSPRPDMAGSANLGLSKNRLVPTHYDRDTITGSYELKQDKHRGKVTLYSSQTEIDRDESVMAGVWPGNRLSRNTATNRNVGINALFQSDYELAAHRNQVSYGMDYVDQTSKATYGSTPFMEESAVSTAVFAENKLYVNDVWSLTAGLRFDDFKRKAM

SEQ ID NO: 1478 - protein, 334 aa, Vibrio cholerae 2740-80
MDKMFKRTLLGAAVAMASTGAFAASETGAIGVLSDFNVQAYGVAAISAFYQEDSNGYDYENESRIGFRASKDMFDNVNVFMQIESGYVGEDGKGSTLGARDTFIGLQGDWGKVRFGRMLTPLYEIVDWPYSNPGLGRVFDWGGDVKAHYDRKGDIARYDSPAFGGLTFNVSVGRGKTDVKDSDHVGFGVHYNVADIVTLHGGYESNSKYDGSNFDSKAYIVGFELPLPAGFGLAGAYKYSEGESKTIAGQEGEQGQYSLIGQYWNGPWGFKVGYAANLDSEVNGVEQQDDDEVLSAQLMYVKNGFVPYIRIGQHDAYNAEDKKGFVRVGLEYGF

SEQ ID NO: 1479 - protein, 428 aa, Vibrio cholerae 2740-80
MNNMRLFKKSLLAVTVTLATQQAFAAGFQLNAQSATGLGRAFAGDAVIADNAAVMSRNPAAMALFDEMALSLGFETITTMIDVKNVSYRGVLGNSVSVQDTDDVGGTSVAPNIHLIVPVNEQFAWGVNAYSNFGTKTEFSDSYPASEYGGLTDVKRFNLGLAGSYRVNKEWSFGAGLDLIYGQGTMKRIAGTSFPASTIVVNPTTVIPARGTSLLNVDKADGWAVGFNLGTVYEMDENNRFGLSYRYSPEFKAKDDYGQEITLPLPDIAEFSGFHKIENTQFAVHYSVQWIGWSAFDKIEFRNLVTSRSSVGALTKGSYDKMYEWQDGWHYSIGGTYYLNSDWTLRAGYMYDTSAQDSRTSISVPDSDRQWLSAGFTYNIDDKSNVDFGFTYLMGKDVAVSENDAGSKLTATTHADAILLGLQYSRTF

SEQ ID NO: 1480 - protein, 432 aa, Vibrio cholerae 2740-80
MKTNKTLLSCAVAFGLASVSTFTQAAGFQLAEYSATGLGRAYAGEAAMADNASAQWRNPAMLTYLEGTQVSAGAIYVNPNVDVEGTVNHAQLGKTHASSNDFAHDAVIPNFYLSHHLNEQVALGFALGTNYGMETDLGTEFAASHFGSQASVISKEANLNIAYQILPQLSIGGGVRYVMGEGHFGATAPAKNLIRHPITNNVMTLPKGTTLKYMEGEDNSWGWQVGSAWQINQDHRVGFAYKSEVVMDFEGHAEGVSYGSYKPGMMSVTLPATAELASFHQLNDQWAIHASINWTDWSSFKELTAVFPEKSDLIKSENWEDNYRFALGTTYQYDAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 1481 - protein, 698 aa, Vibrio cholerae 2740-80
MQVVQMYKKSLLSSAIMLALVPSAYADDYASFDEVVVSTTRLNTQITDTAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDNNANNLLVKLQYQLNPKHRLEFSGNYIRNKNDLENLEFSGYKNASGTDETTQYQLGIKHIWDAEFSLADRITWQFDVLGKEETGITDRTSTSNGNIQKKDYLYSDKGFSFDSQLDKSFMVSNTEHYIVYGFSLSDKDIENTNQEFNSIGKNNVIFYIPNASEKRYGFFIQDEIAFDNLIVTPGIRFDSFETKPGDTSANPSLNDASEYKKYSDSALTARLGTVYKLNQENRLFAQISQGFRAPDFQELYYSFGNPAHGYVFKPNPNLEAEDSVSYELGWRYNADSVSNELSIFYSDYDNFIDSQIVSGSFKTMDAVHQSINIDKATIKGIELSNQFFWDRFMPIVGFSSRIAAAYTEGKDGNGKPLNSVSPWNAVTGINYDSENNWGTAVNLTYTAKKKASEINGDYQPISSATVIDVTAYYKPIKDLTLRAGVFNLTDEEYYNWNDVRGLPSEDKDKTQAKRNFGITAKYEF

SEQ ID NO: 1482 - protein, 651 aa, Vibrio cholerae 2740-80
MFSALYSSPLLAVDYVYDKTKLTDDEITRLKKLRDRDSEYWKEETYFIKSTPQSPPNIPRLFPKNSFDSFENINNSKEISFYDKEFTEDYLVGFAQGFGVAKRNGETEETVRQYFKECLNTGKHSNDPTCKSYSTDAYNIKSDIFALNTIVKNSHINSEILAVGNYTKLMLSAQHSSTWAEHLYSNAELSLTVQDNSHVIGQTIDLGALILTNSLWEPRWNSNIDYLATENADIRFNTKSESLLVKGNYAGGARFRFAYDLQDKAPETPVLTFEQNITGTSDIIFENPIDNLKSLDGHQIVKVNGTADKNAFRLSGKYRKGIYTLSLQRRPEGFFTKVQERDNIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGFGAGVYATWHQLQDKQTGAYIDSWVQYQRFRHHINTEDGTERFTSKGITASIEAGYNALLAEHVTGKGTQIRFYLQPQAQLTYLGVNGKFSDSENSQVNLLGPRQLQSRVGVQAKAQFLLNKNIVIQPFAAVNTLYHSKPFGVEIDGERRVINNKTAIESQFGIAVKIKSHLTLQATFNRQTGKRHHAKQGALNLQWTF

SEQ ID NO: 1483 - protein, 165 aa, Vibrio cholerae 2740-80
MKKTLLALALIGASSTAMADSWIYGGASVGQSDYKGESDTSYSLHVGTGILPIIGIEGGITQHGTFGIDYSGTKRDTKLSSYYAALKPSIDFGPLHIWAKGGLHSWDKEVTGLSSSNDDGVDIMYGVGAEYFIFGPLSVGASYMNYTMDKDDVGTFSLNATLHFL

SEQ ID NO: 1484 - protein, 142 aa, Vibrio cholerae 2740-80
GRAGEDGVFPEITALFDPFGYEEAVGWQQQLLHPRVHLGTSIGTSGEATQFFTGFTWTVDLSEKIFAEAGFGGVIHTGDLDDNDDGPELGCRVLFHEYVGAGYRFTRNWNVMAQIAHSSHADLCDGPNDGMTRAGIQIGYKF

SEQ ID NO: 1485 - protein, 849 aa, Vibrio cholerae 2740-80
MLAAAGLLQSLGATPAAAACAPTLAPASGQSVQCDGAVVNQSVEAAAGSQNVTITVAPGALFSTNATRALSVDDRSRIVNEGTIQMAGGAGASRGAMVGFGDNNQLINRGSITTSGSGVRGISVPNVGSTGTLVDNSGSIRTQGASAHGIAINGPGNRVQNSGAITVNGTDAKGVYLQGGSPAANVLVNSGTIHARGASSNGIFGPDGVHVNTTNANGFHARVENLPGGRILSDHSYALRGQNGNDTFINAGYLQGHGGAGRDTAVYMGPQGTGTLILRTGSAIAGLADGGGAASHAYLEGSGTVDNRFANFRTLTMRGADWRWTSDAAFTESVDLRTGTFFLAGTLASPANRLAAGAVLAGTGTLAGALRNAGEIRPGPNDGSGYGALTVRGDYTGAGGALRVNTVLAGDGAASDRLVIDGGHAGGSTPVTVANRGGQGALTAADGILVVQAINGASSDAGAFSLAAPLNAGAYEYRLYRGDATGAAPDSWYLRSRAYLVEDQLAGSLAEAEAIADDIGRRTGERPSIEDTPLYRPEVALYSSIPMLARRMGLAQLGTFHERQGNQALLARDGERVAAWARAYGGNSKQALDGDAQPGIDARLAGVQLGQDLYSSVRPDGGQHRFGLFGGYGHARGDTHGSAGGERDAATGRLTIDGYSVGGYWTYVGPRGWYVDTVLANTWMDIDTDSKAGRDADTRGQALTASLESGYPLALSERWTLEPQAQLIYQHTRVDDFSDAVSEVRIRDDNALTARLGARLQGEYAAAAQVWRPYAALNFWRTFSGENTVVLGEDSIDTRRGATSLELAAGASVTLARSLALYGRLAYATSIDSQYLRGASAQLGMRYTW

SEQ ID NO: 1486 - protein, 610 aa, Vibrio cholerae 2740-80
  misc_feature (171)..(171): Xaa can be any naturally occurring amino acid
MQKSALAIALASLFTPISYLHANEAQPQETVVVTANRFEQVESSVLSSVTVVSRQEIEAYQANSLTEVLRRVPGVEIAQNGGRGHSASVFIRGTNSNHVLVLVDGIRINSSAGGVALNRFPIGLVERLEVIRGPNAAVYGSDAIGGVINIITRSHRGDDAKQVSLGIGSLXSKKADVIAKADLEESGHFQVAAGFEQTDGYDIKNTGNGTQYGFDGQNLMAGYEHQLNEQWLGYFSASWFDSDAQYDESGSVKHGYSQNESFTGQLNFQGEQLKSLVSLNYQQTKNLDYSLSEGKANASTKANITMTQLQWANLYQLTENAEVGAGVDARRESLADDAKNYGASHKLAGESRDTQGVFASGRVYVDSWTFESGVRYDKHDKYDHYTTWSLAAGYQLNDEHRIRAAYGTAFKAPTYSDLTTTPDLKPEESKNIEFGVSGVYSFASWNASVYDNKVDNLIIWYKPALSSGRWYSDNTDARIKGFEFDVNFNTGPVNHMLVAEFKDHKDDNGVQLSRRAKQNYKWISSLSFGQFDLNATYTYTGKRLDLPTATPKDEDYIPATNLWDMSVGYWVSQDMTLRGRIENVFNEQYESAIGYKAPERAYYFNVSYQF

SEQ ID NO: 1487 - protein, 742 aa, Thermosinus carboxydivorans Nor1
MYPHFRRGHLAAAVLFASSGLLAGQALAEDERLEELDERSESVVQLGDEVVLGTAEQELKQAPGVSIITAEDIRKRPPVNDLSEIIRTMPGVNLTGNSSSGQRGNNRQIDIRGMGPENTLILVDGKPVSSRNSVRYGWRGERDTRGDSNWVPPEEVERIEVLRGPAAARYGSGAAGGVVNIITKRPTDRLRGSMTVFTNIPESSKDGATRRANFSLSGPLTDALSFRAYGSANKTDADDTDINAGHSVDPTRTVAGREGVRNRDLSGMLSWQVTPDQIVDFEAGFSRQGNIYAGDTQNNNGNANTQGLADDGAETNRMYRENYAITHNGTWEFGTSKFVAQYDSTRNNRLEEGLAGSVEGQIGADRSFSTSKLENYRLNGELNLPLHALFEQVLTVGAEWNKETLNDPSSLKQGFVGGDSLPGTPAAGSRSPKSKAEIRALYVEDNIELRPGTMLTPGLRLDDHSDFGLNWSPSLNASQALGEYFTVKAGIARAFKAPNLYQSNPNYLLYTRGNGCPIQTSSGGCYLVGNENLDAETSVNKELGLEFRRDGWVAGITYFRNDYKNKIVAPLDVMGQTGSGNNILQWSNAKKAVVEGLEGNLLVPLQADLSWSTNLTYMLQSKDKDTGNPLSVIPEYTLNSTLDWQASERLSTQLTSTVYGRQEPPKHATSRGSRAISRKEVGTYGIWGVSAGYTFSENLSVRGGVSNLFDKRLYRQGNSFDAGAATYNEPGRAYYVSVTTSF

SEQ ID NO: 1488 - protein, 625 aa, Thermosinus carboxydivorans Nor1
MNKRSLAILMAAMLCNSGLRAEVASNNYVGQEVVVSATKTLNSVADAGGSSVTVITSKEIEESGQTSVEEVIKGQPGIDIASNGGPGSTTSIFLRGADAKYTLVLIDGVPINDPSDGTMAADISKITTDNIERIEIVRGPASMLYGSGASAGVINIITKKGSAKPSVYAGAEGGSYSTWKAYVGANGSTDLIDYSISASRTKTDGFSTTDERNKCINPDDNSFEKDGYENSTLSGNFGLKLNKHVTLETSLRYTDAEYEYDGPGTDVIGNKQESALFSGRVALKMNYQPLLSTLYYNVSDQNRRYFTIDGLSSTYDGYLYEIGWQGDYALADNNTVSVGINSREESMQNESFGMYASSLDKSMGTTGIFVEDQWRIGGLRLVQGIRYEDNQKFGSKTTWRVAPSYTFGSTTLKCSYATGFRAPSLYELYSPYGNETLSAETSEGWDAGFERKLADNLTIGSTWFRTDYDDRIAFDMSTWKYAQVEGKTKTYGLESFAEWRPSNVLFLSVNYTYTYTKDPEGESLNRRPRHKGGLAATWKASKKATLNTNLQWVGSRLDSGAKDDDCVVTNKLESYFLVNVSASYKMTDNVELYGRIDNLFDEYYEEAWRYATPGRSAYAGVKVTL

SEQ ID NO: 1489 - protein, 241 aa, Thermosinus carboxydivorans Nor1
MNKTKIVIAVASVLTAGSVSAASFDVRHEYKSHTDQHATRVKLGDSIGNFLVDIEAKFKGEDGKFMEDLKNNGWELGLNYRHVLNDNWTMTYGMPIEGRESGVTYKPQVRATYKVDSVDGLSLSARYRYDMRQNTSSTEYQVDDNGEIVAVDQNIENQRRHRLTANVNYSMENWRFGFEGNYYKADGYDIYDNDDTNYELNASVRHIMGQWAPYVEFGDVSTSSTKATRELRSRVGLTYSF

SEQ ID NO: 1490 - protein, 1171 aa, Neisseria meningitidis serogroup A
MTPRSVLAVLALSAGLYAQDFRATLTGTVTDPSGAAIPNATVKATNVAINATKETKSTSEGAFTIPYLDPGVYNVEVIANGFQLMKRTNITLEVAMKLNLPIKMTVGQMTQEVTVTGQQEAIETSDANRGLVFDPIKTQEYPLNGRQTYMLMALTPGVVFTQEQFGASGFSGTRGWDVNSSYKINGARTGESLFLLNGAPISNNGGSWQLAPNVEAVEEFKVMTNTYDSSYGRFGGGVVNTTLKGGTNSWNGDVFDYWRNSILDANFFQNNYGGQKKGFHNQHQFGGVAGGPIRKNKDFIFGSFEGWQEVVPFPTLSSTPPAILRDGQHFSDLGYKIFDPLTTHTCNAATEPCQGQTYISNPFPNNVIPTSRISPVGAKILSYYPDVNAPGINNNYVAAGNLGRYYYEQPMVRWDHVFGQNDKFYSLFTFQQGHEYRSSTGFPKPAATGNTNNERNDKNIIADWTHVISPTTVLDVRASFGRFIQTTPGYSDFSINAKTLGMTGFVPAPTSPGDVAPSITLGNYNGPILSGSTAYSWNSYNQYNFTPSVTMTRGNHTIRAGFEMNYVTNGNVSTGSSNGIFTFNASWTQQLPARQQNPTDGSSVATLLLGYPNSGSISYNDTQYRSRPYYGFYAQDDWKITSRLTVNLGLRYDVQIPWLERYDRENRGWDPNYKQPNSDAILANWAKLKLAYDTANPNAKYPYPAVPAALTGGFVFPGVNGIPRRLYDTDWTNIQPRIGFAYRVGDKTVIRGGGGIYYQSSTQSGTTTGFTQGTAYSASQDGGVTPSAGASVNGAYSLVNPFPNGFAAPTGNKLGAQTNLGNGVSYDPPGFSIPRTYQYSFGIQRQLGHAIVAEVSYAGNYQNHINFTQNLNHEPFAGQQIAIADPSYYSRTLPNPFFGFLPVTSSQGSSATIAANNLLRPDPIYQGITNNLIQQGWYRSDQLQVRVEQRAFGSATGNGRAGVLTWVLSYAFSKAFEANHRLNDWNTNEPVIKEIDNTDKAQNLTFSGVWDLPFGHDRRFLNVSNKAARLLVDNWRLTPILSYASGNPTGMANLNNLCNDWHAQNQNENAWFNNNKACYTQLVTNQLRTNPDRFSDIRDPSVGPFINLALEKTIPMGERYKLQFRGESFNLFNHAQRPGPDTSFTSATFGQLPKSQLNFPRLVQLAAKFYF

SEQ ID NO: 1491 - protein, 713 aa, Neisseria meningitidis serogroup A
MNAPFFRLSLLSLTLAAGFAHAAENNANVALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFAGNNGVSYGASVFGKEGNFDGLFSYNRNDEKDYEAGKGFRNVNGGKTVPYSALDKRSYLAKIGTTFGDGDHRIVLSHMKDQHRGIRTVREEFAVGGENSRITIKRQAPAYRETTQSNTNLAYTGKDLGFVEKLDANAYVLEKKRYSADDKDNGYAGNVKGPNHTRIATRGMNFNFDSRLAEQTLLKYGINYRHQEIKPQAFLNSQFKIEDKKDATEEDKKKNRENEKIAKAYRLTNPTKTDTGAYIEAIHEIDGFTLTGGLRYDRFKVKTHDGKTVSSSSLNPSFGVIWQPREHWSFSASHNYASRSPRLYDALQTHGKRGIISIADGTKAERARNTEIGFNYNDGTFAANGSYFRQTIKDALANPQNRHDSVAVREAVNAGYIKNHGYELGASYRTGGLTAKVGVSRSKPRFYDTHPKKLLSANPEFGAQTGRTWTASLAYRFKNPNLEIGWRGRYVQKATGSILAAGQKDRDGKLENVVRQGFGVNDVFANWKPLGKDTLNVNLSVNNVFDKFYYPHSQRWTNTLPGVGRDVRLGVNYKF

SEQ ID NO: 1492 - protein, 1449 aa, Neisseria meningitidis serogroup A
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFSYQIVKRNNYKPDNSHPYNGDYHMPRLHKFVTDAEPVEMTSDMRGNTYSDKEKYPERVRIGSGHHYWRYDDDKHGDLSYSGAWLIGGNTHMQGWGNNGVVSLSGDVRHANDYGPMPIAGAAGDSGSPMFIYDKTNNKWLLNGVLQTGYPYSGRENGFQLIRKDWFYDDIYRGDTHTVFFEPRSNGHFSFTSNNNGTGTVTETNEKVSNPKLEVQTVRLFDESLNETDKEPVYAAGGVNQYRPRLNNGENLSFIDYGNGKLILSNNINQGAGGLYFEGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNATTTSTVTITGNESITQPSGKNINRLNYSKEIAYNGWFGEKDTTKTNGRLNLVYQPAAEDRTLLLSGGTNLNGNITQTNGKLFFSGRPTPHAYNHLGSGWSKMEGIPQGEIVWDNDWINRTFKAENFHIQGGQAVISRNVAKVEGDWHLSNHAQAVFGVAPHQSHTICTRSDWTGLTNCVEKTITDDKVIASLTKTDISGNVSLADHAHLNLTGLATLNGNLSANGDTRYTVSHNATQNGNLSLVGNAQATFNQATLNGNTSASGNASFNLSNNAAQNGSLTLSDNAKANVSHSALNGNVSLADKAVFHFENSRFTGQLSGSKDTALHLKDSEWTLPSGTELGNLNLDNATITLNSAYRHDAAGAQTGSVSDTPRRRSRRSLLSVTPPTSVESRFNTLTVNGKLNGQGTFRFMSELFGYRSDKLKLAESSEGTYTLAVNNTGNEPVSLDQLTVVEGKDNKPLSENLNFTLQNEHVDAGAWRYQLIRKDGEFRLHNPVKEQELSDKLGKAEAKKQAEKDNAQSLDALIAAGRDAAEKTESVAEPARQAGGENVGIMQAEEEKKRVQADKDSALAKQREAETRPATTAFPRARRARRDLPQPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIGRFDIGISTGAGFSSGSLSDGIGGKIRRRVLHYGIQARYRAGFGGFGIEPYIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 1493 - protein, 415 aa, Neisseria meningitidis serogroup A
MRTTPILATLLLAPALASASGYEVISVNPRDLALSHSAVAVQVDAAAASLNPAALSKLEGPTVSVGGSLLNIWTEWDGDPARGPAGHAQTRFEPVTPVAIYAGWGTKLADRGFGVGVGFTQPFGGNVFWEDDWEGRGRIVEVQRRFFGTYATAGYEVLPQLRLGGGLVWYYGFEYLKQGIQPIPAAYGELDTKGGGVTYQVSAEIQPVPSYPLVFGVDYKHKAHVTLEGDGNFVVPPSLESADTRDQGVSHDVTLPNLLNVGVGWRPAKPVLLTLQYSWSRWVEYVDDTFEGDAGLTLTVPRDYRNGQVVRGGVEWQALPALALRLGLMRDTSGLRDTTYSPTLPDSNTTGVSTGLTWAFGKRGLAVNAAFFYGYRDEVETEGDIAFPGTFQTDIMITSLSLSWNTDLARAARAR

SEQ ID NO: 1494 - protein, 725 aa, Neisseria meningitidis serogroup A
MTRFKYSLLFAALLPVYAQADVSVSDDPKPQESTELPTITVTADRTASSNDGYTVSGTHTPFGLPMTLREIPQSVSVITSQQMRDQNIKTLDRALLQATGTSRQIYGSDRAGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 1495 - protein, 174 aa, Neisseria meningitidis serogroup A
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSIGLGVLTGVSYAVTPNVDLDAGYRYNYIGKVNTVKNVRSGELSVGVRVKF

SEQ ID NO: 1496 - protein, 1815 aa, Neisseria meningitidis serogroup A
MKTKRFKINAISLSIFLAYALTPYSEAALVRDDVDYQIFRDFAENKGKFFVGATDLSVKNKQGQNIGNALSNVPMIDFSVADVNRRTLTVIDPQYAVSVKHVKGDEISYYGHHNGHLDVSNDENEYRSVAQNDYEPNKNWHHGNQGRLEDYNMARLNKFVTEVAPIAPTSAGGGVETYKDKNRFSEFVRVGAGTQFEYNSRYNMTELSRAYRYAIAGTPYQDVNVTSNLNQEGLIGFGDNSKHHSPEKLKEVLSQNALTNYAVLGDSGSPLFAYDKQEKRWVFLGAYDYWAGYQKNSWQEWNIYKKEFADEIKQRDNAGTIKGNGEHHWKTTGTNSHIGSTAVRLANNERDANNGQNVTFENNGTLVLDQNINQGAGGLFFKGDYTVKGINNDITWLGAGIDVADGKKVVWQVKNPNGDRLAKIGKGTLEINGTGVNQGQLKVGDGTVILNQQADADKKVQAFSQVGIVSGRGTLVLNSSNQINPDNLYFGFRGGRLDANGNDLTFEHIRNVDEGARIVNHNTGHASTITLTGKSLITDPKTISIHYIQNNDDDDAGYYYYRPRKPIPQGKDLYFKNYRYYALKSGGSVNAPMPENGQTENNDWILMGSTQEEAKKNAMNHKNNQRISGFSGFFGEENGKGHNGALNLNFNGKSAQNRFLLTGGTNLNGKISVTQGNVLLSGRPTPHARDFVNKSSARKDAHFSKNNEVVFEDDWINRTFKATEIAVNQSASFSSGRNVSDITANITATDNAKVNLGYKNGDEVCVRSDYTGYVTCNTGNLSDKALNSFGATQINGNVNLNQNAALVLGKAALWGQIQGQGNSRVSLNQHSKWHLTGDSQVHNLSLADSHIHLNNASDAQSANKYHTLKINHLSGNGHFHYLTHLAKNLGDKVLVKESASGHYQLHVQDKTGEPNQEGLNLFDASSVQDRSRLSVSLANNHVDLGALRYTIKTENGITRLYNPYAENRRRVKPAPSPATNTASQAQKATQTDGAQIAKPQNIVVAPPSPQANQAEEAKRQQAKAEQVKRQQAEAERKSAELAKQKAEAEREARELATRQKAEQERSSAELARRHEKEREAAELSAKQKVEAEREAQALAVRRKAEAEEAKRQAAELARRHEKEREAAELSAKQRVGEEERRQTAQSQPQRRKRRAAPQDYMAASQDRPKRRGHRSVQQNNVEIAQAQAELARRQQEERKAAELLAKQRAEAEREAQALAARRKAEAEEAKRQAAELAHRQEAERKAAELSANQKAAAEAQALAARQQKALARQQEEARKAAELAVKQKAETERKTAELAKQRAAAEAAKRQQEARQTAELARRQEAERQAAELSAKQKAETDREAAESAKRKAEEEEHRQAAQSQPQRRKRRAAPQDYMAASQNRPKRRGRRSTLPAPPSPSFDSSAYAAPRALHNPDWYENDYEEIPLDALEDENVSESVDTSDKQPQDNTELHEKYENDYEEIPLDALEDEDVSESVDTSDKQPQDNTELHEKVETVSLQPRAAQPRAQAATQLQAQAAAQADAVSTNTNSALSDAMASTQSILLDTGASLTRHIAQKSRADAEKNSVWMSNTGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRASIQTGLTLGNTLKINQFEIVPSAGIRYSRLSSADYKLGNDSVKVSSMSVKTLTAGLDFAYRFKVGNLTVKPLLSAAYFANYGKGGVNVGGNSFVYKADNQQQYSAGAALLYRNVTLNVNGSITKGKQLEKQKSGQIKIQIRF

SEQ ID NO: 1497 - protein, 764 aa, Neisseria meningitidis serogroup A
MRREAKMAQTTLKPIVLSILLINTPLLAQAHETEQSVDLETVSVVGKSRPRATSGLLHTSTASDKILSGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDDAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 1498 - protein, 707 aa, Neisseria meningitidis serogroup A
MGKANAFTAPITVVNYDEQALNNTEARTLVDAVAKKDASVWQFGGESNTLTGLYFRGYQLDARQFSVNGLAGMYGTQGTASVQVGSAQLIKGASTAVNGMNPEGAVSGSVNIETKKAADEGNRKIGLGRFSNNRAQGTFDLGQRFGENKAFGVRANGKLRHGDTPRHGYSEDNKEFAVNADYRGETLRVAFDSIYAKRKTNGGRARMQDIQNAGGRLFGAPDGKTNLLPSWNWQNTAGQTNMLTFEWDAFDNAQITGGIGYNKARYYGTLISPTVCLNATSTCTDMQNTNASGKVTARNYDYNTGTARLTDQYFRTLSMNLTARGEFETSPVTHNWSTAFDRVIRQRKTIRGTAAGAGKVEVKANENIANQLASFKADYPNSWENSANLDANIKVNSLALSDTLGFVDNKYRLTLGGRFQAVEYTNKKKSQSGDAKRFSPMLMAAWVPQPDLVVYGNYMEDLEPADIKTDDSGETTMAKPRVSRQFEVGVRKNWGNFVTTLNAFQIKRPGYWRGHTTTKTTKGVTTTLTYGNNSDFARYKAQGGAAGDEQGMERNRGIEFNTYANLLNNTLRPTLGLMYLQSTVKEYPNSRDMLVNGVQVANPRVIAKAGLEWDTPFAKGLTLNSNVSYFGKSYQDTQKQYAFPSYTLVDVGARYKTKLGKNTLTVSSSVENLFNKNYWQVQRGQYDRSFAVVGMPRTYWLKAELDF

SEQ ID NO: 1499 - protein, 921 aa, Neisseria meningitidis serogroup A
MRSSFRLKPICFYLMGVMLYHHSYAEDAGRAGSEAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQQYFVQTGGLKFNSNSGKWERDLQRQFWKTSYYKQYKDPQKLKKYIEDQDKDWRENLAPQYDITPIDPSSLKQQSAGNLFKLEYDGVFNKYTAQFRDLNTKIGSRKIINRNYQFNYGLSLNSYTNLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYSSEGEFKRAFGENSPTYKKHCNPSCGLYEPVLKKYGKKRANNHSVSISADFGDYFMPFASYSRTHRMPNIQEMYFSQIGDSGVHTALKPERANTWQFGFNTYKKGLLKQDDTLGLKLVGYRSRIDNYIHNVYGKWWDLNGDIPSWVSSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIFDFYAAYEPKKNLIFRAEVKNLFDRRYIDPLDAGNDAATQRYYSSFDPKDKDEDVTCNADGLCNGKYGGTSKSVLTNFARGRTFLMTMSYKF

SEQ ID NO: 1500 - protein, 723 aa, Neisseria meningitidis serogroup A
MAVDYVYDKTKLTDDEIIRLKKLRDRNSEYWKDDLFRFDLPNDSGKYFEGKPILRHDIEGAAKGNFLYPILTFSKKTYNDTINPDEKISFFDSPYTPGYTAAFVQGFGVKERNGDTEEQAKQYIDEVRRRLKKNVNIELLGIEGNQPNNSPFVGNNIFQYNYYYNHIFNTHRSLKHSNINSEILAVGNVADLYYKHYIRSTPPLLGSLTIYDPSFPKLTVTDNSHVIGQVIHLYELNLENSLWEPRWDSDVSYLSLYNSHIRFNTKNESLVVGENRIRPTPDNALETEKDFKSRFSNIGYHSSSKIISYNNSRDYVLGYPSIRFAYDLSEREADKPVLTLKSKVRGKTAIVFEEKALNNLKNLTYRQLIKTETDIEPDAFFLLEEYKKGRYRLFLQQCPNGFCIGVEKLAIPTHLVASYAQQAQAANTLFALRLNDKNSDIFDRTLPRKGLWLRLISGHLSQDVQGKTAPVEGNRKGIQLGGDVFSLQNQDYQFSFGLMGGQAEQRSTFRNPDTGNVTTGSMKGFGAGVYVTWHQLQDKQTGAYIDSWVQYQRFRHRINTEDGTESFTSKGITASIEAGYNALLAEHLTGKGTQIRFYLQPQAQLTYLGVNGGLTDSGNSKVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 1501 - protein, 908 aa, Neisseria meningitidis serogroup A
MQQQHLFRLNILCLSLMTALPVYAENVQAEQAQEKQLDTIQVKAKKQKTRRDNEVTGLGKLVKSSDTLSKEQVLNIRDLTRYDPGIAVVEQGRGASSGYSIRGMDKNRVSLTVDGVSQIQSYTAQAALGGTRTAGSSGAINEIEYENVKAVEISKGSNSSEYGNGALAGSVAFQTKTAADIIGEGKQWGIQSKTAYSGKDHALTQSLALAGRSGGAEALLIYTKRRGREIHAHKDAGKGVQSFNRLVLDEDKKEGGSQYRYFIVEEECHNGYAACKNKLKEDASVKDERKTVSTQDYTGSNRLLANPLEYGSQSWLFRPGWHLDNRHYVGAVLERTQQTFDTRDMTVPAYFTSEDYVPGSLKGLGKYSGDNKAERLFVQGEGSTLQGIGYGTGVFYDERHTKNRYGVEYVYHNADKDTWADYARLSYDRQGIDLDNRLQQTHCSHDGSDKNCRPDGNKPYSFYKSDRMIYEESRNLFQAVFKKAFDTAKIRHNLSINLGYDRFKSQLSHSDYYLQNAVQAYDLITPKKPPFPNGSKDNPYRVSIGKTTVNTSPICRFGNNTYTDCTPRNIGGNGYYAAVQDNVRLGRWADVGAGIRYDYRSTHSEDKSVSTGTHRNLSWNAGVVLKPFTWMDLTYRASTGFRLPSFAEMYGWRAGESLKTLDLKPEKSFNREAGIVFKGDFGNLEASYFNNAYRDLIAFGYETRTQNGQTSASGDPGYRNAQNARIAGINILGKIDWHGVWGGLPDGLYSTLAYNRIKVKDADIRADRTFVTSYLFDAVQPSRYVLGLGYDHPDGIWGINTMFTYSKAKSVDELLGSQALLNGNANAKKAASRRTRPWYVTDVSGYYNIKKHLTLRAGVYNLLNYRYVTWENVRQTAGGAVNQHKNVGVYNRYAAPGRNYTFSLEMKF

SEQ ID NO: 1502 - protein, 619 aa, Neisseria meningitidis serogroup A
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHMLETSDNARIRLNTKDEKLTVHKAYQGGADFLFGYDVRESDKPALTFEDKVSGKSGVVLERRPENLKTLDGRKLIAAEKADSNSFAFKQNYRQGLYELLLKQCEGGFCLGVQRLAIPEAEAVLYAQQAYAANTLFGLRAADRGDDVYAADPSRQKLWLRFIGGRSHQNIRGGAAADGRRKGVQIGGEVFVRQNEGSRLAIGVMGGRAGQHASVNGKGGAAGSYLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 1503 - protein, 702 aa, Neisseria meningitidis serogroup A
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGAVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGYRGSFTVPINPYDRASWPASGRLQPILTQNRHKADSYGIFVQNIFSATPDLKFVLGGRYDKYTFNSENKLTGNSRQYSGHSFSPNIGAVWNINPVHTLYASYNKGFAPYGGRGYLSIDTSSAAVFNAAPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYNSRNKEVTTLPGFARVDAMLGWNHKNVNVTFAAANLLNQKYWRSDSMPGNPRGYTARVNYRF

SEQ ID NO: 1504 - protein, 127 aa, Yersinia enterocolitica
MEGSRMKYRIALAVSLFALSAGSYATTLCQEKEQNILKEISYAEKHQNQNRIDGLNKALSEVRANCSDSQLRADHQKKIAKQKDEVAERQQDLAEAKQKGDADKIAKRERKLAEAQEELKKLEARDY

SEQ ID NO: 1505 - protein, 370 aa, Yersinia enterocolitica
MTTKKMAFNALGALACTLVPLAASAQSSVQVYGVVDMAVSNYRGAGAGSRQMLTSSGNQASRLGFRGREDLGSGLAAGFDLEAGLNTDSGTGQASNTNNQPSGAGSGNGLSFNRKSLVYLQSKQWGEVRLGRDYVPAFWNMFNYDPFRLGVGMSLHVLHGTTVTGFRASNSIGYLSPGCSSSSCKGLFYQLMTAFGENDAGPNRQDGRVYGARLGYGGDNWDAAVAITTTKNRAADDYRQINAAASYLWEGHRLMVLAADHRTGNRLAGLDNADHVRYWQLGAIWKVGNGNIPMSLMRLSRNDNSGSSSNKYAVGYVHNLSKRTALYGTYAYVDNRGSINLPVATGALQGPIPVAGGNASGFDIGIRHTF

SEQ ID NO: 1506 - protein, 710 aa, Yersinia enterocolitica
MFSADSRLGVAQPLKTFALNPARQHFNRALAVLCGALLTPLALADDAATDHSRHSTELSPTVITAIAPSSPLTVVTNPKDPRQPVPASDGGDYLKTIPGFALVRNGGTNGDPVLRGMFGSRLNILTNGGMMLGACPGRMDAPTSYISPETYDRLTVIKGPQTVLWGPGASAGTVLFEREPEHFGELGTRVNASLLAGSNGRFDKTLDAAAGGPLGYVRVIGNTAHADDYRDGNNDTVASRYDKWNGDVALGWTPDADTLLELTAGKGDGEARYAGRGMDGSQFKRESLGLRFEKSNLGEVLDKVEAQVYYNYADHVMDNYSLRTPSGTGMMAGPMASNVDRRTLGARIKATWRWADLQLIGGLDAQTNEHRNRASSGIDTYKELPRTKDADFHNYGAFGELTWYAAERDRMITGARLDRASAKDYRQSIGSGMMTRPNPTAGDTRADTLPSGFVRYEHDLADSPTTLYVGLGHTQRFPDYWELFSPKMGPAGSVNAFDSIKPEKTTQLDFGLQYQGEDLEAWASGYIGQVRDYILFDYNSKMMGMSTSRAENIDARIMGGELGAAYKLTSNWKADATLAYAWGKNSSDGKALPQMPPLDARLGLTYSEDDWSAGALWRVVAAQNRVDLNKGNVVGKDFGKSGGFGVFSLNGAYRVTKNLKLSTGVDNLFGKAYAEHLNLAGNAGFGYPATDPQAIKEPGRTLWTKVDLSF

SEQ ID NO: 1507 - protein, 146 aa, Yersinia enterocolitica
MPRSSFSGSLSSPKLDVVIDMGNPFLNLTVDGFLKIGAVAATRSVAEDTFHIIRKGSISSNDFEKSLKKMCKEGAYWGAIAGVYVGMEYGVERIRGTRDWKNAMFGGAVTGALVSAASNNKKDKIAVDAITGAAIATAAEFINYLT

SEQ ID NO: 1508 - protein, 711 aa, Yersinia enterocolitica
MLTEKSRFTLTTIAIAIAASFASSAAVADDKSQTEAKPEIIVVTGSLLGNSEVADLKTYTGNRSIITSDQIERTAARSIDTALQQVPGIKIKDETGTGVLPNISVRGLDSSRSGYAQVLLDGIPMTLAPYGHTGQSLFPATLFMIDRIDVARGGASIQYGPNNVGGVINLISKPIPTDWETSVNERMTFFGDSNTLFDTNISTGGAVNEDFSMRFDGNITKGESFREHSDTDIKNLMLKTLWNIDEQNSLDATLQYYDAFSELPGALNTPAYEADREQSLRPNDEFNADTKRVSLKYSHVLDDSKIIDYGEIDLRVFGNKSSRNFQWDFYDSSKDTDGNLGTSWSDTTQDATHLRNSPRDFTVFGIEPTASLLIDGDISQHIIAGARYINEDISYQLNHIDKSTQTATRPRDWQMDTNAMAYYVSNKVGFFDDTLSVTPGIRYEDVRMTFTNVGQDYSQDNHVTEWLPGITLGYEFSSNWFGYTNAQRSLRTPQISQLWPKDQTLESELSWNYEAGVRFTPTERSNLSIAAYRIDFENKVEYDRNVSMFVNIGQTRNQGIELEGTYSPMSLPDLVLTGAYNYLDTEQLDGEFAGNELAYVSKHQLSASALYSIKDVDLGLMAFYYSKSFADLANSVEEDVSGTSGEVPAYTVVNFNIATEFFKQDNHGLKVGLSVNNLFDNEYYFRGLDVSPAGRVPASGRSLSLDVGYTF

SEQ ID NO: 1509 - protein, 831 aa, Yersinia enterocolitica
MIGGVVSGFGILASPAALAACTTAGTTITCNGTTVGGQHFNETGQNITILSDAQVSTSADNTVSTIDFSSEQGLLTNAGTVSSFGNNTNGVLVRSIDARKMINSGTVSTTGDGSHAVKLSELGGSTVENNGLLVTSGTGSHGVNATEGSQRNTVSNSGRIVTTGAGSHGMSADNSHNNTLINSGNIAVSGSGSSGIFVGQYANDYRIENQAGGMINATAGNGISVTGNSTVTSITNNGIVEGEINGLYLSDTAQVGSIINSGFIVGNSAGVVFTDNSNTNLFINRGVIGSINGDAIRAENNIDITNGINNQGVIIGRVNAPGSNMSNSGIFDLLNNNAPSSVNNYSQTASGVLALQADDTSNYGKLQVAGNATLNGRTIVVTNGSTRFKEGDYLRDVVTASNISGTPYAVLDDSLRYQFVQEQTSTSYSLKIVETKLTTVKNAISSASNNTSLTALGGTIDTLINTNNNSTTTPTTLNCNGALASTVCAVTSSSTAAQVHKNVVQLAPLMDGSMPYIELNNLRAFGNIVGDRQESVRGQGYDSEFNPEKYLWIRPVGRWDNQSSRGDYTGYNADTRGIAIGADGLIIDQTRLGLALGMSRTDVNDTSSEIRHDARVESWNALAYGGYDFTPDTSLTWQTGFGRNTTQGNRYLNIENPADGSMAFRGTAHSDYDSHTFQAGLGLQSTFHPAESWTLTPVLRSDYYRVKNKGYKESGADDVGLDVDGATTEAWVFSGKAKAGLQLSEIVDVHGYLGAGYDVKNDPTQTTAAFIGSQTTPFTYKGMNESPWIAMAGVGVTAKFSDVLDGTVQYDAEQRTKFTSQSVSMKVRYAF

SEQ ID NO: 1510 - protein, 423 aa, Yersinia enterocolitica
MVMNQKNLFTRSALAAAIALISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYVAGMLGGQTDLKTANLNLSAAYRLNDNFSFGLGFDAVYADAKIVRHLGEAGGGLLPANTEAARLEGTKWGYGWNTGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKSQNVSITEKTPAPSNTTYEFNSKGSAMLYGVNFNYTF

SEQ ID NO: 1511 - protein, 799 aa, Yersinia enterocolitica
MHNSNALSLAISVALTVCTFAASAQSQSTQPQKTLDTLIVTGTRVSDRTVAESESPIDIISEESLQATGATDVATALGKLLPSLNFPRPAIADGNDAARPATLRGLSPDNVLVLVDGKRYHTSSLVNYNPYVGRGSAPADLNSLPMSAIARIEVLRDGASAQYGSDAIAGVVNIVLKHGAAAGSNSISVNGGIMDKGDGAQNGVDGSVGLPFGATSGDTAPGWVRLSWNYQNSMDTNRSENTNRATTLAGAANPSGVPYQRHGDPDARFYQGLVAFGYDFTPNVELYGHLSVSRREVTSNGYYRAYDNTDRNVQAVYPNGFLPQIYNPINDRSAVLGVKGTTASDWHWDVSATYGKNDMTFNILNSINTNLYWSTGSSPTNFNSGGFETEQGTLNADFNKSFDWGLAYPVNLAFGVEHRQDRYEIVAGSPASYFFDPDTINPETGTPYPGGAQVFSGLEPSVAGKFGRHSNAAYAALEADLTDKLSGGIAGRYENYSDAGSTRSGKLSARYAFTDTFSMRATVSNGFRAPSLAQQNYASVVTLPQDGQLVQVGTYRTSDPIAVQLGARPLSPEKSTNYGIGSVWQPTANFTSTLDVYQIRIWDQILYSDQIQLAQPIGQVGAVQFFVNGATSRTRGVDWVNSYRADLGAGGSLNLSASANYNKTKILELSNPNFGRASQGLLTESTPRTKYMLAADWTLGGFSLNGNATRYGAIKRIGDPADGSQDQTYSARWILNLAANYTWQALTFTVGADNVTNQYPTKAQLTTGYDDRASGLQYSSLSPFGFNGRYWYGRVTYRF

SEQ ID NO: 1512 - protein, 370 aa, Yersinia enterocolitica
MKLRVLSLIVPALLVAGTAGAAEIYNKDGNKLDLFGKIDGLHYFSDDKGSDGDQSYMRFGLRGETQISDQLTGYGEWEYQANLNRAENQDNNNFTRVGFAGLKFSDYGSLDYGRNYGVLYDIGAWTDVLPEFGGDTYGADNFMFQRTNGVLTYRNSDFFGLVDGLNFALQYQGKNDSATESNNGRDVLAQNGDGYGMSASYDLGYGISAAAAYFSSDRTNDQNGNNNAGILGRGDKAEAYSGGLKYDANNVYLAAMYTQSYNATRFGSSNSSTYGYANKAQNMEIVAQYQFDFGLRPSVAYLQSKGKDIERGYGDQDLMKYVDVGATYYFNKNMSTYVDYKINLMDENDFTKSAGINTDDVVAVGLVYQF

SEQ ID NO: 1513 - protein, 207 aa, Yersinia enterocolitica
MLKQSLLSLALMGSCSVAMADNYTYVAGGLQFGSINSNSRFDQQFDRQNYSHIGNKNMGGIYLNGGYSFDNSLFIDGRLSSLANDNRGSADAVLGLGYYFAFTPDIDFYTVVGASRHALVFDASKDGKKTNTYNSASGEIGVKTKLSPDIGVNIAYRLANYDKRAFHEARIMADYALTQKLAAEVGYTYHNWRVSDQAMQVGLRYNF

SEQ ID NO: 1514 - protein, 354 aa, Yersinia enterocolitica
MKKTLLAMAVTTCALSGAAFAQSSNVTLYGIADAGVSFQSHVNGGANGSGSVTGVTSGGLSGSRWGLRGVEDLGNNLKGIFVLESGFDIDSGKSAQGGRLFGRQAYVGLQGNYGAITLGRQQNALYDLFGAYDPMAVGPMYSLNSVDNQFNGRADNAIKYTGKFGGLTATGFYSFGRDVTSGLGGEVPGHFKVGTNFGGGLAYASGPFSVGAAYDQFQGSTLASADLTAKRAAIGASYAFGNAKAFAGYRWMQDEVTTGKARHDNLYWLGANYKFTPAFTLTGATYFTDARTDSKDSWMFVLNADYAFSKRTDAYLLLGYVKNKGNATFGVTGTANTLPGQNQTGAMVGVRHRF

SEQ ID NO: 1515 - protein, 768 aa, Yersinia enterocolitica
MVVSTTAPGESMLPTATPTESGAYGQPMNVLDIPRQLFPVNQKILQTEGAGTQGWFDPVSTAFLSPGSTAAAGNNLVFAPMIRGMPPLGYINGMQMTMQDAGWWNLPWNYNMVESMDVIEGPPNAVLGEFQPNGGAVNYITKQPYFDRFRGYVWDTTGMYENYLWGADIGGPIDKEKKIAYRFSYMGMENGSYYQYQYNDQQNFYLALSARPSDNYSVDFYSDFGTYNFNILDFMNRPTNELINNDLYQTGALAPSQVTFGFPPFNTYAGPLVPISLRSTAMNPASGAQGMSGMLQLVQNLIVNDDLRVRNNTFVFYIRSSLIDYAQWEDIDITGDYEVFNRTEVLAALHPEEALFEQNIDAGLEFGFQRNLDYEAVSFFGIQNAWSIVNPNNPTLANPYLWNAELSTSFMAGVGNPLAFGGGDWPIPSAPPGWYFEPLNGYSLTEDSQFWEVAPFYQHNIHFTDKLMLLVGGRATNLFISAQTPPGTPAFLSTSYDAAVLMPMVNVSPVYKPFPWMTAYFDFNWGYTSAVGVMGGYTPIYAGAEFRLVNQLIEGGMKFSLLKDKLYITTAGFQQNLYIPNVGLPPAPAYIKGFELALTYQPTKNFWARIQYLLANGTEDWSGLPIGPFQFQTYSTSTALAQGLPLNNATSYPPGKYAFVGWPDQSLTAMVTYQTNMGLGVTLSALVLSNQYLDYSYNLEIPTEYVINGRLFYTTSQWDFAVNIYNLTDNRHLWFPYGPGVTFGREMNTEQIVAGLPFWIQGTVAYRF

SEQ ID NO: 1516 - protein, 192 aa, Yersinia enterocolitica
MSYKAGFACATVLTAAVFTAPAVWAQDNVSRDKSGPYISGSYGGYKAHGGEFEDENDLLGAALGYQFNEFFALEAEYIDFGNFGDDDVEGKLKGAGLSAIGRLPLTDSFGVYAKAGAFASAFDVEAFDEDETYDEVNPFVGAGVDFRVTEQLTAFAEYNRYNVDIDEDDFNGQVTNDGPDFDTGRVGLKFQF

SEQ ID NO: 1517 - protein, 709 aa, Yersinia enterocolitica
MVGALLGTMPMEGLAIEDESEKAGAVTELPVIEVQGSTRRGPDELPSMYTGGQQARGARVGLLGNKDLMETPFSITSYTAQTIKDQQARTVADVMLNDASVRSVNPSSGRFEQFSIRGFTVLNSEVAFGGLYGIVPTYSIPVEATERVEIIKGPNALLNGMAPSGGVGGTINVVPKRAVDRPVIQLTGSYLSDSQFGGHVDIGRRFGKDNRLGIRLNSVYQNGDTPFRHQSIRRNIHTLALDFRGEALRLFADVAYQDRRVEAPLERVGVVSGVKPPSARRVDSGMTPSWTDANVQDIYGVFRVEYDISPVFNAYAAIGARRGDYDFMRATVSVKNAGGDFMTQPFQYLYKENALSAEAGLHAMFETGAIMHAINLGMSDFRLEYGNARQSFDSIQSNIFNPVEHPEPVTGGLSHHLPIVNKTHLSSIALTDTLSILDEQIQLTLGARIQQVEVNGYSPVTGARTKHYNKDAVTPAVGLLVKPWKKVSLYANYIEALTQGPTPAAGAVNINDIFPPSRTKQVEAGIKMDFGKLMTTVSLFKIRQPSGFTNPATLIFAVDGKQQNQGVEMNVFGEPFSGVRIQGGVMYLDGELTKTAGGLNDGNTAPGVPKVAANLGGEWDIRVIPGLTLTARSIYTSAQYLDAANTQKIPSWVRFDLGARYAIRHIATPVTIRANILNAFDKQYWSSAAASGLTLGDRRTLMLSATVDF

SEQ ID NO: 1518 - protein, 1025 aa, Yersinia enterocolitica
MKFKLLTIIFLTSFLTSFSQNTIEGVVNDDKGLPLIGAHVVVKGTKTGVLTDFEGGFKINAKFGDVLIVSSLGFDKKEVKIQGNFIKIVLGELNEVLNEVVVIGYGTVKKKDLTGAVSSIRATSIEKGDPIDLQTAFSGRVAGLQITQNDNGLGSGVRAIIRGGSSLTSGNQPLYVIDNFPIIPDDNVSSNPLSDLDPGQIKSIEVLKDASATAIYGARGSNGVIIITTKLGKVGKPVITATLSSGTSFVSKFPRVLTDLEYLDRQIIEDKINYLMSDDTGNFSSTWQEKKDANERGVDWAKEATQLASTRRMDLSIGGGTKEGLNYQISGNFLDQEGVVIYTNFKRYNLNSNLVQSIGKNTKIGTNIKLAFSKNIGRSLDKDADGIFKKIFSTNPFQPINFQLGAIDIDQETDTGDNENVITYLKDVKNETQSSRIIGNLFYETKLHSNLTFYTSYGFNRGYINNQIFLPSTVLKGYRQNGIAEFEKIEAINQVFETRLSYKKVIDNHDINATAVGEFSDNLKSIFTGGATGFSNQTNGFNDLSSATIPTLPRNNIAKDNLMSFLGRLAYGYNNKYLLTASIRADGSSKFGKENKWGYFPSVALGWTVSEESFIKNMNIFDNFKLRASYGVTGNNQIPAYSSLYLLEPGNYVFNDVFYTGVVPLHVANPDLKWETTAQSNLGIDLGFFKNRLNITAEVYSKKTTDLLLEVQVPLSSGYETALKNIGSFSNKGFELTVNSINIDNSDFKWRSDFTFSINRNKVLNLGDKDEFFFNANIFPSKFMNEILIRVGQSTGIYYGYIEDQIINNQTEAANSPLQDVLIEDDFNNGQVKIYDVNGDGIINTYDKVPIANTNPDFIGGLNNEFTYKNFDFSFFLRFSYGNDVINGNIGNLDKGGINNWNTLKSMSDNSYSAAYNPTGTFHGENGNGAYSSLFRSAYVEDGSFLKCDFITLGYAMPKSIVENLNLNKFRLFARINNPFMLTRYSWFDPEVNAIGGTAGRVGGGVDLGSYPRSTSITLGLSLNF

SEQ ID NO: 1519 - protein, 352 aa, Yersinia enterocolitica
MMKRNILAVVIPALLVAGAANAAEIYNKDGNKLDLYGKAVGLHYFSDNDGNDGDMTYARLGFKGETQINDQLTGYGQWEYNFQGNNSEGSDAQSGNKTRLAFAGLKFGDAGSFDYGRNYGLVYDVIGITDMLPEFGGDTGASDDFFAGRTGGLATYRNNNFFGLVDGLNFGVQYLGKNERTDATRSNGDGWATSLSYEFDGFAVLGAYGAADRTNNQQTLEWGNGDKAEQWATGLKYDANNIYLAALYGEMQNAARLGSRGFANKSQDFSVVAQYQFDFGLRPSISYYKSKAKDVEGIGDEDFINYIEVGATYYFNKNMSTYVDYQINQLKDDNKLGINNDDTVALGIVYQF

SEQ ID NO: 1520 - protein, 358 aa, Yersinia enterocolitica
MKKTAIALAVALAGFATVAQAAPKDNTWYTGAKLGWSQYHDTGFYGNGYQNGIGNGPTHKDQLGAGAFLGYQANQYLGFELGYDWLGRMPYKGSVNNGAFKAQGVQLAAKLSYPIMDDLDIYTRLGGMVWRADSKANYGNGTRLSDHDTGVSPLAAVGVEYALTKNWATRLDYQFVSNIGDAGTVGARPDNTMLSLGVSYRFGQDDVVAPAPAPAPAPVVETKRFTLKSDVLFNFNKSTLKAEGQQALDQLYTQLSAMDPKDGSAVVLGYTDAVGSDQYNQKLSEKRAQSVVDYLVSKGIPSEKISARGMGEADSVTGNTCGYKAGRATKAQIACLAPDRRVEIEVKGIKDVVTQPQG

SEQ ID NO: 1521 - protein, 172 aa, Yersinia enterocolitica
MHKITRSILAASVVLLSQLPCAQAAPQAGASQFAGPYVGFKLGVNNSDASGAFNKASHNTVFPGFTAGYNFDVQRFVVGAEAFADLHHGSTTFKDAGIDAKFGMPFNQFMPYIRAGFTGDDPDTRFHWGLGVDYKFAEHVSAVAEWTTDSSHHDGTKRTNNSFTVGVQYHFN

SEQ ID NO: 1522 - protein, 175 aa, Yersinia enterocolitica
MRKILIFLGLLFVMLSNIYAQKGRQAIGFGLSYGTEIESIGLGLKYQYNITNPIRLEPSLNYFIENDNVSMLDVNMNLHYLCPVGRSVKLYPLFGFTFSNWMFDLGDGFDIDVDGDHIHIDKDDDHHNECRVGVNIGGGADFVLTSNWIMNFELRYQLVSDFDQAVFNLGFAYRF

SEQ ID NO: 1523 - protein, 703 aa, Yersinia enterocolitica
MKIIKNHLFYSIILLYFFSLETSSQAIEEVIIKGDWRETSLSAEDSSIAVLDSKLIESQALKHFENLSYLVPNLNFAASDSRARHFQIRGIGERSGYERTPNSAVGLLIDDIDFSGQGGIATTFDVDQIEVHRGPQGARIGSSAMAGLIYISTKDPTESFEGKGEIVMGSYGTFNTGIAVGGPVNFNKDLTYRLAIKKDYSDGFRKNIFLNKSDTSKKDESTFRLKVNWVTDNQTTYKFLISQIELDDPADIWTIDGSLNTLSDKPGMDSQKSNAYGVKIYHQFKKFEFQSLSSLTNTDVILSYDADWGNPESHSPFIYDYFSETTRKRDTFSQEFRLVSQFADKNTEKSIEWVVGASFVDINETNAKKDTGIYGDPSDPYGPYFSNSSSLSDFSSSSYSLFGNIDYLINETIKISIGGRWENFKSNYFDSYDESFSPSNKMSGGKLSLVKTLNNNSNIYFNIAKGYNQGGFNLGLGLDKNSSNRNLYYDPEFLTNYEVGINSKFFQSKLNLGAVLFYSDRKDQQVLISTQVDPSDPNTFLYLTQNAAEGINNGLELNIDYALNKSLGIFANFGLLNTEIKNWISRPDIEGREQAHAPKNSFSIGINWKPTNQSYLSLNVVGKSEFYYSDSHNNTSESYNLTNINYGYEHGQWTYSLWARNIFDKYYSVRGFYFGNEAPDFIDTLYRRHGDPRHIGVMVQYDF

SEQ ID NO: 1524 - protein, 776 aa, Yersinia enterocolitica
MPRCSTRSAQRLSPLFLVLSLAVLGLAPPVHPAPAETAAAQEEEQWTINMKDAEIGDFIEQVSSISGQTFVVDPRVKGRVTVVSQARLSLAEVYQLFLSVLATHGYAVLPQGDQARIVPNMEARQDAAQKTVRDGPGSLETRVVQAQQTSVAELIPMIRPLVPAHGHLAAVPSANALIVSDRRSNIERIEAIVRSLDRAGEHDYSIYDMRHAWVAEIAEVLDRSVTPAAGKSAATVQVLADSRSNRLVLLGPPQARARLLRLAQSLDVPSSRSANSRVIRLRHGDAKTLAATLGEIGESLHGERGQDGRGSGKRGLLVRADESLNALVILADPEDVGLLEDIVRQLDVPRAQLLVEAAIVELSGEIGDALGVQWALRSGHVAGGAGFADSGLSIGTLLGALQAGKPPAELPDGAIVGLGSRDFGALVTALSRNSRSNLLSTPSLLTLDNQKAEILVGQNVPFQTGSYTTSASGSSNPFTTVERKDIGVTLKVTPHIGEDRMLRLEIEQEISSIAPTATLAAKAVDLVTNKRSIKSTVLADDGQVIVLGGLIQDDLQRSDSRVPLLGDIPGVGRLFRSSRETRVKRNLMVFLRPSIVRDAAGLERISHGRYRSIQLLRGAAGEPARPLFEDAGAIDLRPAAQVAPAPIGSPRSYPAPAPVLMEKPRLADPASLGDGRGGEVLEVRQGTHAPQPPSPQRYAVRLVEGSSEAFMRALIERHPGLSLRLRRELRDGQELFAVERGDYLDPEQARRALAELPESLPRGKARVIAHTPGSAL

SEQ ID NO: 1525 - protein, 789 aa, Yersinia enterocolitica
MKKVTFSCLTLATLLQLIPSNGNAANIQVNKKKTNRTEMKQDTIPANSTKKESEEGERNVMLNASDANKPREIQIGLPSEDVNVYENGLPAVYSSTVHKLAAHWRSDSSLGEVGLLSPSESAITTGNIAYSVNSFSKLGQKDFQGILNYRTNHFGMQNFDFNVSGAINNQWLYTASIYQNFDPGSFDLEFTNYADRTEIYHAGLTRLFNNGRGKISLLYKHSRSENPASYANAAPFIYVGDGSVKEIDGFKLGTNSYVPQNGSFPYMDVRDGKMKTWNLGDGSENRANEIALISDYRFRNDLLWKFNLKYMDAPRANYVDFGGSTISEVTANDGFTLSNGDPYEGLAEGRRTWLHVGKVKNFLITSELNKTFGNHDLRLGVNEWYYHLDYYSSSLQWMATVQNYPQLLTSTTTSSLDPTLTGQRVQTYGYNELSPEYTKGYENKLALYFTDNWQVTPQFNIYYGGRLEYYRMSADQISASRFPGFRIGDFTTYSKEEETGNIIATQRSIHPAKVVKDKLNYAATLRATYNVTGQFGLTADGTVATRFPRINEYAGTGPTEEQYKRVTIPLIRGGLFYKNKWINLTSMVTYISKSNNIDQQNLTKPGTEEGKTVLLIYNIKTLGWTTSAEIDPFKGFHLHALFTYQKPVYKNYNASVTFNDGSEMSVNANGMIVKEIPQILVELDPSYNITKDLRLWLSFRYFGKTYANLQEALYFNGRWETFGGINWNVNKHLSLGATVINFLNQKGASGTINGSELITKEEAAQYAGNYMSGNYLRPFTVEFSASIKF

SEQ ID NO: 1526 - protein, 473 aa, Yersinia enterocolitica
MVTHCQIAAHKAKRKTLALAIASVLFGTGFMAAPEARADGFIDDSSLTGGIYYWQRQRDRKDMTPTSPEYGKYVANLHHSTFNANLAFSSGYVADMFGLDLAAFGAVEISNSGPAAPNEIGFSDAKTRWDEKWTGDKSGVSVYRAAAKFKLGDFWARGGYIQPTGQTLLAPHWSFMPGTYRGAEGGAKFDFDTAGALSMSYMWTDEYKAPWYQNMYHFRQADGLTGVSYLHSFGAKYDFKNNLVMEAAFGQAKDYMDQYFAKASYAFPVAGNDLRTTYQFYGAKDKVDGGASNANDVYDGLAWLQALTLGYTTGPFDLRLEGTWAKADGNQGYFLQRMTPGYATSNGRLDVWWDSRSDFNANGEKALFGGVMYDLKNWNMAGWSVGTSYAYGWDAKPSTNPKFDQNTRLKESAWNFDILYTLQEGRAKGTLFKLHYTLYDNHTNIPSYGDGFGNVFQDEKDVKFIVIAPFTLF

SEQ ID NO: 1527 - protein, 656 aa, Yersinia enterocolitica
MYMNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPFGHRGVYAGWRAELSASATHVKKGDPHQAGYTIHSFSLSYKPVSVKGFEASVTLDNAFNKLAMNGKGVPLSGRTVSLYTRYQW

SEQ ID NO: 1528 - protein, 360 aa, Yersinia enterocolitica
MMKRSVLALAIALGAITSFANAAEIYNKDGNKLDLYGRVAAKHVFSDDKSEDGDKTYVRLGFKGETQINDQLTGYGQWEYNVQANHDEGQGTAGTKTRLGFAGLKFADYGSFDYGRNYGVVYDAEAYTDMLPEFGGDSYSYTDNYMTARSNGLATYRNRDFFGLVEGLNLALQYQGKNDGDGRAVSKQNGDGYGMSLDYQDIGGSGIGVAAAFSDSNRTSKQKESEYGKGDSATAWTTAIKYDANQVYLAAMYADTRNMTPISGNGISGFANKTQNFEVVAQYQFENGLRPSLAYVQSKGKDIEGIGDVDLVKYVEVGATYYFNKNMYTYVDYKINQLNDDNKLKLSTDDIVAVNLTYRF

SEQ ID NO: 1529 - protein, 722 aa, Yersinia enterocolitica
MNINKKPLNAAIALALISMANSTLAAQEQSTKKEGLEVIQVTAQKRVQNLQELPTAVTVFNAQALADKGITDVEDLSVYTPNMQISETPGGSTGATIAIRGSVTINPAVTWEPTTGVYIDGVFVSKNVGGLFDVAAIERVEVLRGPQGTLYGKNTIGGALNIVTRKPSGEFTGEVRVGAGNYGMTDVYVTADSAQINDKLSFNFTANKKQRDGFYDNLSTSSDIDKFKELDSTSLRFGALYEHSDNLEFYYTYDSSNKKNTPPLGQVYIAGAMPEDTKDRQESAALDGAIFDRSKSSGHALTVTWQQSNNLTIKSITALREIDYDDGNDYDGADFLGFHTYRHVEHEQVSQELQFIGDIDNLTYVAGLFYFKEESDVNNPYVLGFGTVNNYYGVESTSVAAYGNVEYRLSDKLMLAGGLRWTTEEKSFYIEHPDDFSFAYFFPLPYTTAGDTWNNTSAMASLNYELADNIHSYVKVSQGWKAGGFNGEAATQALAVKPYAPEEVIAYEWGLKSRWLDQRIQANIAVFYNDITNMQMSEYLGAYSDIQNAGSAKVAGLEFELVAALTDDLTLNFNYGLLDPKYDKFITYDVYTGVANDVTDSAEFPYSPKNKWSLGLNYISETALGEFSAGADYSFVDDHFAFHNQPSAQYTRIEKYNLLNARVSLKRIAGSDFSASIWGKNMTDEEYRINGVPLGDSSGVFIGGLNYYGDPVTYGAEITYSF

SEQ ID NO: 1530 - protein, 238 aa, Yersinia enterocolitica
MKFKLLALAVTSLISVNAMAVTIDYRHEMKDTPKNDHRDRLSMSHRFANGFGLSVEAKWRQSSADSTPNKPFNETVSNGTEVVASYVYNFNKTFSLEPGFSLDSSSTSNNYRPYLRGKVNITDDLSTSLRYRPYYKRNSGDVPNASKNNQENGYNLTAVLSYKFLKDFQVDYELDYKKANKAGAYQYDNETYNFDHDVKLSYKMDKNWKPYMAVGNVADSGTNDHRQTRYRVGVQYSF

SEQ ID NO: 1531 - protein, 778 aa, Yersinia enterocolitica
MNKHPLAHALATVNHQRYFPQVISSLALALLSLPALAQPGAAGPVEELIVTGTPGGASVRRFDASFAISTVSDEEIQQVAPASTADLLKTIPGVWVESSGGVSGANIFVRGLPSGGDADFVTVAINGLALYPAPTLSFMENSTLFRVDETIARLEGLRGGPNPVYSNGQVGLTTNFILKEGGEETEGTVRYTTSDYELQRIDAVISGKLDQDLYYMIGGYVSSSPGVRDAGFNAEEGHQITINITKILDNGKANIFHRSTDDHGTWYLPVALDVDGIKTGLDASYTQVGQANRLVLVPISGADGEGGSETRWESFDMGEGRGWNGSVTGGAVELNLNNDWTFTDRFSLTKGAANTLGFVPQGAAVSLGSLNGGAAGETVSGAAVAADDLVQQFGPWVVMKDIKAFNNDLSLAKRWENYKLTLGYYTSSWEVDEWWSIGNQKWYRLGHNGEMISPASISDACQGPEVATCSWKYDVDALGDARENAFYIAGETYIGDVTLDAGVRVVNRKTHYAVDHTTDDDGPRDGITDFVASADEDKVSYTAAVNWNFRDDMGVFVRINDGHKYPDFDAYRDFRGDYNNGSDLVIDVSQFELGYKLARDNYSLYATAFSNNTKGQPFCDVGGASCDRLETKAVGVELDGKLFLGDFVLDLNATFQEPEIDNGELAGNQVLRQPTHQVRLTPSYQFAFNNGVEASVYGTLSLISDRYGDNANTNKLDSYTKFDFGVQVSVDNFNVQLAVDNATDELALTESDPRAVGTSANGRYILPRNVKFSVGYNF

SEQ ID NO: 1532 - protein, 371 aa, Yersinia enterocolitica
MKRNILAILIPTLLVATTSHAAEIYNKDGNKLDLYGKVKALHYFSDNTKSDGDKSYVRLGFKGVTQITDELSGYGQWEYNFAANYAESQEAKDNKTRLAFAGLRYGNLGSIDYGRNYGVLYDIAAWTDMLPEFGNDSYTRTDNFMTGRTTGVATYRNTDFFGLVDGLKFSLQYQGKNGAEGETNNGRTDTSKQNGDGFGLSSSYEIGAGVSVGAAYASSNRTLAQKNSTFGKGDKADAWTTGLKYSDNGVYLAANYAETRNMTPISGTAVINNVSTSVSGFANKTQNIELVAQYLFDFGLKPSIAYIQSKGKDIEGIGDTDLVKYVDIGATYYFNKNMSTYVDYKINQLNDDNKLKLNTDNVVALGLVYQF

SEQ ID NO: 1533 - protein, 379 aa, Azoarcus sp.
MSAGSPKFTVRRIAALSLVSLWLAGCSDTSNPPAPVSSVNGNAPANTNSGMLITPPPKMGTTSTAQQPQIQPVQQPQIQATQQPQIQPVQPVAQQPVQMENGRIVYNRQYGNIPKGSYSGSTYTVKKGDTLFYIAWITGNDFRDLAQRNNIQAPYALNVGQTLQVGNASGTPITGGNAITQADAAEQGVVIKPAQNSTVAVASQPTITYSESSGEQSANKMLPNNKPTATTVTAPVTVPTASTTEPTVSSTSTSTPISTWRWPTEGKVIETFGASEGGNKGIDIAGSKGQAIIATADGRVVYAGNALRGYGNLIIIKHNDDYLSAYAHNDTMLVREQQEVKAGQKIATMGSTGTSSTRLHFEIRYKGKSVNPLRYLPQR

SEQ ID NO: 1534 - protein, 641 aa, Azoarcus sp.
MTTRNPFSRRARLPLAVSLASSLAAPAFGVTFNIGEIEGSFDSALSVGASWSTAKPNKNLIGVNNGGKGLSQTSDDSHLNFKRGETFSKVFKGIHDLELKYGDTGVFLRGKYWYDFELKDEHREFKDIDDSGRKTLAKSSGAELLDAFIYHNYAIGDLPGSVRLGKQVVNWGESTFIQNGISAINPIDVTAFRRPGSEIKEGLIPVNMFYLSQNLTDNLSAEGFYQIEWDQTVVDNCGTFFSQPDVVADGCDQNLAVLTNNKASINLLNNVLAGAGLSVTPSPWDEGILVRRGPDRDARDSGQYGFALRYFADELNTEFGAYYMNYHSRLPIFSGQGASASTMAAINDLATRLAAINPALAAQAAAAATAGNSSYFIEYPEDIRMFGLSFSTTLPNGTAWSGEVSYRPNAPVQLNTTDILFAGLDPVSIGGNRPYDNASVLNGQAGQDLHGYRRKEITQLQTTLTHFFDQVMGAERLTLVGEIGWTHVGGLESTSKARYGRDPVFGPGPLPGTISGLASCQALNVSTLGTAEANNVSRYCENDGYTTSDAWGYRARAIWDYNDVFMGVNLKPSVAWSHDVDGYSPGPGANFEEGRKAVSLGVDAEYQNTYTASLSYTNFFDGKYTTVDDRDFVALSFGMNF

SEQ ID NO: 1535 - protein, 708 aa, Azoarcus sp.
MLPRISQRPFILSALTLCVSGAVSAATTTTAQHHKVSDDDTLIVTANRSESSLWESPATIQVIDRQAIQNSTSVSIADDLQDIPGVEVTDNSLAGRKQIRIRGEASSRVLILIDGQVVSYQRAGQNYGAGLLIDESSLERIEIVKGPYSVLYGSQAIGGVVNFITKKGGDKPLGGSVKAVYNSATAGWEESAAAWGSIGNFDYRINGSYSDQGNRDTPDGRLPNTNFRNNSQGVWLGYNLDRHKFGLSLDRYKTSTQTWISDADNQYDEFSVRIPKLEREKVGVFYDYDADGDYLKKIHLDAYSQTIERKFENRVKTTQVIPSPMIQALTVSNQTNTNDKQYTQGVTLQSNFSLPANNELVIGTQYQHDKVKQDTNSSTRQTAATGVFDIQTNTLSHIEAEQGNASIFAQNDWRFADDWTWTVGARQYWLSSKLNRSDSLSGTTWQSSGGKSAHDDELVTSTSLRYSGFDNLELRAAYAQGYVFPTLVQLFMQTSAGGRITYGNPDLKAEHSNNYELGARYKGNMWLIDGAIYYSEAKDYIASLACSGQAICNGSSTSSYYYDNIDRAKTWGMELTAEYNAWAVSPYLSGNLIRRQYEGDVQKTWDTGEPMLTGRAGLKHTLLLNAANITSDLFIRAASSAKDNTGETEIRYPGWATLNLAFNTEFGPQDQYQVNLALNNLTDKRYQTAHESIPAAGFNAAIGFAWNF

SEQ ID NO: 1536 - protein, 150 aa, Azoarcus sp.
MQTTRPRITWKVLPMAQVAIFKEIFDQVRKDLNCELFYSELKRHNVSHYIYYLATDNIHIVLENDNTVLIKGLKKVVNVKFSRNTHLIETSYDRLKSREITFQQYRENLAKAGVFRWITNIHEHKRYYYTFDNSLLFTESIQNTTQIFPR

SEQ ID NO: 1537 - protein, 189 aa, Azoarcus sp.
MKKKLALLTAGLALAGFSAAPASAADHYVSGNAGITWMNDVDYAGHKAEMDAGFALFGAIGCDYGDTRLEGELGYMQNDVDKVDGASASGDISVISLMANGYYDIDTGGGIEPYITAGVGFAQGHAEDVTNFGTWNETTLAWQVGAGVAVPVGNNVMVDLRYRYFDTTDMLDDTNIGSNNLLVGMRVGF

SEQ ID NO: 1538 - protein, 362 aa, Azoarcus sp.
MHARSLREPLQRPSPFLLKSPRFRHHESCLCTAGGGGLSGSRWGLRGTEDLGGGLKALFVLESGFGLDDGKSQQGGRLFGRQAFLGLQSDTLGRVTFGRQYTTMFDMFANFSPTGYATLYEPVVAQLGTNFRSDNTAKYTAVIGPVTAEAHWSFGTGVGAIGTTPLAGGGAGEVPGNFNNNAGGGAGVLYMSGPLGLTVAYDEWRPAVNIGSPGRSRKIGAAGSYTYGPAKLMAGYRYGRTTDSSGNELIRDNYYWIGLNYQVSAPLGLTLAYFYDDVTQLRAPAGVGQAALPSNNPANPWQISFVADYNFSKRTDVYLTMAYAKNSGLNFDTSAVSFANGYFLQQGANSQVGVALGIRHKF

SEQ ID NO: 1539 - protein, 268 aa, Azoarcus sp.
GGLSAATVCACSLLVSGAVVASPMSHEVASEGGVMGGSFYVGAAYSPAFPSVTSFDMRESSKETSYVRGYGKSIATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLG

SEQ ID NO: 1540 - protein, 1951 aa, Azoarcus sp.
MVGPLVVGYEIQNDNAGSGKREVINEGTLTDDKEKDLEEIGGLKKGDSDKLKRSPHLGGDEINVARTKDKVVNGQVIKGGYTGYKIGMILTQEFDDPNPGNNYYRLINDGTISFMGRNSIGIQVYAKPNNKASTIIDVINKENKNGAGEITLGGIESYGLKLSSRILREANGRKSVFENRGKINIKGGDGSENSLSSGMAVLEDTTMMGNFAIRAYKGMVVNKGTIDVSGGKGNTGMILKVNAGDDITNDTNGIINVSGTANIGMRVDKGAVNTDEPGDPEAINNGTINVSGSATKAKDGNIGMVAHNQAKATNNKHITFASGTKYGTGLLAKGAGAKIENNGANAKITGSGLERTIGMSALQGTTGSNSGTIDLSGNRVTGVYNEGTFNMTGGLLKAAGNQSISLYSKGSSSTTNITGGTIVAGNKAVGLYADGSTIGIKNPTKLEAHNEGLMFYNYASNNPTDPSGRFNLTGDVEGDIKSGGTAFYFKGAASNTASFLNQMFNKGQASSPGKLKLKLEDGATLFVLDSPGGAPIKLSTVRTLGTALGDKVDISRTTSNKYKAYTVYKGSLEIDEAVNLDNETDNFYKMDFTASNVTINENINVTGSKAGKVIIAQANYNGATSSSTIKVTNKGKIDYSGNKSTALATDFGQVTNETSGTIRMSGDNSIGLYGAANSIVTNKGTIEMGKAGVGIWGANNLSNKYANRNINIVNSGTIRGISGKEGIFGIYAKNSHAGATSNISHSGNIDLSQAKKSTGIFMTKGTLNSSGNISVNEGSVGVNAEDSTVNVNGGTHTIGANSIGFNLKGNSSKLLANSGNISITGKGSVAYLFEGVNLTSGTNFKDNLTLTATNGYTYINLTNSTLNYKNQKTINNDETIFVNSKNSTVNLQEGNDISSTKNKVVGVYSEGGAISNAGKITLMGNGSSALYSKGSGTINGAPGKITIGTNGSGIYVVNTGSTGSNYGEITIGAGSVGMRAENGRIKNYSTGKISSTAEKATGMSQSGNENLENEGTITLTGNQSVGMHSEGVTAAGHQMINKGIVTVGHSATATSPSIGMYAANTDKTTIINNGKVIAGNKSTGIYGGNVTLNNNSETSAGNGGIGVYSKGGTVDIKENAKISVGDTLGDKQEGVGVYLAGNNQTLNSDTDNLTIGKGSFGYVMTGQGNTVRTGKAGTTRKITLTHNSIFMYSADRTGTAVNYNNLRSTGDLNYGIYASGRVDNRGTIDFSQGIGNIGAYSYTKGATTTPNSIRNYGTINVSKSDLQTNPDDRKYGIGMAAGYSEESPAGSGRKVTRGIGSIENHGLIRVTTPDSIGMYATGKGSRIYNGPTGRIELSGRKRNIGIFAENGAEVVNEGTITTVGSGNVGQIGIGITSGATLINRGNIHVNAARGYGLFVAGGIVKNYGNITVAGGAQKTKEVSAADTSKALGDEGLDRVGIKSPAGASKGTITSNGKVKRPTIVRAIPNRKPSEIPKSSIGMYLDTSGINYTKPINNVGALAGLKQGDLIVGTEAADYTNSKYIQLGQDIIKPYNEMIRKSGIEKWSIYSASLTWMASITQLPDYTIRNAYLVKIPYTVFAGDKKTTRDTYNFTDGLEQRYGVEGLNSREKELFKKLNKIGNNERILLQQAFDEMMGHQYANVQQRIYATGQILDKEFDYLRDEWKTVSKDSNKMKIFGTKGEYKTDTAGVVDYKNEAYGMAYVHENEDIKLGKGIGWYTGIVDNTFKFKDIGKSKEEQIQAKVGLLKSVPFDDNNSLNWTISGDIFVGYNKMHRKYLVVNEIFNARSKYYTYGIGIKNKISKDFRLSEDFSLVPYGSLNLEYGRVNKIKEKVGEIRLEVKENYYVSVNPEIGAELTYKHLLASRKIFRMGLGIAYENELGKVANGKNKARVAYTSADWFNIRGEKEDRKGNIKFDLNIGLDNQRVGVTANAGYDTKGHNVRGGLGLRVIF

SEQ ID NO: 1541 - protein, 716 aa, Azoarcus sp.
MYRPFCVVDLRMFVCLGLIDMSVSVSAARAEDTQIQLAPVTISAEASAPSLSSVEGGYRVKTASLGPFGEVPVVNTPFSITIVPSDLAKNQQLLSVREAFRLIPSVQGENIRPQTRGMQAGVVQNTRIDGLNIAATTDYPIEQFDRIEVLNGLSSAIYGPSNPAGTFNFVLKRPTDVPLHELTFGYLSQTSWLGHADVGGYLDEGKHFAYRLNLLNQNGENYVNGSQLKRQLASLAFDVHITPETVVETNASFYNYVTKGLPGTFALASKVAFPAAPDPTRLGYGQPNGGDDNQTLILGGRLKHDFSQDWHLTAGILRQSNDRASTVPTNTITNNSGAYTTTAATTTYSLDTVLSNQVALNGRFFTGPVSHDFVIANNGFLWDRYTPFQTGAVTLGSASLNNPAIFPAKAFPDFKNRYRSVETLQQSITVGDIIGLTDQWAVQFAISQSWINAQNFNKTGVMTSNYNTSGVSPTASLLFKPYQNMTAYLTYAENLQQGDSAPAGVANAGNVLAPYRAKQWELGYKVDLDKINLRAALFQIQRPYAYTVNNVFGINGSQINRGIELTAAGKLTDDLTVFGGLSLLDPRLYDTGSVTTTGKQILGLSHVMFNVLLDYQVPVVPGLAFNANVNFASDRPGDYANTTFVNGYVVADLGMRYVTKIFERPVTWRLNVYNIADAHYWANVAPSGQNGYNSTDNGTGTLGAPRTVRLSMQMDF

SEQ ID NO: 1542 - protein, 726 aa, Azoarcus sp.
MLRNVAGLLAFCSFFSAGLRAAEIKGKIIDPSGAPVAGAQIAAVNRLGVIIRTTASLTGGFQLDAPETPDLRIVVTAAGFSTRTLPPAEAATVQLDIAPQVDSVEVVGSTIEIPTTLQASSVDIITNTQLRQRNEPFAMDLLRYVPGVAFNQSGAPGGVTSLFLRGGNANMNLVQIDGVPVIGFGGGLGFDFAHIPAEAVDHIELVRGAQSAVYGSYANSGVVDFVTRQPQSAPQLDLLAEGGSHNERRFGITATGSLAGFGLLVSASRFDTDGVVANNDYRNEDVLLNVTRRFGRQSLALHGYFDSNDVGEPGPWGSNPLHIFTGIDHVSRGKNNFSEYGAHYEAGLSARVRTELTGSFFLANNGYVSQYGFSYNQDIRGLGESRTIVSISPHDTASFGVTAGREQVTNTYITDSSFSTFPIKRNEIAIYAENRYEIGNRLFLSAGLRGEFFRTASVPSDGFSRPFFPQTNISRANPKFSAAYAVPKGTRLHASFGMGVRPPSGFELAFTNNPALRPERTRSFDAGIEQRLGKFLVLDGTYFYNRYYDLIVTLGGSLTTLSHYKSANLANSRAQGAEFSARLRPARWVFVTGSYTLLETRILSLDGSSNQAPLPFTVGQQLTRRPENSGSLVATFTHGRLAADLTGYFRGKTLFEEPSYGASSGLFWDPGFANVGVNVNYSLAHGVAAYAHLRNALNKDYEEIYGFPSPKLNFVAGLKWTLAKGQ

SEQ ID NO: 1543 - protein, 723 aa, Azoarcus sp.
MTTRTKRRLRRVLVPAAAALSCASVFAAEPADTQDAADTTPAAATASASTLDTVSVTGKKQPYRKLTATGATKTDTLLKDLPQSVRVLTEDLLEDAGVTNLAGALDLSSGVSRQSNLGGLWDSYAMRGFTGDPSFGSDYLVNGFNYSRGYNGVRDAANTGSVEVLKGPSAALYGRGEPGGTVNITTKKPLFQREGQVDISYGSFDAFRTAIDLTGPISDRMAYRLNGAYEKAGSYRDHVSSERSLISPSFLWMLSDDTTLSYELEVSRQKATFDRGVMAINGKLGVLSRKRFLGEPGDGDHDTETVGHQVFLQHYLNDDWQLQGGFSFRESSIKGTSTEVRFLRADGENAARQRRTRDNEASDLSARAELLGSFRTGPLKHNVLFGVDAYKFVDERLQYRIANAGDINIFEPVYGNVVWGFTPANRNTDTKEEQDSRSLYAQDQIDLTEQWKLLLGVRFDDYDQKLTNNRNGIVVKKSLAATSPRVGLVYQPTKQVSLYAQAGKSFRPNGGVSRDFTAFDPEEGRSYELGAKWDSADQRITSTVALFHITKENVLSPDPVDPNNFYVTAGEVESKGLEFDLSGEIMPTVRLSFAYAYTKTEVTKDNNKLLEGRELANVPLHSANLMLVKSLSLNDKPATVGVGLNYVGEREGAVAPLVAADDFKLPGYTTVKLTGSYNFDKQTKLMLEVDNLFDKEYYTSSYSQAWVYPGSPRAFKATLQHRF

SEQ ID NO: 1544 - protein, 2371 aa, Azoarcus sp.
MPRGSMNIAHSKKSGESFPRFLLPTGVFLALSGAGIVSAYATCSTAGTTVTCSGVANPLAPSYSNSANNLNVTVNPGASVGVLLGVGGTAMSLTGSNNTLTNNGTIDPSVLGSGLGVLSSGAVVGNAAASTTTVTNNGTMNGSTGVAISGVTGMALSVQNGTGGTSTITNTGTMGTSALAGATLIGADAPVVAAYGGGTVNMTNSGTITGRVSLGSNGTPGLGNTFTNSGTINGSVSMGANSTNTFNAVTGSSVNTAGGTGGAFNITVGPVTLGVAATGTVDGGAGGNNTLVLQQGGSANGTIAVNNYINFNHLDVTSGNWTINGASTAQDATLAGGVAIIGDNASLGTGTITATGGALQAGAAGLDVSNNVTLGAGGLTVQGATGLSLSGTVSGAGALTKNDGGILTLSGANSYTGGTNLNAGGLVVGNNDALGAGALNVNASASLDTSTNVTLGNAVNLATGATLALGGSNDLGLAGTISGAGGLVKNGTATTTLTGANTYTGDTTINSGTLALGAGGSLASTGTVNLTGAGATFDLAGATGAQTIGSLAGAAGTNVNLGGNSLTLDGSANTTYAGTIGGTGGLTLSGTGTQALTGANVYTGDTNLNGGNVVVGSNTALGFGAINVNGSSTLDATTNVSLTNGVNLATGTTLTVGGSTDLGLSGTIAGAGGLVKNGAAALTLTGANSYTGGTTLNAGGLVLGNDAALGSGALSVGGAATLDTTTSLSVANAIDIGTTATLTLGGSNALGLSGAITGAGALVKDGAATTTLTGTNTYTGGTTINAGTLAIGAGGSLSSTGTVNLANAGAAFDIAAGGAQSIGALSGAAGTSVNLGANALTLGGSASGTFGGTIGGTGSLTLNGTGTQTLNGANTYTGGTNLNSGSLVLGNNAALGSGALNVGGAATLDTNASLSVANAIDIGTGATLTLGGTNALGLGGGISGAGALVKDGAATTTLTGTNTYTGGTTINAGTLAVGAGGSFASTGTMNLAGAGATLDLSGASGGQSLGALSGVAGTNIDLGGNALTLGGTASGTFGGTIGGTGSLTLDGTGTQTLNGASTYSGGTNLNSGGLVLGNNAALGSGALNVGGAATLDTNASLAVANAIDLGTGATLTLGGTNALGLSGAISGAGALVKDGAATTTLTGTNTYTGGTTINAGTLAVGAGGSFAATGTMNLAGAGATLDLSGASGGQTLGALSGVAGTNVSLGANALTLGGTASGTFGGVIGGTGGLTLAGTGTQTLSGANTYTGGTTINGGSTLALGAGGSLASTGTVNLAGAGATFDLGGASGAETIGALIGATGSTVNLGANALTLSGSGNNTFGGAIGGTGSLTLAGAGTQTLTGANTYTGGTTINGGSTLALVSGGSLASTGTVNLAGTGATFDVSGAAGAETIGALSGAAGTNVNLGANALTLNGSVASTFGGTIGGTGAVTVAGTGTQTLTGANTYTGGTTINGGSTLALGSGGSLASGSTVNLAGTGATFDLSGASGTQTLGTLTGTGGTNVNLGANALTLNGSGNGTFGGAIGGTGGLTLAGTGTQTLTGANTYTGGTTINGGSTLALGSGGSLASSGSVNLAGSGATFDVSGAAGAETIGALSGVAGTTVNLGANALTLNGSGASTFGGTIGGTGAVTVAGTGTQTLTGANTYTGGTTINGGSTLALGTGGSLASTGAVNLAGTGATFDVSGAAGTQTIGTLSGAAGSTVNLGANALALNGSTNGTFDGVIGGTGGVTVAGTGVQTLTGSNTYTGGTTIASGGTLQLGNGGTSGSVVGNVVDNGALIVNQSGSVTLANVLSGTGSLTQAGSGALTLTGTNTLSGPTTVAAGTLDVAGSLAQSAVTVQNGATLTGTGTVGGVVVQSGGIAAVSQPGAALNVAGNVTFQPGSTLQVAVTPQQSGSIAAGGTATLNGGTVQVLANQASFQPSTTYTILSASSGVQGAFSQVNSNYAFLMPTLSYDPNHVYLRLVTNGTALPDVATTPNQRSVATAIGALGAGNTLYDKVLTTDAATARQAYSVLDGELQASLKSMLLLDSRYVRDAVTDRVRQGLAPGSGPLAALSSGGAALCGDNTAGVTDPTLAPERRIGSRDGCYGGTPYQPVVWGQAFGGRSRLAGDGNASTINRSMTGFIAGADMALNDKWRAGLAAGVTHSSLDNDQSSSAAVNSYYLSLYGGAQYGALGVRGGASYTWYRINTDRYPGFAGFSDHNSAGYNAHSAQVFGEVGYALPLGPVALEPFAGLAYVNLHTDGYTESGGAAALQAGGQTTHIGFSTLGLRAASQLGSIASGTFTARGTVGWRHAFGNVRPSSAFTFANGGTSFQVSGVPIARDSAVLEAGIDANITKRLTLGLTFSGQYGSGVRDNAVLGNILWKF

SEQ ID NO: 1545 - protein, 755 aa, Azoarcus sp.
MHCYPLARRPICAALFGVFGLSAAPAYADSSPQGANPPPAARVTASTRGDAALLDPVTVTATRTATATSRTAASVSVITDDDLEEQQATNIKDALRYEPGVTVRRTAYRPGSAALGGGRDGDSSINIRGLEGNRVLLMEDGIRLPNAFSFGPLEAGRGDYADLDTLKRIEILRGPASALYGSDGLTGAVNFITKDPRDLLSIYGKPTYFSFRPSYDSADRSVGATVSAAGGNDRVQGMIIADGRRGHEVDTRGSNNSASTLRTTSNPQDVYSESLLGKLTLTPTTRDTIKFTAETVQRRVSTDVLSAINRPATLGLSTHDRLERNRFSVDYDFRDDALRWFQTAHVQFYYQDAKQDQYAFETRGRTPSRSRDNQYQERAFGGSAFAESGFATGPLAHKLLYGVDGSLSRVTNLRDGTVPGVGEAFPNKAFPDTDYTLFGAFVQDRIGYGRLLVTPGLRFDTYRLSPSRNDPLFTGTAVSTSANEVSPRVAVLYEITPALIPYAQYAHGFRAPTPDQVNSSFSNPVYGYTSIGNPNLKPETSDTFEAGLRGKAGTGYGIVRYSAAAFTGRYRDFISRTTIAGSGRPVDPFVFQYVNFADARIHGLEGRAEWVMPNGLTLKTAMAFTRGSTRNDGAASQPLSTINPFSAVFGVRYEPGERWFVQTDLLFQAAKRDNDIDKSDCSNKACFAPPSSFVVDLRGGYRFNKHVSATIGIRNLFDRKYWNWSDVRGIAADSQVLDAYTSSGRTVAVSMKVDF

SEQ ID NO: 1546 - protein, 785 aa, Azoarcus sp.
MAGVRSRTVGKAAAMALVLAAGTAGPAWAQGQAAATARIEIPGGPLGAAIARLGQQAGVIVTVDPGLVRDRRTDGLSGTYAPAAALERMLAGTGLQAEPDGSGGFRIRPVPAAAPPAPPPAPRPAAASTPVPPPPTPIEEIVVVGTLTDVAIGPAEIERRQATDLADLFRRVPSVSVGGSLGIAQKIYVRGLEDSLLNVTVDGAPQRGTLFHHIGRVSIEPELLESVEVRAGAGEATSGFGAVGGAIRFRTRDAEDLLAPGQRLGALAKASYFTNDGHKLSGTLYGRLIGDIGFVGSVVRVDRNDMKDGGGDRLRGTAAEQRLAFLKLGGDIADGHRLSISYEQRDEEASFGQRPNWPVLEGAPLFPAEAQRRTAVANYQADLGPLRIETTGYWTESEFTQNRYDRWGLYGATIRSQGFDLRGRATPGDHSLVAGMEYRDDRVAGGYRGDPAVWGQWSWNPSVGRFVETGDVFGLYAQDHWRIIDPLLLSFGLRYDAYDMAQVTYGDGTDSDGISVNAGFTYDLPAGFSINAGFAEAFRGKEIGDAFTLEKRPGRISLSPTLKPERVDNYEAGLSYARDGWRGSAVYYHMRIDNVILDQLGSGPRPQDAVYYENVGRFKSDGVEIRAGYSHGPFTLDAYFNHYVSKLNGDEVEGYEHIALGNSVGDNWNISAGYTPVPGLELEAALTRFESLDGIEVLQRSVAIGWIGETQRVDKPGYTVVDLFARWQPFGDDRLTLLGAVYNLFDKRYRAHSSVADYTAIPGWEGIAGIYEPGRDIRLTAAVRF

SEQ ID NO: 1547 - protein, 358 aa, Azoarcus sp.
MKSTSNPSRFDVFFYAVSTSLLLATPVETFAFEAQEGEPFARFLEQPEVPRLSLDPVNASGLNQGLLNAFSERMGERHGPATPDTIASQWAQFFPGAPRIGAQAPAQLEAPSQQLMIGPDLFVREASDGSVHRAGIFMGHNNLQSSFNGMRPLLGDKQRDAVNLSGESLGVYWSMTHEQGWHVDAVAMGTRIDVNGRSQAGERVDDSGHAMTFSVEGGYPIGLGGGWVIEPQAQLINQQFFPGSQAQEETLQAFDSQPTWSGRVGAKLSARYEVSGMPIEPYVRTNVWHDFSNTDTVKLDQVDKISSARSATTVELGLGLVARVSPNVALFVSADYSSDVDDNDLNGLIGSLGIRMRW

SEQ ID NO: 1548 - protein, 352 aa, Azoarcus sp.
MQFKRRFKLAVLAAAALTAGAAQAQSSVTLYGQVDAWAGATKNFGQDRAWGVNSGGMSTSYWGMRGSEDLGNGLKAIFTLEAFFRPDTGKAGRFDGDHFFARNSFVGLESNTWGSVKLGRNTPPYFVSTILFNPFIDSYTFSPMVFHTYLGNGRTGAAGISGLVGDSGWDNSIMYSTPDMGGLTANLIYGAGEQAGHNGQNKWGGSLLYFRGNFAATAAFQQVRFDGAPGDLNSLVAGFARQTAGQLGATYDFGVVKLYGQYQYIKNTISTGDAKSNGGQLGVSIPVGPGSVLASYAYTKTTGAADVKRNTWAVGYDYSLSKRTDVYAAYFRDKVSDLSSADTFGVGVRAKF

SEQ ID NO: 1549 - protein, 791 aa, Azoarcus sp.
MKTPRLLLLITSLLCIQTAVWAQTQTIRGRVLDKQSKFPLVGATVAVLDTKPLLGAATDADGYFIIENVPLGRHIVRVSYLGYKEQTRPNVVVNAGKQTILNLALEEAITSTDEIVITAEKDKTRTNNEMALLSARGFTIEETSRYAGSRNDPSRMAQNFAGVSGANDSRNDIIIRGNSPTGLLWRLEGVDIPNPSHFGALGTTGGPVSMLNYNTLSNSDFLTGAFPAEYGNGISGVFDLQMRTGNNAKREYMAQLGFNGLELGAEGPFSKKSKTTYLVNYRYSTLAVFDALGISFGTGTAIPNYQDLSFKVDVPTKNAGRFSVFGVGGFSNIDLLASKTEFDPNDLFSQSANDIRQKTSMGVVGLTHLYFFNKNTYSQLNLAVSRSTEGTTIDSIYRNPNTKVVEALVYRGTRDFRQVKYTLREQINKKLNARNNVNIGVILDWYQLTMVDSFLVDGGSRFRRLRDFNGGSGLLRGYAQWQHRFNDQFTLNAGVHYQQFLLNNTYAIEPRLGLKYSFTPTQSVSIGAGLHSQLQPLQVYFRQEDGTGIRTNRDLEFTKSRHLVLAYDNSLTPNLRLKVEGYYQQLVDVPVDADYPHFSLANAGAGFGIPTLDNMTNGGTGRNYGVELTLEKFYSKGYYFLFTGSLFESKYKGYDGIERNTAFNGNFVTNGLLGKEWRVGKRNTLAIDLKVTYAGGRRFIPIDLEASRQQNDEVLLYDQAYEQKLDDYFRFDFKIGFKMNGKRITQEWFIDIQNVTNQQNVFTRSYNTTANDIQTTYQLGLFPLVQWRLLF

SEQ ID NO: 1550 - protein, 720 aa, Azoarcus sp.
MPRFSRLRTEPFALGLSTSLLLVPPALAETEEAALALPSQWVSARQDPAEADHIDLATPVDAGSRLGLSALDTPASTSSISGAEVRGRNNPSVQAAVTRSPGISFIGTPGDGGTGLSARGFSGHASVMQLFDGTRLYTGMGTVNFPSDPWMVERIDVIRGPASVLYGEGATGAVINVVPKKPFAGEIRNHLRLGYGSYDNRQLALDSGGSLTDSLSYRLNLNQQQSHGWIDRGDSRNLGISAALRWQASDDLAFTLAHDYGDQEPMNDFGTPLVGGKYHKRLREKNYNVRNDVQRYNDQWTRLTTDWSLSDSVSASNQLYYIKARRHWRNAETYEWDVPREELLRKDYLRISHEQEQIGDRQTFAFQHALFGLDSRTLIGAEYNRIRFRLTNNAPYEDVVDGGESIDPWHPAPGYFESRSPYRPHSRSQTRTFALFAENRLQLNERLSLVTGVRRDQNHIERADLRDGSRSDRSLQGGNWRAGLVFALTPELSLYGQYSTSEDGVSNLITLSPTQQQMDLTHSKQTEVGLKQLFPEGRGEWTLAAYHIVKKKLLSASPLPPHDAQQVGQQSSDGLEASLELNLAQDWRLSANAALVRAEYDDFDESINGQTYSRNGNRPRNVPRRTANLWLDKSFADTLRVGAGLRYVDRRYADAANQASLPGYTVVDANLGWRVRPDLTLGLELYNLFDRQYALADNNNGQQWIMGQPRSFNVTADFSF

SEQ ID NO: 1551 - protein, 337 aa, Azoarcus sp.
MNTEATHDQNEALTTGARLRNAREQLGLSQQAVAERLCLKVSTVRDIEEDKAPADLASTFLRGYIRSYARLVHIPEEELLPGLEKQAPLRAAKVAPMQSFSLGKRRKKRDGWLMTFTWLVLFVVIGLSGAWWWQDRKAQQEEITTMADQSSAELSSNSEQGQSVPLNTSTTTDPATTSTPPASVDTTATNTQTPAVTAPAPAVDPQQNAVVSPSQANVDTAATPAPTAATTPDGAAPLPTDQAGVTTPVADPNALVMNFTADCWLEVTDATGKKLFSGMQRKDGNLNLTGQAPYKLKIGAPAAVQIQYQGKPVDLSRFIRTNQVARLTLNAEQSPAQ

SEQ ID NO: 1552 - protein, 763 aa, Azoarcus sp.
MTKKGVLICCTLLCCLFFSDLKSQEQNTATVPLATVLSKIEAIFNVSFSYADHIVAPTYIKDISKGSTLTQALEYIENNTDLTFDFLNERFIVITENIINEVQELDQIYISNLLTTGISKSRSGITRIIPEQFGILPGIIEPDVLQTVQALPGIFSTEETVSDVNIRGGTNDQNLILWDGIKMYQSGHFFGLISAFNPYLTKRVEVIKNGTSARYGDGVSGTINIELDDKVATDYEGSVSANLLHLKGFATLPVSKKLTLSLSARRSNTDFIQSPTYTSYTDRIFQDTDLSINSDKESQVSDLNFYFYDVSTNLIYDISKKDKLKLSATTIYNKLGYDETIRALEINERSGINQSNNGVRLVYTRNWNKKHTTDVELYLSNYNLNARNFNLENGQQLDQENEVLDVGLKLQLSSKLSDTFIWNNGYQFTEVGARNLAQTNRPIFFSNERDVIRTHSLYSELSYLSPSKGTQFITGVRGNYLDTFNTLIMEPRVRFSQRFLSFLKISALGEFKSQSIFQIIDQPNDFLGLQRSRWIAANDDSFPILKSKQASVSLDYTKSKWLLSVEGYIKNVDGISSRSQGFQNQFQFTNAVGSYDVMGIDFLVNKQFQKFGTWLSYSFSKNNFDFESLNNGRRFPNNTDIRHSLTYGSTYTINDFKFSLGFNWRTGTPLTSPREENPIVDGQIIYDLPNSSVSDSFLRFDVSAIYKFELFSKNVQVGASIWNLLDNNNILNTYYLINSNDEIQKITVKSLGITPNFSLQYSF

SEQ ID NO: 1553 - protein, 714 aa, Azoarcus sp.
MTRPAFRTLQPQRLSIAVFAALCSVAPTAFADTTADPTTLDKVVVKGERAEGYSVRRTSAGTRFDLAPREIPQSVSIISHQRIEDQKLDDIIDVLANTTGVTSTQSDSERTEFYARGFYIDAYQFDGLPTQMVQNWSYGDSGLDLALYDRVEVVRGATGLLSGAGNPSASVNLIRKHADSAELTGSVSVNVGSWGRTRTTVDVGSALNASGTVRGRVIGSYLDTDGQMDRYNQRKTLGYAVIDADLTPDTQLSVGYDYQQKRANGATWGGFPMWYADGSPTNYPTSFNPSPDWTYWDTTSKRAFATLQHAFSNGWKFKIGATHDRTEADDKLFYPAYTAFNKTTGAGITPMAGFYNTERKVDGIDGYIDGPFQLFGREHQFMAGLSYNKREFANYGDFQPDSSDPEAQYLPLASYLGWTGDFPQPNWRPLKLASQGTITQKAGYAAARLSLADSLKLIIGARYTDWKSEDEGNDRSHKVTTPYAGLVYDINDTYSAYASYTEIFQPQTLRNKQRSYLDPVDGKSYEVGVKGAWFDNRLNASVAVFRIEQDNVGQATMDKVDGQLNETAYIAARGTVSRGFEFEVNGELAPGWNATFGASRYVAKDINGADINTELPQTALKLFTSYTPQSLQALTVGGGANWQNRIYYTAPVVGRFEQEGYALVSAFVRYRISPEFSVQANLNNLLDKKYYSQITGYGAYGDGRNGSLTFTWSF

SEQ ID NO: 1554 - protein, 356 aa, Azoarcus sp.
MQKKLIALAVAGLMSAPAFAQSNVTIYGLVDFGYVYTGDSARSGVKSRNAIDAGNSAGNRLGFKGTEDLGNGLKASFVYESAVRGDANDNGLWGSTGSRQSYVALSGNFGTVALGRQYAPQYTLASAVDAFSRGTVATIANVYIHESRLDNLAAYVSPNWSGFSFVTAYTNSAAGDEGIHNDFGNQSTSSDARAWAISPSYKNGPVYVALNVHQIRVNASDATTKVWDLGGTYDLGVVKLGAIYGVRDVSDSVKHKQWGLTAVVPVGAAGKIQASYLHRKSDWDAAISDAKVSQWGIGYQHELSKRTAIYTAFSDINNKGSAKDLGPGAGYIGTAQTSSISGNYQRGFTVGLRHSF

SEQ ID NO: 1555 - protein, 1919 aa, Azoarcus sp.
MQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDVTPPDDGGNVTPPDDSGDDDVTPPDDSGDDDVTPPDDSGDGDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSNISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVNVSGDNNAVDITGSVNISADYGQDDLAAGAPPLTGVVVGGNGNTVTLNGALNIDDNDLSATSGQYLDVVGLSVTGDDNDVEIDGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGDIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTVNGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGTTKAIINNGEINLLCDSGCDIYAPGTTGTQNDHNGTADIAIPDATTAPTEGSIPTPPEDPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDGSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGINGLATIGVKYSSNDTALHLDAYQWKEDSISDKGFMLNVKKTFR

SEQ ID NO: 1556 - protein, 857 aa, Azoarcus sp.
MTLRLRSLLSSTLFLLLNCIASVSLAATAVNDSYIVDPGDGQEKLVVTYNDTIDISTQEAINAAKITSVSALSNSSAGSVAIDTDDNLSVNFVPNPSFSGTVTFTYTLQDIRGASTATVTVDLTVEAGSLQALDDKYLAGREAITIFPLENDVKPSGNPSEFTIDTPEQGSLTQLSGISGLYKYTPPSDLTEPTDVVINYTVTYEGVGSSTATVTISVDPDSEPLLAGAKDEEQEQLAGVLQAACDANSAGIVRETDSTFEATCNALAALSDSERSDALEQILLRQIGAQAGAMKEAAASQVKSLGDRLSNLRNGSTGLSLIGLRTEVQGQNFSVGKLLGVTGTGGGAGDDDLMFADNRLGVFISGSLIFGDADAHGDQRAYDYDAQQLLAGVDYRFTNKLILGLSAGYTTTESEENNSVTKLETDTWNLAFYGNYYPRDNWYFDWIAGYGGVSIDSTRAVNFPGVTSTSKGDTDGDQWNAAMGTGINYQVQQWQVDAFLNIEYRTVNVDAYSESNDAGLGLDVMEYSTDLMTGTLGARVSQALSYDFGVLIPQLELAFVNELKNDPTEIEAQLSIFPEAGSFKLQTEEADKTYMNAGLSLTGVFKSGTSAYVRYGTDFARDNLSTDVWQAGVRMELGGPQAESGVFHTLEGQSIAPGIMVGTLGAGVSVTIPLHDLSWNMRGMINGFSHSVDRSLDDVDYDIDIDLESYGLIMDWHPFEGGFRVSGGLFSNRNEFTGTATPTENVEIGDFTFTPEQVGTLHAKIDYDRAISPYLGIGWGNAVAPTKGWGFNADLGVLFTDTAQAHLSADSPAADANPALKAQLESELAKEEDNINNDDLDNAKYWPVIAIGVTYQF

SEQ ID NO: 1557 - protein, 693 aa, Azoarcus sp.
MKFRLTSIATAIILSPAAFAADMEDIERLTVEGKYLSVNQSNSIKSPTPIIDVPQSLSIMTAEEITARGITSVGQIIDYTPGVNTSQGEGHRDSVVFRGVRSTADFYLDGNRDDVQYYRALYNIEQVEILRGPNALLFGRGGTGGILNRVSKKAKTGEQFVNYNVSANTFGAYNLQLDTNVDTGDKSALRINAMYESLDNHRDFFYGDRYGFNPTARFEVSDDTIVDLSYEYIDHERFIDRGVPTANGEPVEAFEDIVFGDPENNYQTLGADVFRANVEHTFSDNLKGNFNAFYGDYDKVYSNFYAAGYNADANQVTLDGYIDNTQRENLILSSNLVGEFTTGSIEHTVIFGGEVINTKSNQDRFNTVFDSTGGDRETFNISRPLSFRGLTGTNVDGVTVTADFSDLNDDTRVDLDVYSFYVQDEIALSKNLDLVVGARFDSFDIEVFNADPDVLETRSRKDEQVSPRAGIVYKPQENISIYASYSESFLPRSGEQYANINGDADALDPDTFTNQEIGIKWDFNDSMSFTAAIFENEQTSLDNDPNDVERFIEVDSDISGFEIQLQGYITDKWHITANYSNLDGENASGVALRELPENTMSVWTTYEVNDVFGFGIGATYQDESFVVTGEDSPVLPSYTRVDASAYYTLSDKTRLQLNVENLTDTLYFPNAQSTHQATVGAPINARLSLIGSF

SEQ ID NO: 1558 - protein, 382 aa, Azoarcus sp.
MAGGGACGDDQRPTLAALPCGWTLPATQETKRFGDTMKRKLLVPGAMLFACAGAYAQSAVWLSGYVDLNIEHLIQSGPASVTRMTSGGLNNSRFNLSGVEDLGGGYKAVFTIEPMFSADTGVQSAQFRQSFVGLKSADLGEVTMGRQFTPSYWIAGYADPSWAAAYSMVNNMEFFYASYRVDNAIQYKTPTFYGFTGRVMYAFGLEDTTRAGRFLSIGVDYRNGPLFLGAVSEQQYTRDIHQASQIPSSRDNYFSAVYRIGGFEPTAIFHTYKGYYAYPPYVAFNSSGWDAQIGARWNIDGRSRLYGSVVYRHDDNNKSITSATGFVIGYIYGLSKRTDLYATYAHVHNQNTVPIAYPVTFQSNPSPGQNPSGMQLGIRHAF

SEQ ID NO: 1559 - protein, 662 aa, Azoarcus sp.
MKRTHKTLRIPIGACLLSLLCASLPALGNEASAELAELPLDALLDMPVTGASRFVQRRSQAASAVTVITREEIRAFGYRTLSEALGGVRGVTVATDRTYDYLGVRGFLASGDFNTRVLLLIDGNRINDGLYDQAFIGGEFPLDLEAVERIEFVPGQGSAVYGANALFGVINVITRESSRDGSGRASVALGSAGERTLKAALNAPLPGGGLQLMASRRVSAGEPYFDAAQVGVGAGDGWSRGTDGEQRSAAYLRWDRGGLALSVLHAERLKGTPATVGLIYGDPRNSYRDSYSQVNLENVWTLDAATAVIARAYLGQYHFVGNYLLDYPPPTLNRDVGDGHWRGLEARITSTRADGHRLVAGVDAQVMNRLAQGNFDVDPAGTVYLDDARRARRTAIYLEDQMTLSPTWSLHLGARADQVSGMATQLNPRLGLIHQPGASWTFKAIHGRAFRPPNVYEAHYAVDTPAGYVGNPALDGERVRGDELIAEWRPQAAWRLSGSYYRNQTRRMLLLGYDAAADRYRFDNAGTQDLRGAEIELEHARGAARYRLNYSLSRPSRAGAGAAELGYPQHMLKGSAMLPLPHDWVVGLEFQAQSRRGAAPGAAQAHLALHGHWSAIGADLALGARNLFDRQLFDPGADALRQPVIAVPGRRWRVEASWPLGR

SEQ ID NO: 1560 - protein, 272 aa, Azoarcus sp.
MNPAPKNLLFSSLLFSSLLFSSLLFSSAAQAASEDSSRSPYYVQADLAYAAERITHDYPKPTGTDKDKISTVSDYFRNIRAHSIHPRVSVGYDFGGWRIAADYASYRKWNNNKYSVNIKKGRETQDNREELKTENQENGSFHAASSLGLSAIYDFKLNDKFDKFKPYIGARVAYGHVKHQVHSVETKTTIVTSKPTATSPQGGPIIQTDPSKPPYHESHSISSLGLGVIAGVGFDITPKLTLDTGYRYHNWGRLENTRFKTHEVSLGMRYHF

SEQ ID NO: 1561 - protein, 568 aa, Azoarcus sp.
MQNYWFANFHILGCLSVLSFVILNHATPSLAKTVESLTFEEKQATEDVPTLSPVVPTSITQLIHQIIPQESDATLQGQVTSVNQLDDVQPTDWAFQVLQSLISRYNILTGYPAQTFRGDVSRQAALHLRAMTRDEFALALNITLKQISEQIAQGTGSRISRDDLETLQRLQEEFSGELSTLQERVDGLAARTAKLEASQFSTTTTFSGIVVFGVTGGGFSGDRIVDVTGREIATKDPNLTFLYRATLDFTTSFNGTDALELWLEIGSNGADDNAAGLLEPSFGSVLDYSAKPPVEEFGVSRLNYTFSLSEDLTLSLGPVISLTDYVDLNRYANVSFLDFSTQALVNNYILFPVQGLGAGAAIRWNPNEGAFTARAAYVAASASRSKIESSSPVPGIFPLGYILYPNGRGEGGLFGDPYQGIIELEYAPSRMFALRLQYTSGSILGGNFDVFGANLELTLSDRFAVFGRYGYGSYADTAFGDLKPSYWMAGVAFLDLFIENALAGIAVGQPFIASEIGDSTQTNFEAFYNFPINDNIRVTPVFQVITNPANQSVNGTILTSTLRTVFSF

SEQ ID NO: 1562 - protein, 464 aa, Neisseria meningitidis serogroup C /
MTPSALKKTVLLLGTAFAAASAQASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADDAMAKQLWDANKLALLGYTPSEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 1563 - protein, 725 aa, Neisseria meningitidis serogroup C /
MTRFKYSLLFAALLPVYAQADVSVSDDPKPQESTELPTITVTADRTASSNDGYTVSGTHTPLGLPMTLREIPQSVSVITSQQMRDQNIKTLDRALLQATGTSRQIYGSDRAGYNYLFARGSRIANYQINGIPVADALADTGNANTAAYERVEVVRGVAGLLDGTGEPSATVNLVRKRLTRKPLFEVRAEAGNRKHFGLDADVSGSLNTEGTLRGRLVSTFGRGDSWRRRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYTRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 1564 - protein, 230 aa, Neisseria meningitidis serogroup C /
MGQDNIRNWVMNKTTVKILMGMALLSSLQAAEAELDEKSKKPKFADRNTFYLGVGYQLSAINTSFSTESVDKSYFMTGNGFGVVLGGKFVAKTQAVEHVGFRYGLFYDQTFSSHKSYISTYGLEFSGLWDAFNSPKMFLGLEFGLGIAGATYMPGGAMHGIIAQNLGKENSLFQLLVKVGFRFGFLHNEITFGLKFPVIPNKRTEIIDGLSTTTLWHRLPVAYFNYIYNF

SEQ ID NO: 1565 - protein, 1773 aa, Neisseria meningitidis serogroup C /
MKTKRFKINAISLSIFLAYALTPYSEAALVRDDVDYQIFRDFAENKGKFFVGATDLSVKNKQGQNIGNALSNVPMIDFSVADVNRRTLTVIDPQYAVSVKHVKGDEISYYGHHNGHLDVSNDENEYRSVAQNDYEPNKNWHHGNQGRLEDYNMARLNKFVTEVAPIAPTSAGGGVETYKDKNRFSEFVRVGAGTQFEYNSRYNMTELSRAYRYAIAGTPYQDVNVTSNLNQEGLIGFGDNSKHHSPEKLKEVLSQNALTNYAVLGDSGSPLFAYDKQEKRWVFLGAYDYWAGYQKNSWQEWNIYKKEFADEIKQRDNAGTIKGYGEHHWKTTGTNSHIGSTAVRLAGNERGANNGQNVTFENNGTLVLDQNINQGAGGLFFKGDYTVKGANNGITWLGAGIDVADGKKVVWQVKNPNGDRLAKIGKGTLEINGTGVNQGQLKVGDGTVILNQQADADKKVQAFSQVGIVSGRGTLVLNSPDQINPNNLYFGFRGGRLDANGNDLTFEHIRNVDEGARIVNHNTDRASTITLTGKSLITAPQNLSVYEIRNDYDDDDYYGYYSYRKPIPQGKDLYYKNYRYYALKSGGSVNAPMPENGQTENNDWILMGSTQEEAKKNAMNHKNNQRISGFSGFFGEENGKGHNGALNLNFNGKSAQNRFLLTGGTNLNGKISVTQGNVLLSGRPTPHARDFVNKSSAQKDAHFSKNNEVVFEDDWINRTFKATEITVNQSASFSSGRNVSNITANITATDNAKVNLGYKNGDEVCVRSDYTGYVTCNTGNLSDKALNSFGATKINGNVNLNQNAALVLGKAALWGQIQGQGNSRVSLNQHSKWHLTGDSQVHNLSLADSHIHLNNASDAQSANQYHTLKINHLSGNGHFHYLTHLAENLGDKVLVKESASGHYQLHVQDKTGEPNQEGLNLFDASSVRDRSHLSVSLANHHVDLGALRYTIKTENGITRLYNPYAENRRRVKPAPSPATNTASQAQTDSAQIAKPQNIVVAPPSPQANQAEEAKRQQAKAEQVKRQQAEAERKSAELAKQKAEAEREARELATRQKAEQERSSAELARRHEKEREAAELSAKQKVEAEREAQALAVRRKAEAEEAKRQAAELARRHEKEREAAELSAKQRVGEEERRQTAQSQPQRRKRRAAPQDYMAASQDRPKRRGHRSVQQNNVEIAQAQAELARRQQEERKAAELLAKQRAEAEREAQALAARRKAEAEEAKRQAAELAHRQEAERKAAELSANQKAAAEAQALAARQQKALARQQEEARKAAELAVKQKAETERKTAELAKQRAAAEAAKRQQEARQTAELARRQEAERQAAELSAKQKAETDREAAESAKRKAEEEEHRQAAQSQPQRRKRRAAPQDYMAASQNRPKRRGRRSTLPAPPSPSFDSSAYAAPRALHNPDWYENDYEEIPLDALEDENVSESVDTSDKQPQDNTELHEKVETVSLQPRAAQPRAQAATQPQAQAAAQADAVSTNTNSALSDAMASTQSILLDTGASLTRHIAQKSRADAEKNSVWMSNIGYGRDYASAQYRRFSSKRTQTQIGIDRSLSENMQIGGVLTYSDSQHTFDQASGKNTFVQANLYGKYYLNDAWYMAGDIGAGSLRSRLQTQQKANFNRTSIQTGLTLGNTLKINQFEIVPSAGIRYSRLSSADYKLGNDSVKVSSMSVKTLTAGLDFAYRFKVGNLTVKPLLSAAYFANYGKGGVNVGGNSFVYKADNQQQYSAGAALLYRNVTLNVNGSITKGKQLEKQKSGQIKIQIRF

SEQ ID NO: 1566 - protein, 764 aa, Neisseria meningitidis serogroup C /
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGEAGLRLSSGNLEKLTSAGINIGLGKNFVLHTEGLYRKSGDYAVPRYRNLKRLPDSHADSQTGSIGLSWVGEKGFIGAAYSDRRDRYGLPAHSHEYDDCHADIIWQKSLINKRYLQLYPHLLTEEDIDYDNPGLSCGFHDGDGAHAHTHNGKPWIDLRNKRYELRAEWKQPFPGFEALRVHLNRNDYHHDEKAGDAVENFFNNKTHNARIELRHQPIGRLKGSWGVQYLGQKSSALSAIPETVQQPMLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYEGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQDDQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 1567 - protein, 167 aa, Neisseria meningitidis serogroup C /
MGKANAADSPHVLGGSLGYGTQEFETKSGKYDAGDTFTSDLYYRYMLNDNFGVEAGYLTGSGGVASALVSVISEIKDLRFQGVRATAYGEYALSRGNSLYAKLGAAYTQVSYEMDKQEMDSDDVGFYGAVGWQYRFRSGFGLNLEYQYVPMKELELQGVNFGMSYRF

SEQ ID NO: 1568 - protein, 377 aa, Neisseria meningitidis serogroup C /
MRKKLTALVLSALPLAAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAA

SEQ ID NO: 1569 - protein, 651 aa, Neisseria meningitidis serogroup C /
MRSRWLLGVALAALAPAAHAAEAEVEALVVTAARLEETLPQELARYGADLSVIDAAVVRDNVYVDVSQALQMQTPGLFLSPRNGPFSYVDIAVQGSRTGDVLWLVDGVRISNRLYTSTSPADTLPASMVERIEVLKGGQSLFYGTQAVAGAINVVTRAYSEDFAGRLTAGGDTHGGVHADVYVRDTVGRHRFVAWASKDESDGYRTFDVFQPSATDRKRGYDVVSFGGKYGVDLGEGLSLNLYAQHTDAHLEYPNPRLTRLAFNDRDEEIASLSLDWTARDDVQLSVKGYYHDWDSVYSTVNNRPDGGIEIVDDLTYWGYEDYGVQALARLNLHRGLEYQLGYDFQNFRGRDDVLLIGEQTETVHAFVGQVRTTDELFDNARLAAGVRHDRTGGTDATVWNVSGRWDWAPGLYVEGMVGTAFILPSAEQLFGVDPCCAVGNPQLAPEKSRNANLSVGGEGARLSWKATAFAREVRDLIADAERPGFPEGIYVNTEGQVRFRGFELQGEAQLTGAIRARASYAHTRARAEGSGAQFDRVPKRQAKASLVYAPADRPFGASASLLWTGEVRSNASGFGRVNYGDYLVVDLAAHVYLDGVGGSRRLTARLENAFDEAYATRVASAFVDGSGSERFLYRFRGAPRTLHVSYSHSF

SEQ ID NO: 1570 - protein, 642 aa, Neisseria meningitidis serogroup C /
MAVDYVYDKTKLTDDEITRLKKLRDRNSEYWKEETYHIKSNNRVYPNIPALFPKHPFDPFENINNSKRISFYDKEYTEDYLVGFAQGLGVAKRNGETEKPIRQYFKECLNTGKYSDDTCKSQQSIPTVRSDIFALNTKIKNSHINSEILSVGNYIEWLRPTLNQLSSSQEHLYSDVDPFHYIEVTDNSHVIGQTISLDEFRLENSLWEPRWDSDVGELKTTNADIRFNTKSESLLVKEDYAGGARFRFAYGLKDKVPETPVLTFEKNITGTSDIIFENPIDDLKSLDGHQIIKVNGTADKHAFRLSGKHQKGIYTLSLQQRPEGFFTKVQERDDISIYAQQAQAANTLFALRLNDKNSDIFDRTLPRKGLWLRVIDGHSNQWVQGKTAPVESNRKGVQLGGEVFTWQNESNQLSVGLMSGQAEQRSTFRNPDTDNLTTGNVKGFGAGIYATWHQLQDKQTGAYADSWVQYQRFRHRINTEDATERFTSKGITASIEAGYNALLAEHFTKKGNRVRFYLQPQAQLTYLGVNGKFSDSENAHVNLLGSRQLQSRVGVQAKAQFSLYKNIAIEPFAAVNALYHNKPFGVEMDGERRMINNKTAIESQLGVAVKIKSHLTLQATFNRQTGKHHQAKQGALNLQWTF

SEQ ID NO: 1571 - protein, 937 aa, Neisseria meningitidis serogroup C /
MNKKHGFQLTLTALAVAAAFPSYAANPETAAPDAAQTQSLKEVTVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETHPHGDIADGVAYGINRLDAFRQTYGIKKPSEGGEYFLAEGESELKPVAKVAGNGNYLNNQLNRWVKERIEQNQPLSAEEEAMVREAQARHENLSAQAYTGGGRILPDPMDYRSGSWLAKLGYRFGGRHYVGGVFEDTKQRYDIRDMTEKQYYGTDEAKKFRDKSGVYDGDDFRDGLYFVPNIEEWKGDQKLIRGIGLKYSRTKFIDEHHRRRRMGLLYRYENEKYSDNWADKAVLSFDKQGVATDNNTLKLNCAVYPAVDKSCRASADKPYSYDSSDRFHYREQHNVLNASFEKSLKNKWTKHHLTLGFGYDASNAISRPEQLSHNAARISEYSDYTDKGDKYLLGKPEVVEGSVCGYIETLRSRKCVPRKINGSNIHISLNDRFSIGKYFDFSLGGRYDRKNFTTSEELVRSGRYVDRSWNSGIVFKPNRHFSLSYRASSGFRTPSFQELFGIDIYHDYPKGWQRPALKSEKAANREIGLQWKGDFGFLEISSFRNRYTDMIAVADHKTKLPNQAGQLTEIDIRDYYNAQNMSLQGVNILGKIDWNGVYGKLPEGLYTTLAYNRIKPKSVSNRPGLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSL

SEQ ID NO: 1572 - protein, 915 aa, Neisseria meningitidis serogroup C /
MQQQHLFRLNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVSLTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIRTGRHAGEIRAHEAAGRGVQSFNRLAPVDDGSKYAYFIVEEECKNGGHEKCKANPKKDVVGEDKRQTVSTRDYTGPNRFLADPLSYESRSWLFRPGFRFENKRHYIGGILERTQQTFDTRDMTVPAFLTKAVFDANQKQAGSLRGNGKYAGNHKYGGLFTSGENNAPVGAEYGTGVFYDETHTKSRYGLEYVYTNADKDTWADYARLSYDRQGIGLDNHFQQTHCSADGSDKYCRPSADKPFSYYKSDRVIYGESHKLLQAAFKKSFDTAKIRHNLSVNLGYDRFGSNLRHQDYYYQSANRAYSLKTPPQNNGKKTSPNGREKNPYWVSIGRGNVVTRQICLFGNNTYTDCTPRSINGKSYYAAVRDNVRLGRWADVGAGLRYDYRSTHSDDGSVSTGTHRTLSWNAGIVLKPADWLDLTYRTSTGFRLPSFAEMYGWRSGDKIKAVKIDPEKSFNKEAGIVFKGDFGNLEASWFNNAYRDLIVRGYEAQIKDGKEQVKGNPAYLNAQSARITGINILGKIDWNGVWDKLPEGWYSTFAYNRVRVRDIKKRADRTDIQSHLFDAIQPSRYVVGSGYDQPEGKWGVNGMLTYSKAKEITELLGSRALLNGNSRNTKATARRTRPWYIVDVSGYYTVKKHFTLRAGVYNLLNHRYVTWENVRQTAAGAVNQHKNVGVYNRYAAPGRNYTFSLEMKF

SEQ ID NO: 1573 - protein, 273 aa, Neisseria meningitidis serogroup C /
MNPAPKNLLFSSLLFSSLLFSSLLFSSAAQAASEDSSRSPYYVQADLAYAAERITHDYPKATGANNTSTVSDYFRNIRAHSIHPRVSVGYDFGDWRIAADYASYRKWNNNKYSVNTKEVSRNNSNGNDTWQELKTENQENGSFHAVSSLGLSAIYDFKLNDKFDKFKPYIGARVAYGHVKHQVHSVRKETTTVFSKPSGSATKPGQIPSLVTKPAYHESHSISSLGLGVIAGVGFDITPKLTLDTGYRYHNWGRLENTRFKTHEVSLGVRYRF

SEQ ID NO: 1574 - protein, 703 aa, Neisseria meningitidis serogroup C /
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGAVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNFTLNGDYTIGRFENHLTVGMDYSREHRNPTLGYSRAFTASIDPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSINTSSSAVFNADPEYTRQYETGVKSSWLDDRLSTTLSAYQIERFNIRYRPDEQNDPYTWAVGGKHRSRGVELSAIGQIIPKKLYLRGSLGVMQAKVVEDKENPDRVGIHLNNTSNVTGNLFFRYTPTENLYGEIGVTGTGKRYGYNSRNKEVTTLPGFARVDAMLGWNHKNVNITFAAANLLNQKYWRSDAMPGAPRTYTARVNYSF

SEQ ID NO: 1575 - protein, 1067 aa, Neisseria meningitidis serogroup C /
MRTTPTFPTKTFKPAAMALAVATTLSACLGGGGGTSAPDFNAGGTGIGSNSRATTAKSAAVSYAGIKNEMCKDRSMLCAGRDDVAVTDRDAKINAPPPNLHTGDFTNPNDAYKNLINLKPAIEAGYTGRGVEVGIVDTGESVGSISFPELYGRKEHGYNENYKNYTAYMRKEAPEDGGGKDIKASFDDEAVIETEAKPTDIRHVKEIGHIDVVSHIIGGRSVDGRPAGGIAPDATLHIMNTHDGTKNEIMSAAIRNAWVKLGERGVRIVNNSFGTTSRAGTADHFQIANSEEQYRQALLAYSGGDKTDEGIRLMQQSDYGNLSYHIRNKNMLFIFSASNDAQAQPNTLALLPFYEKDAQKGIITVAGVDRSGEKFNGSNHCGITAMWCLSAPYEASVRFTRTNPIQIAGTSFSAPIVTGTAALLLQKYPWMSNDNLRTTLLTTAQDIGAVGVDSKFGWGLLDAGKAMNGPASFPFGDFTADTKGTSDIAYSFRNDISGTGGLIKKGGSQLQLHGNNTYTGKTIIEGGSLVLYGNNKSDMRVETKGALIYNGAASGGSLNSDGIVYLADTDRSGANETVHIKGDLQLGGEGTLYTRLGKLLKVDGTAMTGGKLYMSARGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 1576 - protein, 810 aa, Neisseria meningitidis serogroup C /
MPIPFKPVLAAAAIAQAFPAFAADPAPQSAQTLNEITVTGTHKTQKLGEEKIRRKTLDKLLVNDEHDLVRYDPGISVVEGGRAGSNGFTIRGVDKDRVAINVDGLAQAESRSSEAFQELFGAYGNFNANRNTSEPENFSEVTITKGADSLKSGSGALGGAVNYQTKSASDYVSEDKPYHLGIKGGSVGKNSQKFSSITAAGRLFGLDALLVYTRRFGKETKNRSTEGDIEIKNDGYVYNPTDTGGPSKYLTYVATGVARSQPDPQEWVNKSTLFKLGYNFNDQNRIGWIFEDSRTDRFTNELSNLWTGTTTSAATGDYRHRQDVSYRRRSGVEYKNELEHGPWDSLKLRYDKQRIDMNTWTWDIPKNYDKRGINGEVYHSFRHIRQNTAQWTADFEKQLDFSKAVWAAQYGLGGGKGDNANSDYSYFAKLYDPKILASNQAKITMLIENRSKYKFAYWNNAFHLGGNDRFRLNAGIRYDKNSSSAKDDPKYTTAIRGQIPHLGSERAHAGFSYGTGFDWRFTKHLHLLAKYSTGFRAPTSDETWLLFPHPDFYLKANPNLKAEKAKNWELGLAGSGKAGNFKLSGFKTKYRDFIELTYMGVSSDDKNNPRYAPLSDGTALVSSPVWQNQNRSAAWVKGIEFNGTWNLDSIGLPKGLHTGLNVSYIKGKATQNNGKETPINALSPWTAVYSLGYDAPSKRWGINAYATRTAAKKPSDTVHSNDDLNNPWPYAKHSKAYTLFDLSAYLNIGKQVTLRAAAYNITNKQYYTWESLRSIREFGTVNRVDNKTHAGIQRFTSPGRSYNFTIEAKF

SEQ ID NO: 1577 - protein, 1457 aa, Neisseria meningitidis serogroup C /
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGNLSANGDTRYTVSHNATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHDAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAKKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 1578 - protein, 749 aa, Neisseria meningitidis serogroup C /
MNANDCRFQLHKIKFTQQHKPPRNGHVRQSLSHPQISMSKRQISGRRFPVLALSLCSIAGVASSPAPAAEFDDELPAVEVRSRRHPNDPRAESVSTATRTASDPRDVPQTIDSVPVEETLSYGGRTLADALAGVPGVSNTSDTRFDSFRIRGFSAAGDLLLDGMRDDAQYVRSLSNIERVEVLKGPAAALYGRGSGGGVINRITKQPLPENFGHLSAATGSYGRLGASVDLNRMLSSAWSVRLNAGREHAGSFRDHVDSTRQYVAPSIKWHDARRSWLLQFEYDAYRRVPDRGMPAPVAALDAAGKPFAFSLPSAPRATFFGAAGRDTIRDENMNWRSVFTHALDGDWELRHTLGVLNLRSTFDNTYVTQSYVAKPRDYRHVQRARYLQDMTHLNVQTGVELGGKVATGPALHHLLFGIEYGWQKRAPTLWQADAAPIPVTGPDRFALVGSTPRPYAMNRHRVSDYAIFAQDRVDLGRAWKLLGGLRGERFDVDSTNALNGLHARRTTAAWSPRLGVVWSPVGTHSLYASYSKNFAPVGGDLIGITPDARGNANDLGPQYTRQYEIGVKSDWRDGALSTTLALFQLDLYNRRIADPVRPGFFDLTGLERNRGLELGVAGRLAGDWFVRGGIGWQHARVVDAEPKYAGKRSAGVSASNGSLFVGHAPLRGFFAELGLVYEGARYADRDNLLELPAYVRWDGKAGYRTRDFEVTLAAVNLTDRDYYANATGLAQIMPGTPRTFTLTAAYKF

SEQ ID NO: 1579 - protein, 788 aa, Neisseria meningitidis serogroup C /
MFFNKNRQQTLLRFSAVTLPLFSFNAIAQFNDSATLDQIVVETQQVSAKTSSTNSQQISRGLVWNEQDLVRWQTGVTVTEGGRGGANGYTMRGVESDRVAMSVDGISAVESYMPRFYYIKGFYNGNRNSTEIENLSSVEFNKGANSLTQGSGALGGSVSMRTKNVHDFVDSNKTVGFYAKTAYSSRNTEYRQVIGGGFKQGNAEGLLQYTYRHAHENKNYYSGKLKDVAYCGILPSGDQRDIFPQLCGRSRVLPDNVDYHSRSWLAKLGYHFTPQHFVQVFFENLEQSRKILEKSFYASNRQEAGDITPYQRFGLSYNYTPTESWLNKFSVQLAQQKVSQQANSNQYGVSPQDYNIITDKRLYKTEQKHHQLDVSFIANEIAGKFAHHQLSGGLGYHWGKLENRNQEYGAYSRIKQREFTIQQPVARQAWYAYVQDLISINQKWGANAGIRFDHYRYKPTTSALKYESPNQKVEVLPKKQFSAVNFSLGLNYSITDSTLLSYEFSTGFKAPKIEEMYFDLKGEGSNHHLPNINLKPEKAQNHELSLTTEGDNYQLNLSVFYTKYRDFIDADTKTEVIDNGYKKHVYSLSKVIYQQINIDKAYVTGLDFHARANGKIIGLSKSWYAILKASYAKGRKNNGTAMLPIQPFSTTLGLGYQAENDKWNVLFSGRYVSAKKAKDAIDIPVAYSLKLKADRGTGKVSGFEQPKPYRFLSSSYVVFDLTAQYRLNSHFALNAGIFNLFNRKYTTWDTLRQIKYNGALGDVYNNGKGLERFTAAGRNFALSLEMKF

SEQ ID NO: 1580 - protein, 453 aa, Arthrobacter aurescens
MNRTLPLLPALALGVLLGLPASGQATCYRVTSVGSETTTSNTQIRPGEGTAGSWTGACDTCNGSLGLPSVVNVSDESFQPYPTLIASAVAPLTQYGATGGYDPERVFFRCSAGDAVYEMFSTNGDDLYSGYYTGADTVGNDIGLQDAYRTAWPNVLLRLTNVETGETITPIWKERQLSGLDIDSRGFQLVKAKNLAAVRAELYSAPLEAIRYYSPTILSQPYSYTQPAAYIAIKGPGLTAPTVGQAHVGGNWGGWYSNWPGAIGLYRYVTLKRYPTCAVMTVTPHVQFPSITLAEIDSGGVREAPFELTFKCQSGMTNGTGAGATALGIRVSSGALAASPALGLVNASGGLSYLLSDRYGEPGIARGVGIRIYRDGTPMTLLANENSAGGSNAEATGWYPAIGGATQANGGSGGIDLYRETFRARLEKLALGSQPGVTAGRVEATAQVVIRVQ

SEQ ID NO: 1581 - protein, 690 aa, Shewanella sp.
MLPYARGRKEDVSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 1582 - protein, 382 aa, Shewanella sp.
MCNKILYMSAISCFALLMNQAMADNLSVNGSLKLQYGINSKDFSRMSISANPNLTYSYDINDYVTIGSHVKLGTNLITNGANDATGSLNKNILDINSSTSSAYIFLKSPYGGNIQIGLTDPVAQSMKTSSIGSNGNFSQYISLKNDSRFPYGYNLDDTILVEPSIYSAYYGFSVPVISYYSPKIKGLEIGCSYIFKDKNGDVGYRNIFDIGVKYENNLFSDINYSISGTIEHAVKALSSDNVKFNDLLAYSTGISVKYKNFTFAGSYGNLGKSGKEEITISNTSGSNDTKKFKVISSHFYDLGIKFETNIFNVSANYFYSSKKNSIDNKEDNHSLSVYTLGLEKVLDDKLSFYADIIYFTVDRPTLSNNSGYLTLIGAKLSF

SEQ ID NO: 1583 - protein, 723 aa, Shewanella sp.
MTFKSSLVALAILTALTQSAAAQDASDNSNKDQEIEKITVTASRMDKSPSAIPNTVTIIDRLQLEEQFRTTKDLSTIIGNLAPSFSPSRQKMSNTGETLRGRPPLIMIDGVPQSNPLRSGGREGQTIDPAMIERIEIIHGANAMHGLGAQGGIINYITKKPSGHNEHVVSFDVTVPDSMKSNGMSFGTSYAFSGESELVDMLGSVSYRNNGVYYDANHDLVGVDTTQGESMDSQSADFFIKLGHNFAESRIELMVNHYNMDNNGDWMPIAGDKPNGVPTGAIKQNQPWEAANNQVTTTSLTYTHENIAGQQLNLQLFNQDFKAVYGGGCFESFYDPAFEGSDQVIQCGVGSKGESLYYDQSRNSSVKWGLKSALIAKDIAGSGIDAAYGIDLFRDTTEQDLVKTGFSWVPESTYDNIAPYLQLDYDLIKNLTLSTGIRYEHAELSVDDYKTLWGAGNKQIAGGEASFNETLLNIGISYKITPDIRIYTSYNEGFGMPDIGRILRDGKSFPGANPSISDSLALTPIVTDNVEVGADYQGKYLRAKISYYRSATDFGSRLALNSDGFYDVKREKSVIDGIEANVTAYLTSNDDLGMNIAIQQGEYDSNGDNKVDTDLDGANIAPNRINLYWTHNFDNEMSTRVQANYFMDRDFKNAAGTQYAEFDGYTTVDASFSMPLYTGTLSLGLQNLLNKDYFNYYSQTMGTNDRYFKGMGRTATIGYTLPF

SEQ ID NO: 1584 - protein, 182 aa, Shewanella sp.
MILYVMSGSRLADNHTLSAGYAQSKVQDFKNIKGVNLQYRYEWDSPVSVVGSFSYMKGDWADSHRDEADDFYRHQADIKYYSFLAGPAYRLNDYISFYGLVGISHTKAKGDYEWRNSVGADESDGYLSESVSKKSTDFAYAAGVIINPWGNMSVNVGYEGTKADIYGKHSVNGFTVGVGYRF

SEQ ID NO: 1585 - protein, 301 aa, Shewanella sp.
MLLSPSVRYDHYDTSSKTVKYKDNHLSPATKLTWKVTNWLDFSAKYNEAFRAPSMQERFVSGTHFGTDVGKYLVNKFVANPNLRPETAKNKEITANLHFDSLFKQGDKFKIEATYFRNDVKDFINLKIFNDANANANANPNAKTNTNGALLPTKSQYQNITNARLSGVELQAQYQTERLTLFTNYGSTKGRDKDSGEALSNIAASKIGVGADYALVKDKFTVGATITHYAAQRRVPKDHAVTYPSYILTDLRATYAPLKGEWKNLRLDFALENLFDRKYQPAFSLMEGTGRNAKISAVYSF

SEQ ID NO: 1586 - protein, 456 aa, Shewanella sp.
MMNKRIISLAVIGVLLGCVSHVQAAGFQLAEYSATGQGRAFAGEAAMADNASTQARNPAMLTYLEGTSFSAGGIYVMPNVDVTGDISIASPLFGSQAMTMNADAIDVADNAVVPNFYFSYQINDSWTWGMAVNSNYGLTTELPADHAAAIFGSETSVTTVEFNPNIAYKINQAFSVGAGLRIVYGEGSIGASAPGWIDGLKAHPSLPADVAAALPAGGASLKSMEGDDIAMGWKVGASWQINPAHRLGFAYHSGVELELDGAVSGLLYIGGQDVDIGAQLPLELPAFAELASYHQLSENWAMHASVNWTQWSVFDELVAYFPGEVKPIDSSDGKSMESDLVKEENFKDNWRFALGSTYQLNNQWLLRTGIAYDNTAVDDEYRTMTIPDSDRLWLSVGAGYQAFENLTVDFAVTYIKAYGDAPINESMNLMDLAQVSFDGEAVGDVWLVGMQLSYKL

SEQ ID NO: 1587 - protein, 694 aa, Shewanella sp.
MKPTYLATILAILLSPQLVVAEEVDSAETANIERMSVIGVRQRLEQAGTLANTIMKTEVINATTIENKNAVNLSEAIDNSPGVKVSNECSMCGVKRIMLNGMKGEQTTILVDGLPVHTMISGYYAVDAIPTTGIERIEVARGAGASLIAPEAIGGTINIISYEPTENGAELDVSAGENGYRKMGFLGKGVSEDGRTRATLVAQYDDRDQFDADHNKVNEAPQQENRSLTARVSQDVTDTDNLVLRIANIQSEIFGGPMLGGTFVDGTASSIGNVLSGFDDQFSEPQQLFEDGDVRKPFTGKAWETTEWIKTERNEASLAWLKEFSDDWNMHLAASYAEHKQDSFYEGFDYTAEDKMWFFDARFNYLLTENQLLTFGADLRTEEMRSHSRAGSANPNYASDSFDYDVKGVYIQDTWQATEALEIAMALRYDTITADFTDPNKPGTELDESILSPRLDVRLRHNDEWTSRVSAGRGYRAPLSFFETDHGILDGSLGFDIDIDELERSNSASYALSYEGEKLTFTASIAWTEVEHLAALTTNDLGIPLLTQLDEKATVITSDIALGYRLTDDMTLSLTAEHFDYDSVFKSSYAIAPIEERLTLTFDWDVNDWEFFANVVWVGSRDLSKYGYEGYNRLDANGQVDPDSKKTTDAPSYLTVDLRVSYQLNEYLSLYSGVSNLFDYTQAGDEETPLFLRC

SEQ ID NO: 1588 - protein, 653 aa, Shewanella sp.
MGTNPTKIALLIGSLCSFSIIAPALAADDTHTARVDEHLVVIGRTDNTPLNIAANVNVIDAAAIEMSGATSLTDVLRGRSGIQISDNNIGTSFAMRGFSASTAVNNTLILLDGRRLNNIDIAAPSLNAIPLNLVERIEILSGSAGVLYGDQAVGGVINIVTKSPENTSGSVQLSGGSFDTYEGRGDISGAINKDWRYFFTGSYNQGDNYRKHNANETGSILGRIQYKTDTDAFFVETSYYDDDRENPGSLTKDQFKQNPRQSSNKSEYVHEMTTAARSGYEHQLNPNWALAADLDYSDTLVTSLNWGAGSHNTRSLLMFSPKALANYTTRQGELNLVAGLDLSRGKADYNTMARSNVQEMQSAYVQATVPLSHSLSYVVGGRYARVTDELVDGNVYPNGIDLDEDATAFEFGLNYRPSAEHRFYLRGDENFRFAKVDEQAYTPKDVYGLKPQTGRSYEAGWDWTVASQSLRVSLYRLDLEDEIVFDPSAEKPVGGSFQGANVNADASLRYGASADWDWQITQALQLGLEYNYIDAEFTDGVNDGKALSWVAKHTGRGYISMDFAEHFQVFAEAIYTGNRFIEGDNANEGDKLASYVLGNLALNYNRDAWLASLRVDNLFDKEYVSSGYYGGGLWDSYYSGRGRDIRLTLGYRF

SEQ ID NO: 1589 - protein, 769 aa, Shewanella sp.
MTYKTPARSLAALLLCSCAATPFAALAQTNETDEEQTQQRTSSLDSIGNIVVTGTKTRDPEDVQDVALAVTAFNEDTLEAFKVRDVQGLTFQAPNVSLDQIGTSRGTANFSIRGLGINSSIPSIDPTVGVFVDGVYLGINGGVVFDIFDLESVEILRGPQGVLFGRNVTGGAVLINTTSPTEDFRGKFRAAVDGPVDGGRGGENYTASGVLSGPIIEDKLLFKVAGYYNNDRGYFENQFDGSNFGQAETYIVRGALEARLGDLTLTGKVDYFDSTGDGPAAQNRGIFERDSFDFAIDNAGSYSTEILTTSLTAELDIGPGTLTNIFGYRDYSAETDADIDATTLFLFHSNTETEQDQISNEIRYAVSTDNFDLTVGGFYFDQTLAYTEVRDIPVSTPLSFFGGGRQEHEVLGVFANGQFYLTDSFSVIGGIRWSQETKDADVTYVRPRPACSVVDQTCPTTGVNPFIPTENNGFSDRVRFRNVSPKLGVQYEFANSQVYGHWTRGFRSGGYNFRITNANAFEAIVAQPGFNFFFGEEQVDNFEIGGKFQTEDGAFTLNVAAYITKIEDMQREVNQSDPVSGVAQSIFNTADATITGFEAEARMRVSDNLLFTANIGIIDDEYDEILFDISGDGVINDTDLDLRLPRVPEVTWGVGLLHELFLGDSEVITRVNYQYRDEFAYTDDNRGFVQDISNLEANITWNTPMDGLSFSIYGRNLFDEVQVGGDTQIPFGGPLSNGINRPFDPLPGAGTFSPLQRGRNIGVEAVFEF

SEQ ID NO: 1590 - protein, 279 aa, Shewanella sp.
MKNVKTLALAATAVAAISGNAFAADRTDLHGSDYKWMQFNAMYSIGEKPDNPASGDQHNYLEMEFGGRSGIFDLYGYVDVFNLANESSKDGDKNPGSGTSKLFMKFAPRVSIDALTGKDLSFGPIQEVYFSTLFNWDGLNGEGVNSTFWGVGADVNVPWLGKTGMNLYGYYDMNAKEWNGYQFSANWFKPFYFFDNKSFLSFQGYIDYQFGADEDKTAFVPKTSNGGNIFFGLYWHSDRYALGYGLKGFKDVYLLEDGAGALALESTGWSHYLSATYKF

SEQ ID NO: 1591 - protein, 445 aa, Shewanella sp.
MIKIERIIMKTFNKTLIAVSVALASTQTLAAGFQLNSQSATGIGRAFSGDAVIADNASVLSRNPAAMALFDKDALSVGLTYVDITVDVKDVNFAGGAIDLGSIDDAGSTKLIPNLFYIHPINDKFAVGFAVFSNFGTGTDASSLSKNEPLAPFDLLGKTEVTTVNFNTSVSYRINDMFSIGAGLDGVYGEGRLTRDAGTTPIVDVDADGWALGGIVGATIELNKENRFGLSYRFSPTVNVKGDVNTISTKDLSALGLGAQTKLATSFDSLDVPLADIFQFAGFHQLTPKFALHYTAQFTKWGDFHQITAKDGVATILPGQAGAGMSINAGDIALKEYQWKDSWLMSLGGTYTINDQFTVRAGYMHDQGVVDEISSISIPDSDRNWFTAGMSYHVNSQNTVDFGIAYVKGEEVHLIENSAITGIGPVNAITESSGMYYSVQYSYQF

SEQ ID NO: 1592 - protein, 359 aa, Shewanella sp.
MKKTLLALAVVASATSVNAAEVFKSEEGSVDFYGQLRPTLLFTEKTDHTAELNTSSSRTGVNAVYVVDESLKVLGEVEIGVALGDNYDAGADSSERTDDSVYVRRHIIGFDMGDMGTLRFGKEGTWADDVYFADYSYFFGGNAAETAYGHAWNNDSQIKYAYENDAFWLKAGYALGEKDSNEEVLEVFVGKSFNDLSLHAGVLTANNDINVTKEKKLVLNGVEQTVSHTERTDNENLSFEVTAEYALNEHTLGATYYYNENEDKLGKSTVDSHYIVVAGMFAVAPKTTLYSGYEYLAQSTDEAGKVDADSSWFYAGVEYKFSKWARVFAEAGYTFEGTDFDNKDTDDATNFGVGARFYW

SEQ ID NO: 1593 - protein, 438 aa, Shewanella sp.
MKTFNKTLIAVSVALASTQTLASGFQLNSQSATGMGRAFAGDAVIADNASVLSRNPAAMALFDKDAISFGLTYADITVDVKDVNFAGGAVDLGSIDDAGSSKIIPNIFYIHPIDDKFAVGFAAFSNFGTGTDASSLSKSLPANSPAPYDLLGETEVTTVNFNASLSYRINEIFSIGAGVDAIYGEGRLTRNMGTTPLVDVDADGWAFGGIVGATIELDKDNRFGISYRFSPTVNVKGDINTISTKDLSAVGLGSKTTLATSFDSLDVPLADIFQVAGFHQLTTKFAVHYTAQYTQWGNFDQITAKDGVATIIPGQAGAGTQLQAGDVALKEYQWKDSWLFSLGGTYTINEQFTVRAGYMHDQGVVDEISSISFPDSDRNWYTAGMSYHINPQNTVDFGIAYIKGEKVHLIENSAIAGPVNAITESSGMYYSVQYSYQF

SEQ ID NO: 1594 - protein, 924 aa, Shewanella sp.
MRANSTLAKAVRFALIGGATTAALSTSAVFAAEDGAKVERIAVTGSRIQRTNLETSTPITMFSAADIEKTGFSTVSEFLRTNAASGGFNESSTLSQAAGASSIGVKGFGSDYTLILLNGRRIAKNTAGGIFTDVNQVPMAAVERIDILNDGASAIYGSDAVAGVINIITKKEFDGVALSAKYGGATNKWDGNELSASIVTGTSNEKTSILFSAEHFARDVIQASDREFGRTALIEGHEGGDGRSTWGIPGFTSISSAKGFTNAATDEGSKPWSNCPAGDVLSSGRCAYDFAHLYQLQPESERQSIFTTINHEMNDDLTFNGQFRYTRAYTKTSNAPAPGQVDVSNSPFLADFLRNDRYKDDQAKAEEIIRLVEAGEANVSVGRRYLDFGNREKDNTNETFEAVGGANYNIDDNWGLNFDIGFSRLTNRQIGSSGQLLSEEVANAFNDPKSKLNPFVINDCSSKDLSDTCRDLQVAIHRTGEYTVSFSSLVLSGLLPGIELPGGEIGLATGLDMREEKYTDRSDPATVGGQVIGGAGSNGGGQFSNLAGFIELSLPVLDNLEVSLAARQDKADWELADASDTTYSAKLSYRPIDDLLLRASYGTGFKAPNLSDLFLAESSGVTRAIDTKLCNAAGNVQNHPDCQRQELNSKSGGNPDLTPEKSKSYNLGAVYQFTDNLSLSVDFWSLKIDDVVGSLAIQEILDEEAKGNLTNLVVRNSEGRLTDSNRDGYVQTNKQNLTEQSATGLNYDLQYSSEFSFGTLKSSLQAEQFLSYKTQSSAVQPLCDDIADNSMRDYRINGSISLEQNDFVTSLNMRYLPGYEMYDKRNTGNKSCQLVGYYDVGKATDVDANGDLVNPGRSQHVAAYVQFDLTTAYYFADDNKVTLGVRNLLDRQPSFSAPNNWPFYDQGVYDNIGRFVYLQYDVKF

SEQ ID NO: 1595 - protein, 686 aa, Shewanella sp.
MMYHEKEHTEKSNFVGIFGALFFGAIALTGTDAIAAEEKNPQSAQKGNTKASSSEEDVLVVTGEKVNRSIYDSGSSVEVYNLRKMKSIPNPDVNMLLQMTPNVVDNGISNALPAVRGVDGSGPSQGGMAFISGTRPRINVSIDGRSFTYNELAFGTQSLWDIESVEVFRDPQSYIQGRNAIAGAVIIKSLDPTFYWESAIKSGFANQGYQQVAAMASGPLIDEQLAFRLSVDRQNRDSFANLVSYDPVGDPHKIESTTVRAKLLFEPLSIPELSTKLTVNHLDSRAPQNEAYNPRDTLNLRHELFRPVVERKTTSGIWDISWALSDTISLENKLIYTDLAYHRLTSSKIPKADTDGKELEVEPIIRFQGFDNKLNGLVGVRYFHGKQDETINLFGGSKFDDKTETASAYTVLTYTVVPEIDVTLSSRFEREHRTRKGGSESVAIDFDKTYNAFLPKIDVAWKPQKDQTVGIAVGRGYNAGGAGVTFGKPVISYTYDPEYVWNYSLYTRNSLLDGKLELTSNLFYNDYKDMQLPYYLSLDSTMIRNANKVETYGAEVGARWLPVEKLELNANIGLLKTKIKSFAESGVQGNELPRAPGYTANLLAKYLLTEDIDVSGNVMFSDTYYSQYDNSARGKIPAYWIANLQLGYNFKWGRATLFAQNLFDSDKRLLVPDNNVNSIILSASRE

SEQ ID NO: 1596 - protein, 939 aa, Shewanella sp.
MFKQTYLASAIILALTSQATFAANNDIAPQDQVEVESTTQEETQADNPRPNEEAMEIIQIQGIRGSLNKAVELKRQNIQVVDAIVAEDIGKFPDNNVVEALQRVTGVQVTDRAGGEANVVSIRGLTDVTTTVNGRQIFTATGRSVAIADVPAALLGSVEVFKTRSSAQVASGIAGQIDIRTHRPFDFEDSKVSFAAKGIYSDQPDKIDPNFSALASDRWDTSIGDIGALVNVSYIRTNYKDETVSPGASFPYFVEDGTRITSGWTQGLAHGIDTSAGATIDGKEYLLARDAMFGNTVEGERERPAFNISLQWAPNDTSEYTFEAFYNGFRNESFNSMLFSTVDSSANWQQVIADGVEVYDGTNVVKSRTAYNAYNFTSGDHSKASTDSYMFALGGKWDITDEFQLKSEVVFQQSQYENEFTAMRGQATVYGVVIDANADDGIPSWAYLDNPDTTVDESDMTNPDLWETADFYDNASKDEGDSLSWTMDGSLYVDFSIFTKMQFGTRYEQRGATNSNRTASGAKKIAFNDLDPSMITTTSGFFDGRANVPDSWAVINGYNLYNNRSQYEALWEFTADQLLMQKTFDIDEDSWAAYVMADFDTELFGKRLDGQIGVRYEASNSDMTFFNKDAEDEKGNKYTAITTDSMNTSKLLPSLVMRYWLTDDLLARFAYTETIRQPDFTDLNSFTYYTPDLTKVGNGNANSGTPNLDPVTSENYDLTLEYYFGNGNSIYGTYFRRDIEGLVYNSLSKIFYDYDRDGVDEPFILSRPGNTSNGKLTGFELGAVYFPDDLPSFLDGLGTQVSATLLDSSQDIPEFDISSGEQIGVTTRDMFGVSDESYSAVLIYDKEYFSARMSYTWRSEFLNSYDSPSFAMPRGIYRKPEQSLDFQLSYNITDDLVLSFDATNLLDDVYQEYYEDSVLFNRTNSIYTRTFALGVRYSF

SEQ ID NO: 1597 - protein, 147 aa, Shewanella sp.
STDQLRGARVGYRVTDIRLSILEDWTWLGGPKLHIEGALNNWQNSNDRSDNVFALTISPVLAWQLTDGPRPLYVEAGIGGSYLDGTRLGDRRLSTRFQFEDRIGLSWQYSAYSNARLTLAYVHYSNAGIDSPNDGLDFFGLTWSNTF

SEQ ID NO: 1598 - protein, 853 aa, Shewanella sp.
MIKRTKVASAINLAVVSSIAAGTFVASSAFAAEETAKVERIEVTGSRIQRQDMETASPVTVIDAAAIKAEGFTSVDQMLQVQTSMAGAAVGSTTNNGADGVAQVDLRGMGSQRTLVLLNGRRMVNSGSGADSAVDLNSIPVAMIARVEILKDGASAVYGSDAIAGVVNIITKKDFDGFQLDFNGSGTDKGDGENGDISALYGFNTEGGNYTFGAAYSDRRGVVQGDRDWYDPLDNTSSIIPTGALNQKVIDANGNWVKRTSTYDYSNDVYFQTPSERRSLFANMTQELGNDVVLTADAIYTNRRSNQQLAAQPAQIKLNVCGDPRVTDPTAGCLTLDQGMIDAGIEADARGQVQYNRRMKDVGPRIYNQDTDTWRLSAGLAGSLDVHTGMNWNVDYTFGKNEAKTGVANSINATLMANSIYADPYAWFEGSPLTDEMKDVSYDQQETGGNEQQTLSAGLNGELFDLSAGAVGFAIGAEYRRESGFYNPDAIVVAGDSTAAQQDPTSGNYNVISIFQEVSVPFTEKLTGEFALRLDDYSTFGKATTWKIGLTYTATDELMVRTVAATGFRAPSVAELYGGNSGSFDYLTNPWLPMSDQTGQILVNRTSDPDLKPEESESYTAGLVYSPSYIDGMSITLDYWRFKVTDAIARADVQVGLDACHGGDTEACSTFNITADGDLFNLTSALTNVGSQDTSGVDFNLAYNFELLGLDWKVSNDTTYLIKFEQDGENYTGTIDGNTGAYARVRNNFSISAGQDDWSVMYFNRYIRSMDDVYTDYDANDNPFVAVRGVDSILYHNISGTYHVNDSTTVSLGVKNFTDEKPLYVTNGSDAGTVPEVYDTIGRTIYGGVTVKF

SEQ ID NO: 1599 - protein, 606 aa, Shewanella sp.
MQKSLLAIAMASLLTPVSYLHAQEVQTNDTVVVTANRFEQPLAEVIASTTVISKQEIEETQAKSLLDVLKRVPGIEVSQSGGRGHSASVFIRGFNSNQVLFLVDGVRINSAAGGISFNHIPVGIIERVEVIKGPGGALYGSDAIAGVINVITTSSESSEGSVVSLGAGSDAQKEANFSTTRAFANGGVLKLAGGFEETEGFDIKDPETGLNYGYESQNLFASYSQAFNDEFSGSASVRWYDSLTEYDSGGKNYGYSENLSITADVQYSGSRLSSTLRANQQAIENLDYSQAEGKDNAGTVKKIALTNLQFLNQYLISEGITIGAGADWRKEKLDDDALSYGYPDKLAGESRSTTGVYLSTDLQLGDLQVTGSVRNDKHDTYDNYRTWSLGTRYQITESHSVRATFGTSFKAPSYSDLTNNPDLKPEEAMSREIGYTGEFALFTVDVAAYDNDVDNLIIWYEGSPWWYPENVDATLKGLEITGYFNTWFVHHTVVAEFKDHQDSGGNKLAKRADENYKWLMDASYENFDVNLTYTYTGERLGNPKEVSDPKNELPSVSLWDASVGYWISPDLVVRARVDNLTNEKYQTTLSYNAPERRYFANLTYQF

SEQ ID NO: 1600 - protein, 661 aa, Shewanella sp.
MFTLQRLCKSRINCPSLPRFAPSVLSCAVAIGLSLSTTLVNAAETTSVNPDMERIVVTATQTKHSELSAPASVSVINRAELDALVIDDLASAVRYLQGVNISEGTSYGRNEISLRGLDSDYTLILINGRRINSREALTSSYGNDFDLSSIPMSAIERIEVVRGPMSSLYGSEALGGVINVILRQPTDDWQTSVGVQYDTPTKGDGGDTTKYNFYTSGALIKDKLLANLIVDSSKRDAWRSDLKPKLDALEDRDEISAIANLQWLIDSNQDLQFDLSYADDERESDWNNYGAILTNYQQAERISSGLTHNGHWNWGDTRLRYYYENVEVTDNSALIAEIGNITQTNHNLDGQSTVLLGDHMLTGGAEYRWTKLENSRNVLGDGVLDDNQSALYLQDEFNLGELNITLGGRVDHHDVYGTEFSPRLYLVYNLSSEWVIKGGGGKAFKAPNMSQSQADYIISSCRGSCTLAGNPELEPETSVNYELSTQYQTTDIGGSITYFHNDVENKIITETWNRVPGAVLTYQNVNEAKITGWELQAWYDLTDDLSLSGNYSKTDAKDKQNGTPFTLTPEDSYNIKLQWQALDGLSTFVAYHYTGEQYLRANVKSDGYGSLDIGANYQINPMFRLKLGVTNLTDSERDNAATDLDYIQKSRSVYAGITASF

SEQ ID NO: 1601 - protein, 782 aa, Shewanella sp.
MNSLFKIYLFLCLFLIQISAQAQEISQTVRGKIVDQVSKSPLIGASIMILNTDPLIGGVTNELGEFKLQNVPLGQHSLRVSYVGYQESILPNVQVNSGKEVVLEVFMEEDITQIQEFVVTATEKDRTINDMVVVSGRTFSVEETKKFAAAVNDPGRMAASFSGVVSTDDGNNNISIRGNSPNGLLWRMEGIEIPNPNHFINPGSSGGGVSILSAQLLSNSDFLTGAFPAEYGNALSGVFDLNLRKGNNENQEYTFQAGFLGIDVAAEGPIAKNYRGSYLVNYRYSTLSLLSKLGLPLGDFATNFQDLSFNIYLPTSAKSSFSIFGFGGLSDQDSEAESDSLKWESDGDRYSSNFLSNTGAIGLKHSLTVNKSNFLQSTILFSGNTIEFNEFRLNQEIVNENRYQEQFGNSKITLSTVLNSKLSARSSLRTGIYLNQLYYNLYQNNYDEDQGIMVREIDSKGNTQSIQAFSQWNYKANDRLTLNVGLHYLELLLNHSRSIEPRLSASYELDEVQRINFGYGLHSQIQPLGTYLAEQEVNGTILLPNENLDFSKSHHFVLGYDRSLNPFLRLKLEAYYQHLFQIPIKEGVDETYSIINQQWTFATDPLINEGFGKNYGVELTLEQFTNNNMYFLLSTSLYNSLYKTQENVWRNTRYNGNLNVTFTGGKEFALKKNRALGINLRAIYGGGFRTNPILLDESIEAEETVFDENRAFEEQNPAYFRTDLRISLKKNKPKSTRTWALDIQNATNRKNVYGSYYDPTEGEIMTSYLTPLIPILSYRVEF

SEQ ID NO: 1602 - protein, 903 aa, Shewanella sp.
MFNRSKVALLRRASLLALSAVAISGVAHAADVVTDDQDAVSGVVVTARRPLAESQAAAMQIQKNSDSLISVLSADAIGDLPDQNIAFAVGRLPGVAIERDQGQARYVNLRGAPVYWTTLSFDGLSVVSPEGRATRFDNIPSAIASLITVEKAIVPSMPGDTVAGNVDIRTRRAFDYKGQKLTGKLGVGRVKLGGGDELDSNLVYSNVFGDKLGIVAQASYYSREMATDNWETDPYLSNTVAPEKRFAREHENKHYRLTRRNVSASIRADYKFDDNNSIFVSTINTYYNDDELRDNFIFRLDQGTDAAGNGYTSTAYINGNNPVSGTVFGARINARIDYRNTKEGMSTNTVGGEHKWDKLSASWRLNYTYTQDGRDTPVTMAFQSPSTFSLRPTVEYDFRNGDVNTVRLFQTGGLTAARTKGAQVTNIEDFQFPLTSAGMLKGGDFTGAYTAKADFDYESELFGRETKFEFGGLWTSRTKKSRESSFTRAYSGTGVPAWGQFATNIEYLGSQNLNYTFRYTNKDYTTNFVEDLVKTGQATRNDTRANYWRVGETITAGYAMATTRFDWGNIVYGARVEHIENEGQAFVNFPASGSTPAGQRLVKVASDDTLYYPSAHLNWNLREDLKLRVGVTTSASRADFDDLRPNFTFSDSNQTISGGNPDAKPERQVGLDTYLEWYAGRETFVSAGVFYKDLKDVLVQTSKVFGDTSLNSGGVDRSGYAYSSIGNAGEGHIKGLEVFFTGTAETFVQSRNLPAWLGGFGTRLSGTWTSSEVTLPSVGGVPARTISVLGTSDAVYNVQAIYEKYGLTMRLAYQYRTPWGQSVGAYRVVNGSVIPSDNGDIFWDSDEELDFSARYQVNNNIEVFFDASNLTNAGARRYGGQKQYPIEYEKFGPRYVAGVRFNF

SEQ ID NO: 1603 - protein, 737 aa, Shewanella sp.
MKSRFAYSLIALALAQHSWVFATEKPIKNDIEPSSDTVQSDVIPAADASEPDAKLVTPERIAVHGRAMQMYVDKETTIGTKTAINVMELPQSVQVLTEQLIVDQAARNITDLYRSIAGVSEFSYSGVTFRGFRDDANVFYDGVRGDPYSGFSVPQLFNVQRVEVLKGPASALYGGGEPGGMINYVTKKPTFIESKELTLSTGSEDMIGGSLDFTGGLTQNLAYRFGAYYQQEDSFRNNADSQNAEVAGGLLYEISDDTKLTTTFDIIKQDLGGNRLRGVPVDDAGNFLVAPSYNANEKSDFQKMDALVLQAILDHQFTDNFSVKTQVRYLNNDSDQQYHESRGWATLDANKKPIMGDGTIKREYRVQSRANDEISLTNDFVYAFDALGFEHEFLFGGDYHYVETEYHYKLATSNEDVGNLNIFDLNYGETNPSTYNLKDKNTDGIRANRYGVYVQEHLHFNEQWSLIAGLRFSQFDEYDKATGFSFSDNAITPRAGLNYRPIDSTSFYLNYSESFNPTSLTNQAENIGDGFLDPETGNQIELGMKNEWLDGQFMTTLAVYRIEKQNVAQANPLDTGDDDGIPAMLNFGEVRSEGIEWTLVGDLTDNLTVTANYAYNETEVIKGVTDDSLTNTFDSKHFANAPRHQAGIWTRYDINALNSAIAFGMDYVGEQFSLDGQTVKPHTIFDMSWTTQWDQTQVRLNLKNIFDKEYAVSGFSERNGHFPGEPRNITLELSHKF

SEQ ID NO: 1604 - protein, 933 aa, Shewanella sp.
MLRSNLLANSVRLALVGGAAAVALTAPMAFAAEDGAKVERIEVTGSRIKRTDMEAASPVLVMNREEIAATGLVSLGDILQTIPSAGAALNTAFNNGGNGSTNMDLRNLGSQRLLVLVNGRRWISSLGSTVDMNTIPTAAVERIEVLKDGASAVYGSDAIAGVVNIITRKDFEGVEVSVYGGENLSEGDGRQYTTDLTFGISGEKGGLLFNMSHVTQQPIWAGDRDISDTGFSSTTENTRLRVKPSTLSQANQDGLTAAGYAVRSNGLYDLMSLPGTGADTGLDKFRDRTGSDVYNYAPDNYLVTPQNRNAFYVQGYYDLADNLRLVSDFMMTNRKSAQELAPMPVTLGASFGAAASRVDIHADNIYNPFGQTLYGDSARAVANGEAAGYVPYALQRRMLEAGSRRYEQNDVTYRAMVGLEGNINDNWSWSAHYIYGQNTQDELTTGLLNLTRINQALGANCDTSTSCTPLNLFGGPGSITDEMVDYITFDSVGRSGLTMKDYAFNISGDIFDLPAGSVGMAIGLERREETGYDTPDPLTVTGESSGNQRDATSGGFRLDEAYVELSIPVIDSLVITPATRYSDHDVYGDNTSSKVGAEFRPMDDLLLRATWAEGYRAPSISDLYAGNADSYPSWTDPCNTRTSSGAVIDVSGKPGCSAVPDGYRQSNTQIRITQVSSPDLKPETSESVTAGFVYNPSWLEGAELTFDYYNIKVKDAIGRYGYNRIATECAEGTNPATCSAIDRDSLGNIVDLRNYLLNANNYDVSGVDMYTGYRFETGFGSFKTSLDMAYVIDNNFNGYNQVGQQYGDGGYPRIKANFYIDWAMGDWDAHWKTRYVHSMMNNYYVDGVYEDYGIPESDFTKKFDAYMVHNISVGYSFAEYNTNVSIGINNLFAEKPESEYINNDMAMSTNNFSVTEYDVNMDRFVYLRATVKF

SEQ ID NO: 1605 - protein, 402 aa, Shewanella sp.
MNKTLVATALAAIFLAPSVSAIEIYKDDKNAVEIGGFIDVRVINTQGETEVVNGASRINFGFSRELTNGWNAFAKLEWGVNPVGSSDIVYNNRFESVQDEFFYNRLGYAGLSHDQYGTITIGKQWGAWYDVVYSTNYGFVWDGNTAGVYTFNKDDGAVNGVGRGDKTVQYRNAFGDFSFAVQAQLKNSSFFTCDIENITENECEARWIEGGADAQQVTYDYTYGGALTYKVTEMLSVSAGVNRGEFDIDYGNGDQKTAVDLIYGAGITWGNFDNNGLYIAANVNKQENHDTDNIGRLIKDAQGAETLVSYKFDNGLRPFISYNVLDAGKDYVIQPNFNADPDDVFKRQFVVVGLHFVWDPNTVLYVEARKDYSDFTSTDKVQEARMSLSEDDGIAIGIRYTL

SEQ ID NO: 1606 - protein, 215 aa, Shewanella sp.
MMNKNIVSTVIAATLLAAGFTASVSAHQAGDIIVRAGAVVVAPNESSDPVATFGEFKVNNNTQVGLNFGYMLTDNIGVELLAATPFSHDVSLAGVGKIAETKHLPPTLVVQYYFGDAQSKLRPYIGAGVNYTKFFDNKFTNDLNGALTDLDMSDSWGLAAQVGLDYQVNKNWLVNGSVWYAKIDTDVKFKLGGAPVTIETDIDPWVYMVSVGYTF

SEQ ID NO: 1607 - protein, 737 aa, Shewanella sp.
MCYQPKLGKLKTKVSLFVVGILPSLPLLASDVLGEPKVQPIEVIQVHGQEYRRVMTVTKPGEAIISMDQIEEMQATTFAEVIDDMAGAHIDGGTRSGGERINVWGFGETEDFNVYVDNAPVGFEQYRYGSFFLDPDLIKRVEVIKGAHDVRSGNGGFGGAMYVVTKSADDFLKYDQSLGARVKTSYASNNDAMGYTGTVYGRVNSSLSGLLHLTRRDAGDVTLANGEEYEYSGYEQNNYLGKMDYAQGDHQLALSLTHYLDEGRKPWANRRGPMPAISDYNIKKYGSYEQALYATTAYNTYEDNTWSANYRYSPSNPLIDTQVVISHSANERHWVRPDIAWEKMTVSVGNFGHESWLDYKRDYIDINNLSLIGDHEITTGLQYRSLDRTSLVFNKSYEKNPEKNFGWYTPYYQPEGRQDTYAAYVRDAIHITNDLTVTPSLRYDFIYSIGRPNIAPDYNDIAAGHDYSSTHHSGFSPRLGIDYQLTNHARLNFDYAYSLQAPVVDEIYAVQYAKASITGTSRNIDVERLHAFKLGLMTQHQHVLANEDALSTQITLFANLGRDDIAQRRGAKSDKTQLIQSGYTNLDGYHIYGADFEAQYRYQDVFSDLAVSWLQGKHNGSLRDSQDDDEYLANIAPLDIRLRLGMYITDDISIAWQGAWYDAQDHVPHGDIFNAESPSENYFLQNVYFAYEPQAILKGLSVRLMVKNLTNQQVVPFLSDGIPAAGRDVRLSLAYEF

SEQ ID NO: 1608 - protein, 314 aa, Shewanella sp.
MMNVFCKTLLASALASATLASAYAAEPLTVYGKLNVTAQSNDEKGDSTTTIQSNASRFGVKGDFELSSSLEAFYTVEYEVDTGAATSDNFKARNQFVGLKGAFGSFSVGRNDTLLKISQGNVDQFNDLSGDLKSLFKGENRLGQTATYLSPSIGGFVFGATYAAEGDADQQAQDGFSLAAMYGDAKLKKSPFYAAIAYDSDVKGYEILRASVQGKIADLTLGGMYQQQEQTYKNSLPVNTDSVNGYLLSAAYDINAVTLKAQYQDMEDLGDSWSVGADYSLGKPTKVFAFYTNRSMEASNDDDKYIGVGLEHKF

SEQ ID NO: 1609 - protein, 394 aa, Shewanella sp.
MKSFRLPQAMAAAALCAASSSALAQGSDLTLYGYLNTAVESYYKGAAASSSAVGLPSATTSRLTNYGSFFGTRGSEDLGGGMKALFQVESYVFLDGVTPPGFNAFASRNTRVGLETPYGTVFGGVWDTPVRMLLARDLFPGSTPDGGQILGNGVANTVSNVQAPGSFARRQVNTLAYWSPSMNGLRLMAHYSFGEDATPTARPRLLSTSAVYDGGPLSLGAAYETHGRYGGAGTQDRAWVLYGAYTFGNLKLGAYVVDMHYERVIGSDTLDLDVRNWQLQATYRLGKGLLKAAYTRADNGSGSLSALGTDANGQVTVDASRMAGQATAGPDTGASQIALGYEYGLSKRTAWHTNLLFHRNERNGAYTPFAGVPSPAGALGVRTRLLSVGLRHVF

SEQ ID NO: 1610 - protein, 872 aa, Shewanella sp.
MRPSTFKKSVLATNIAILLGSAVSVSAVAANDAVAAPENIEKIEVRGMRASMKASVNDKRFSDAVVDAVTAEDIGKFPDGDVGESLGRIPGVAVNRQFGQGQQVSIRGASSQLTSTLLNGHSVASTGWFDQQNIDRSFNYSLLPPELVGGIQVNKSSQADIAEGGIGGTVTVKTRKPLDLDANSVFLSAKGDYGSVSEEIDPQTSGLYSWKTEDEKFGFLVAGSLDKTEYQRNGIESLLGWGEIVPTTFQQDRERTALNAAFQYRPTDALEFGLNIMSLQLDANNANTSIFLFPTQRGENTCLKKNAAGVCTLVEHTDKDGFAWAQTWARKASMSSDTIDLDFTYQADDYKLEGRIGKTKAEGGTDLTSNYGQSIGKPEDFAGIYDATGDVIKINIANNSFDASDFNGQLETAGWALKKQPNTDEEAFATFDITIPVELGVITSIKSGISYADHDVTQTTEAALSSNIMAKDASAYYSGTMSSGAGFTLPKPIFNNMINDAYAAIDGFTLDKSGYGTLQEKNLALYTMATFASEGVRGNFGLRYISTDVESDYYALSDSGVYADVLSTDKASYNDVLPSVNIAFDLASDLILRASAAQVISRPNYADLFATSKLPGFNDGTPGNEKKVTGNVNLQPFKASQADLSLEWYFSGEGLFAATYFIKDVSSFISTREKLNQEIGIEDPNLVIAGGSSCGVGIYDCWTVSENFNATGGSIDGIELQLQDSFDNGLGYSVNYTFADASSPAENYADRVGVFSDSSKHTVNLVGYYEMDNFSTRIAYNWRSEYMMRELPGFYGNREHQAYGTLDLSANYNVTDYLSVTFEVVNLLEEDSIQKGVSPVNAPGVISEFKDNYPVWSFDGEARYKLGLALRF

SEQ ID NO: 1611 - protein, 368 aa, Shewanella sp.
MMKNSLKIALLASALPFGVMASDEGMSPWYVGGGVGINNYEPACDQKTMRSCGEDSPYAWDVFAGYLFNDYFGVELGYRDLGRAEWTDYANNLNDVGAKGTTLGLVAFWPFASKWSLSAEAGAMNYLVYNNKRWGSNYYSDSGIAPFVGAGIGYNFTDNLKLSAKYRRYENLDEEKWNTLEMESNYWGLELSYRFGSKAAPVVAAPVVVAPVDSDNDGVNDDLDKCPATPADHKVDAYGCTVYKDDVTTHNLGSLRFANNSSVINPSSYESVEKLANYMNQHPGSTVEIGGHASNVGNPDYNMTLSEKRANAAAKLLVEKYGISANRVTAKGYGITRPVMDGNTAEAHAANRRVEAVVTGSEKVPVLK

SEQ ID NO: 1612 - protein, 696 aa, Shewanella sp.
MKKKPLVIAMAVALSSSTLSFTLAAEDVTKAEIQESADKELITTEFDEVLVSATRISEKASETSRSVAVVGEEQLAIAQASSVANALKHEANISLTNGPRASSQGVEIRGLSGDRILQTIDGARQNTSSGHRGTYFMDPELLKSVEVLRGPASSLWGSGALGGVVAQNTKSAKDFLAPNEKFGGYLQQGYETNGDRVKTSGAVYGQEGTIDWLLNGSYFDSNNIKTGNDETLINSASDGGSGLAKLGWQADEASRLELSARVNKTNELVPSNPSTVVSSSVPLVRRQTDDQNITLNYSLNPTNNPYLDTKVQVYWNSTDYDEDRVTKGQKDSTEFRTVGVNLNNSSRLGNTKLTYGVDGYRDTIETVRDDSGQVGQRPGNIDGESTVWGAFTRADIELIKTLNLDAALRYDNFKNDSNNLNMSSDDNELSPSLGLSWQTQPWLTLSARYDQAFRAPTVEEMYSSGTHYCIPPIPGFLPQGLCNTFATNPNLKPETARNKEIKADLRFSDLAGDDELAVTLNVFRNDVDDFIVQQVSNPWRGIPGFEQTTSWNNVEDARLTGFEISGRYRIGQTRLAMNYGQTHGEDRKTGEYIEGIPANKFNVDLSQGIMDGDMKLGTRVTYVASQSNTPDGYSVAKYDDYKLWDIYVAWEPTMGVMSGVRVDFAVENIGDEQYQQAWQTLYQPGRNMKLSARYMF

SEQ ID NO: 1613 - protein, 683 aa, Shewanella sp.
MSSRYFILSFCAVAVSVHYSSHLFANPLDSQTINLYEVNDIYHSSDDVIALSRLKTLTILPADHSGNPANISMRSVSQGVAVLQDRVYFSPAPYSAPQLQLLPNLLQQQSVTVTPLSEMTVGGQGAFGVISYQSLAMLDQAQESKITVEGSTDSDMSAEMNWGVKQKEYGTILAVNYEKNKGEGDFFTGRDTDRTSTDILFKINASSLLGARNPQMTEFTYQFLDVDSYRSLLGVTGADWLKNPMMQYSASAEDQAIGRYHKYQLSHQVNLGNSQFITDFYYHSYAQQLSQVNQFNGLVIDRQSLAEIAAFDRQPWNSGAELAALEQDNDYSAFGAQTQSVNQYGEHQIIYSARYHTDKAEMRFAEQQSMWLPDRSIVKAASSSILAYTDDATALTSSVDSLLKWEGLQFKLGVTYEHVDVNREVHSAYTGLDAVDFSDSDWMPQLGVFYDAGNWRFSTDIRRAWTAASAGNLEQEAQVSLHYQVSMQYALEGFNANLKAYMQEFDNLHVDCNAYSLCADARLFTQENIPDVQTYGIEVSLGYLWNVEHLTFPLSLNYQYINSEYQTNTCTEIQGCVFAGDKMARLPEQQLQFSAGMKYEAYEVNVNAFYQSERELSQFGAELTPIAGQLRVDLAASYQFDRHHRFYFRVENLLDESLVTTASNSGIRVENGRISYLGYQWRF

SEQ ID NO: 1614 - protein, 844 aa, Shewanella sp.
MLNEEQNSLEEKGGENKNEKETPLKGIHSKIPSLKQALEQTISKIKSSKEFFKQILHNKKKLYIALGALLLLIVLIVALSLLLGHKKENKQTSLQTNTIATNNETPNNTNNANNTEAERQIENLDLSDLIGKDSLKRNDENQVDAIMKKASLLYEQGQKDEALHLFDKAASFSQGIASHNLGVIKFKEKDFNGALDLFDSSIASKENASVSAIDALVSAYHLQDEDLYYHYLKIARDTLYKDYKKSFYSYAYALKSYYAGEYFEALSPLMHPNSNAFLKPNTRLASKLFLMFKDETNAYEQLQKSANAQDELALGLLQARLGHYKQALEHLQHYLHNYPKDLNALMALELVSLKKGDTLKASEALKLASHTKEDTLLANSFYPIKPTINPVFLDKERAKERFWNTQYFEGKRDFIYRLLFYYAPFKVLDSKETLGVIEEGLFLLDSDAQKDLEGASLAFKRGRLMAIADKNALQGLKALENKRLKKALSFFDLSLKNSPNNALLHYNTGLIYAQLENYHKAYFHFLRAFHLNSADYLSAVFAILASHFTHEDTTEFLREITENFYSQDFSSPTQKALLSSLIAYLNYRTNWDMDWLKNAPKKLPFYYALEAAFAKESKDKKLMVQSFGNLKKMLPKDLISNIFYEIVSYYDASIRHTLSIYTLLDSHKISWDQTMQGPILGRHFYTYMGFMVNDLDHQERLLEQKIASLEEGEAPNDWLENLALVSLFQGQYEKASALYQNLISGLKDNETHLKILAGLTYIAQNNYDSAALWLELGKLDDPNNENIRYALGLLYQRKGDLKSALNHFLAIKTSDFSSPYFDFEIDANLLKERLDQEKEGEFLE

SEQ ID NO: 1615 - protein, 342 aa, Shewanella sp.
MKNAKYIYLGAVLICSTQTLAEPLDFYGRLWLGVANSSNGLSGNEKVDGFSLENYASYLGVKGEYAAYDNFSLLYKFEAGIESFDNDDSNIFKPRNAYLGFKTNYGSAVFGRNDTVFKSAEGKVDLFNITSSDMNMIIAGNDRLGDSVTLNSAKFVGVTMGISYVFDKDFNQKNPELSDKQNNYAVSFTVGDASLKNKNHYVSIAYADGLNLLEATRLVGGLSVASIKFGAMYQHSESSLYDNIKGNSYLLSMSVPVDKYDIKLQYLKDDAGLGKITKNAGADLKTLKESDASQYSLGVDFKAQKDLTFGVGISYFDGDYTDAKGHTEFDDTLIFVSTRYLF

SEQ ID NO: 1616 - protein, 353 aa, Shewanella sp.
MKKTFISASVASVLALASFGALAEGPSFYGRLDLAVTNTDSSTTLQGSTKGATIGESGTYLENNFSWLGVKGSEKVADGVDIVYQMEFGVDNTTNSGNTFNARNTFLGFKTVAGTVLAGRNDTVFKQAEGNVDVFGNTNADIDRLVSAQAGAGRSGDGVWYYSPKIADLVTLNATYLFDDNYGTSESMYAVSATLGDKAFKEQNYYLAAAYNKAIGGVDAYRGVAQAKFGDFTVGGLFQHAESIVNDNRDGNSYFVNVVYKLQNGVNLKAEYGKDEAGFGSYFKNASGLNNNMTVDLDDVNVDQITIGADYRLVKSTLLFAHYAHYEGDFKQNGVKQDLIEDDVVSIGVRYDF

SEQ ID NO: 1617 - protein, 678 aa, Shewanella sp.
MKLAVCFLPLLGLSYTVIAEDLADNIERLEIRGRQINTLGHSTSASEGIVGAAEIASRPLLRTGEILEFVPGMIVTQHSGSGKANQYFLRGFNLDHGTDFNTRVEGMPVNMRTHGHGQGYTDLNFLIPELLGEIRYAKGAYYPEVADFSGAGAAQLMLADQLAYNQVGVTLGEYGYQRLVATQALTTDVGRFILGAELQAYDGPWKDINEDVSKVNVVARYLTRLAGSDLSVTMMAYDNSWNSADQIPARAVESGLIDFYGSLDKDVGGDASRYSISAHYDAGNWQGNVYAIRSTMDLFSNFTYFLNDPINGDEFEQVDERTLWGGDIKRDWHTSLGGTQINYSLGADIRYDDISAVGLYNTQARQRLSTVRLDEVQELSGGLFGKLEWLPFEQWRFNLGLRYDYFDVQVDSDNSLNSGDASDGMLSLKAGASYLWSDNLELYVNAGQGLHSNDARGATIQVDPVSGDEVDKVDLLVRSNGGEFGVKYYDRDFINFSAAVWYLQLDSELVFVGDAGNTEPSRASERYGAEITAYYWLNDDISLDMELAWTHARFTEDEAEEGKYIDGAVPFVGSAGITYRPDGGLYSSIRIRYLGERVLDNFNEHKADDTTLVNLALGYKFDHFDTKLELLNLFDSQDHDIDYFYASRLPGEAAEGIEDQHYHPVEPRMIRVSVSYHF

SEQ ID NO: 1618 - protein, 628 aa, Shewanella sp.
MKNNFKIAKVAQWVLALSIATTSAEAWADPLGNWLAKVNNHHKQKESASEQSVEQDDRTDTDNTVNTSPVANQPQAQTSQTVSQPSAVTPYQSVNNRESQAASQIPAADATDNDVRMSDNDNNDASGRSVDAPQMAEVSHQHVSPAPFPYASLTVGSSELQPETDPRLPVSKGGVVEENVENKGLVDSIVQSTRGRHNAFAWIGVGDNSVMLARDPKDRGMFGTWLGIKPWLRDKGIDIQSSMGGVETAFNARGGDRHGLRTAYQWLVQASFDMERLGVVKGGKFNFMMTKRGGGQIEQAINSTTLTEMQEVYGRGNIWRLIEGSYEQQIGRFNIKVGRLTENNEFGMAMTGCSFMSLGFCGNQAGNLVGDYWYNWPVSNWAGRVTYQVSKEVTIGAGVFDVNRKNIQGKVLHENFYMDNPFHPEAGLYIGEVKWAPKFGRENNLEGLFKFDGWYTDDKSYNLRYYQDVAMQTGYSSQGPEVRGRYGAYVTAEQQVLRFDSHRQLTVAFRALKNDGRTNKSTAEVSAYAILFGVSKERPDDWVGLGAGTTWLSNAFLKSQALSAQNRHQEYYSELFYNIQLSPAVFLRPNIQYVVHPGGYYARGPVDTPYNYNSKNIILLGLKSGWVF

SEQ ID NO: 1619 - protein, 716 aa, Shewanella sp.
MNSPRLSLLYSAMLLALGTAGLSHADDSATNNKTTDNIEKIEVKGSYIAGYNASTASGASRLDLAISDIPQSVSVITNAQMSDFQLTNINTALDSATGVNVERIETDRTYYTARGFDITNFQVDGIGLPLSSGSNHADEDTAIYDRIEVIRGANGLMTGVGNPSATINFIRKRPTADTQLNINGSYGSFNNTRLELDGSTKLSENIAARAVAVKQTQDSYLDRYEQDKTVLYAFIEANLSDNTSFSISHSYINNDANGGLWGALPLYFTDGSATNYDRSTSTSANWSAWVVEKNNTVVELSHYFNDDWYLRATYSHKSADEDTELFYVFGTPDKTTGLGLTGYGSAYDAKETTDLADIYVKGDFSLFGRDHQLVFGANYSTADKQEHSLYDDTTGNGFPKMPDLNTWDGNTPYPTFADRPSGSDTESTQKAAYFTGRFNLFEDMHLIAGGRFNRWDTKGESYGKSRDAEAEEFIPYIGAVYRFMPELVAYASYTETFLAQTEVDINEQPLDPVTGESKEIGLKSELFEGKLIASLACFQIDQVNLAKLDPATINLPPNQQKYIAADGISSDGYEIDIAGEIYDGLQVSVGFTDFDIKGDELVANYTPSKLFKLAATYDVAQLEGLSLGVNMRWQDDISREQGTVGAGFANAGDTIITRQDAYAIVDLMARYAFSENISLTFNANNVTDEKYINSLYWAQGFYGAPANYSATLSWKL

SEQ ID NO: 1620 - protein, 713 aa, Shewanella sp.
MEDNKMAANASTIPHGFKCSAIASALTLALGASVASQAMADETNQTQIERIQVHGEQSIGRNALGSADALLKDQGVDFSEAGGVSALPVLNGMMGDRIKVLVDGADITASCANQMNPPLSYVSANQISSVEVVAGVSPVSAGGDNIAGVIKVNSLNPKFSDSEDLSFESGEISSGYRSTSDAFLLGAKAGIASKNLSFSYQGAYEDANSYHDGHGDKVLDTLYRAQNHALTAAWRDDTQQLAIKLTHQAIPFQGFPNQYMDMTDNKSYGALVRYLRDLDNDGEFSAQLNWHSVKHEMGFFTPEKTGKMPMNTEGSDYSYQLHWRLPIGDDSTLLVGQEFYNYQLDDTWPAVPGTMMAPNDYININDGERRRAAVYGEWQQNLTPLWWLSAGVRYEYATTDTGEVQAYSNMPMMGMPNMDAEAAKAFNAMDRSRDDNLIDATLLARYQLSAKQQLEFGLARKNRAPNLYERYSWGRGVMATTMIGWYGDGNGYVGNPDLKPETAHTLSAAYKFAGDEWQFSTTAWYSAVTDYIDAEVIGSFNRTGLASGKRNILKFTNEDAHLYGAKLSANYLLADTDSGKWQMQGKLNITRGERDEGNEPLYQIKPLQTELALSHQLGDWENRLSWQWVATKDKVDDRRLENETDSYSLLNLSSSIKWQELSLTFAINNLFDTYYELPLGGVNLAEFKADSSGGFSQFAGSGRSFELGASYRF

SEQ ID NO: 1621 - protein, 250 aa, Shewanella sp.
MKKTCLCLALMLSPQAFAGDLVQWWDFSATALYGEDYDLAPSDKQATITLETAGGWKYGDWFAFQDFIYFKGNDTGMESTTYGEISPRFSASKILGEKIAFGPVTDLSLALTYEEGEGPVHSLLYGLGVDVAVPYFTYLNFNTYRRNSMSTGNNSDGWQFTPVFRIDIPVGSANIVLDGFIDWVFATDDNGYEENFHFNPQLKYDLGKSLFGDHQANKLLVGIEYDLWTNKYGVKGVDQDTYSVIAQYHF

SEQ ID NO: 1622 - protein, 701 aa, Shewanella sp.
MVLSYLILIILIAPSLRAGTLNDEFKHSDEEAYFTEIASGHLEALRKAPGVVTVITADDIERSGATHLDEVLESVPGLHVNRSDLSRLEPVYSIRGIQNGFSAQALILFNSMEIKNPFSGGLPAVFRLPLNSISRIEIIKGASSALYGANAFSGVINIIPKKGQDAVKPVAQIRTGSFGSHDLTLQHHYTTEAGTGYFLSLEQQYSDGDNNRIIAQDLQSTTDNLIATDASLAPGPLNTHYSVTNLFLNIEQANWSWNNWYWENNNAGNGQGAARTLDNSGKENIVSFMSQLQYRSIIDQQTSIEGNTYFHYLDGESQLTLFPANSRIPIGSDGNPFTAPGNLINFPDGVIGIPAGTTYRYYFDLGLQYIGIVDHILHFQTGAQSTQFRSREQKNFGPGILTGTEISVDGTLTDVSGSPNSYITNQDRQNFFLAVQDQWHITPDVTLTLGGRLDHYSDFGSTFNPRAGVVWEPSPDFTGKLLYGEAFRAPSFSELYLKNNPSGIGSSSLKPEQIKSYEIVTDWIINPELQLTNTLFLYKASELIKTELKNNVLVFQNTGANKGYGIESEFKWQLDHNLSLKGYYSHLKSKNSNTNKTIADIPRNTAYLALNSDLPGKWQINLSNHWIGSSSRQNGDNRENRGSYTWTTLKASKQSLIPGLKLAVIVKNLFDKEAFAPSSSTIPGDYPLEGRSVWGELTYRY

SEQ ID NO: 1623 - protein, 701 aa, Shewanella sp.
MLRAGCALPLLCLSVPGLAQTAPAADADQDGSYHDQRADIVVTALIPRRQGDILSGTSVLTGEKLTRELRPSIGETLARQPGVSATSFGPSASRPILRGFQGERVRILTDGIGSFDVSNTSVDHAVAINPLTADRIEILRGPSALLYGSSAIGGVVNVIDSRIPRRVPDEPIHIDAIGTYGSAANERTGAGEIEVPLADKFVVHLDGSYSKTGDLDTGNYILTPALRAQAAASGDAEIADLANLKGKLPNSAGRVWEVAGGAAYIDDGGNLGVSFAHTDNFYGVPVRYALDPDGEAEEVRLRMKQDRVDLRGEVAVNGGVLDSIRLRAGYADYQHQEIEDTGEVGTTFYNQSMESRLEFVQSKRGGWDGAFGAQFFTRRFEVEGEEKFLPKNETNQIGFFTLQSLDLGDTRLEGGARFEHTNVSADADEALFFDGRRRSFDALSGSIGISQAIMPGWRVGLNASRSERAPSAEELFARGNHAGTQAFELGNPDFGKEKSWGLEGTLRGSGDGYSFSLAAYHNWFSGYIYESVAADSACQAVNGGEELEFPCYAFNQADARYYGFEAEATVKLAQLGSYAINVDGVADYVRATIKGSGPAPRIPPLRLLGGLEAQGDRLSARAEVEHVFDQDRVTDFETPTDGYTMVNASLSFKPLPGNDRTTLMLSANNIFDVEARRHASFLKDFAPLAGRDIRVTARFSL

SEQ ID NO: 1624 - protein, 804 aa, Shewanella sp.
MLFRQTCLAAAITAVFAGNFVQAEEAPDRKMEVIVVTASGYEQKLVDAPASISVITQEDLMIKPYTTLLDAVRDLEGVDIGETRDKTGQGTISLRGMGSDYTLILVDGKRQNNHGDIYPNSFGGNQFGHVPPLDAIDRIEVIRGPASTLYGADALGGVVNIITKKVGDEWSGSVTHSRTNQTNDAYGEDITTDFSVMGPLIKGVLGLSVHGSIYDRMGSTPEYAPVNYPNGEVRTRSLGFGGGGKTVDNENHMLGGSLSWTPNEHHKIWFDLDSSSQEYDNTPLINADGVREYPLGTVDNLESLWVASNFCKGGVGSREAACLASGGEWARRSNPRVGYSETQKFTRDAWALTHEGAWDFGTSFVSLSYVDTQNHGRTLPFTTAERTLLLQMIDGKGAYTGMTEAERKAIVSSTFLPRPKREMASNQYTLDMKLDIPFEAAGNHVAVTGAQVIRGELKDGVFGMEEGTPGAVQEHNMWSVFAEDTWSMTSDLSVTAGLRHDDHEIFGNQLSPRLYGVYTINNEWTVKGGVSTGFKTPKTTQLYDGIVGFGGQGTSPQFGNPDLEAETSVSSEVALYWSHPDGHNFNVTVFKNDFDDKIASQPCGTGTSIECSDAGEYADLGYAVSTKTVNIDKVTIQGAELAGRWEILDALTFNANYTYTDSEQKSGAEQGRPLGNSAKHMANATLKWEITDSVNVFLTSEYRAKRYRSWDTINDAPLYYKGYNVFHLGGSYQASEFVTFNMRINNLFDKDFTTYDIVFTECSDTSATCVSDDNGQNGYTASYVDDYNNKDKARNLWVSMNVRF

SEQ ID NO: 1625 - protein, 705 aa, Shewanella sp.
MPRFGKFYPQSKWVIGSLALGLSAISGSTIADSGTAPDKQSKQQDAAGNIEVITVYGQKIERTLKETASSVTVITEEQLRKNADQSTISEILGGTPNLIYAGNTDAPIIRGTDTKGPVAAGNAYLSKPVPGATISVDGKYLSPAELDLGAAGVWDVSSIEVYRGPQTTSQGANSIAGAVVIHTHNPTYTPEFAAQALYGSRNKKRFSVMASGALSNDFAARISADYSARDTFVDYVNPEFTAHDLDFEFKNQNLRAKLLWEPEKYSNFSAMLTYSSTEAKRPRNEVVSEPYDDLENRSIFQDNQEVSNHVGIFDLEYVFDNGMKLHNQMQYSEGQFDYRFAAPYQGIAKRDNENFSNDIRLNFGDKSSEFSGVAGVFYWDDKTNNKLNNVFGNADADLRHTSFAPYGEVIWRFSPKWAFTSALRYQSDEISHDGIASYIPGVRHQYEETFTALLPKVALSYDLTDNVLIGAMISEGNIPGGTGINFRGGEYYTFDAESAWNYELFTRIDLLEQRLIINSNLFYTRFKDSQRSVTDYLDGRPFGSVIINADEAQSYGIELDWNFKVADSFSLYGGLGLLETEISEFNDYRGEEFVGNEFSKAPGYMFNLGFDYAITDAFKVSGDVRHTDGYFSTDTNEPELRVGSYTTVNLNSSYQINQYFEAFVYARNLLDERAPVAKMADRSTGGVDAYLLEPREIGVGVRAKF

SEQ ID NO: 1626 - protein, 384 aa, Shewanella sp.
MNKTCIALVLPVLLTATSSQAIELYKDSKNSLDLSGWLGFAALNDSHDTSVIDDLSRVRFSFERNEKHGWTAFATTEWGINMVSSDDSLVMQGGKLAAEKNEDFLYNRLGYVGMSHDEWGSLSFGKQWGVYYDIAGTTDLPNVFAGYSVGAYAFSDGGLTGTGRADSAFIYRNTLGPVHIALQYAAKTNGDIVLKNADGSEMADSELNFDSSYGASLTYSVTDKFKLLAGFNRGDFDGHLGNTQVDETNKIVGIGAMYGDYYHYAENREASGLYVGFNAHQSKNNELVDGELYDATGVELMTAYQFDNGFVPMLVLSYLDLDTDATTPIQGKWTRQFAMLGLHYRYSNDTVMFAEMKLDFSKMDDAALEALEDNGFAVGINYFF

SEQ ID NO: 1627 - protein, 685 aa, Shewanella sp.
MEHRAFKKNIIAAIISSLGVSSAYAAVEAESTEPIEKITVYGEKIERSLKDTTSSVSVIDKDSLDSGQYQSVSDALSEIPNVVVLTGSVPDIRGVSGNGSASGFNSFTGGARARVSTLVDGVAEPFVADLTGDTGLWDIQQVEVFRGPQSTINGRNSIGGTVFIKTEDPTFDWRGAARLGYRDQNNYVDSAVMVSGPILDDELAFRLSGQNVTGETYNKGLVYETNPAPFDLNELITNRWRGKFLWQPSAVEELKVLYSFSYNDEKGDSGRNYFSGDDPWAYRPILQRYIETESTTHSVKVDYDLGSGRALDLVVAYMDYDWGSKSYEALVTAQQYVDMKDESYTVDGKYSFGLNDRDFNGFIGLAYYERSQDFGSTGSSVYTGDDSSSSLSIYGELTYGLAESLWLTVGGRVMRDEQKRNFSMLYRGTQLEEKLDNDSTITLPKLVLQYAITDNTTLAASARRGYNSGGGALSLAESEYYYYDEEFVDTYELSARSMFLGGNVNLSANLFYNDFDGYQASNQARKITNVDKAVTYGIETELSAMLTANWQVIAGVGLLDSEIKKVDSSYGDIVGNQLNSAPHVTANLGVKYWLNDAFSVGVSGNYVGEYFADIDNTESRIAGDYVVARLSVDYQKDNWRISGFINNMFDEQAMTVNEPPSANYVNGYAAIIDPRNLGVSVMYSF

SEQ ID NO: 1628 - protein, 1045 aa, Shewanella sp.
MVFKIMKNKSVRTEIQKSFLWNFKLYAFIGCLAFPLNVLGESVSFDTDNVAFMSPSQRIKVTGIVKDEAGITLPGVNVVVKGTIIGTITDANGQFTLEAPSDGVLLFTYVGFGNLELPVNGKENLEIIMKEGDTQLEEVVVVGYGTQKKVSVVGSISNIAPKAIKQTATTSLPNALSGRMPGIITRQTSGEPGFDAASIYIRGIATWGEKAPLVLVDGIERSISSVNPDEVESLSVLKDASATAVYGVKGANGVILINTKRGKQGKPQVSFRTESAILSSLAERNYIDGYEYASLMNEGLANVGKAPRWSNEELEKFRTGSDPYLYPNVDWIDKVLNKNSYQTINNLSVTGGNEIVRYYVNLGYSMQTGIYKTDKSNPHNTNAKVSRYNYRSNVDINLTRDLVVELGVGGIIDDRNYPGAGAAGIFNGLRDTGPIAFPVTNPDGSISGLPTYIGSNPWGQSTQTGYSDEHLTTIQSTAGLTWDLSRLVTKGLSVKGHFSFDFYHANKALRYKEFGIKQYIGKNEQTGEDQYITHRDDKAMGYSIEQNSNRAIYMDFSVNYQRTFDKHSVAGMLLLNRRQYDNLSAGTSIMNLPYRSQGLAMRATYDYAQRYFIEFNAGYNGSENFPKGKRMGFFPAISLGWLVSGESFWKDNLVSNLKLRFSHGEVGNDQIGGDRFLYLTKMDQNWEQVYYFGQDQIRWPGIIESKIGYNNVTWETAVKTNLGLDLGLWKDRFSLQMDFFYEKRKGILMQRQSVPTGAGFLAASVLWGNLGKAENKGFDALLEFKDRTSSGLFYSLRGNVTFARSKVLENDKADPLYSNLSEIGHPIGQPFGLVAAGFFESEEDIDNWYDQSLLGGRPIPGDVKYKDINGDNIIDSNDQCAIGYTREPELVFGFGGTIEYKGFDLSAYFTGAARTSTFFEDRTFWPFASGMGFFNVFKEIYDNRWTPETAGAAKYPVVTDGFNVQSMRRSTVWQKDASYLRLKNLEVGYTLPKKVVSKLKINNLRVFVNGTNLYTWDKINHTIDPESDNWYPIQRAVNFGLAVDF

SEQ ID NO: 1629 - protein, 750 aa, Shewanella amazonensis
MTLKPNPSIDCGERKYSAHRRVWWQRKGPLLTQASTFAVLMGMSAVPVSAQSVPGATSKTNSNMTLPEVDISAVSTNVSPAGETFGVITPPKKFELGPAGNQKPLDMPHSVQVISQEIIRSQQARNLADVLKFNPSVQMSRGADGGRISSRGFESGVVQNTRMDGLNMISTTGYPIEQFDRIEMLNGVAGGMYGPTGPTGTFNFISKRPTDVPFQTISYGYDSISNNTVFGDVGDRVEGLAFRFNFVHSGGQSYAPTSSLRRTLLDGAIDLHFGDSTVLELNGSYYDWHWFGFPGSFTYGNGIYNLPQAPSSSTAGFGVPGMGNQNETHTFSAKLKHEFNQDWNLTIGLLDQTVERGLYQPTNVLNNNYGQFTSQINSQKAAKFTIISNLATLNGHVMTGNISHDIFVGTTGFTWGTFSGIGTNSVTVGTANINNPFVFATPIYQTGGAVYKSARNDQQSLVGGDTIKFDEHWSLSLNSSFSWLTSKNYNALGQKTSSFQTGGEWSPTASVMYKPSENQTAYFTYANSLQQGDTAPTGTLNANQTLAPYRSTQYELGYKVALNDRFMITADGFRISQPWAYQNADKIYQNFGTQVNWGSEVMLTGQLTDDLSMMGGFMQLVPKLFNTGTPGIEGKDVVNIPRVQANLFLEYTVPTIQGLALSTNFHYVGGRPGNETNTIWSGAYATLDFGLRYTTVVDGHRITARFNVNNVTDKSYWTNIYPVSGVSTSAGSQAYLGLPRTFSAGLDFTL

SEQ ID NO: 1630 - protein, 461 aa, Shewanella amazonensis
MFKLKLLSISTIFILAGCVSLAPEYQRPPAPVPQQFSLSKNSLTPAVNSYQDTGWRNFFVDPQVSRLIGEALNNNRDLRMAALKVEEARAQFNVTDADRYPQLNASSGITYNGGLKGDKPTTQEYDAGLELSYELDFFGKLKNMSEADRQNYFASEEARRAVHILLVSNVSQSYFSQQLAYEQLRIARETLKNYEQSYAFVEQQLVTGSTNVLALEQARGQIESTRAEIAKREGDLAQANNALQLVLGTYRAVPSEKGIKGGEIAPVKLPPNLSSQILLQRPDIMEAEYQLKAADANIGAARAAFFPSITLTSGLSSSSTELSSLFTSGSGMWNFIPKIEIPIFNAGRNKANLKLAEIRQQQSVVNYEQKIQSAFKDVSDTLALRDSLSQQLESQQRYLDSLQITLQRARGLYASGAVSYIEVLDAERSLFATQQTILDLTYSRQVNEINLFTALGGGWVE

SEQ ID NO: 1631 - protein, 416 aa, Shewanella amazonensis
MTTNNTRLFKKSLLAVTITLASSQAMAAGFQLNAQSATGLGRAFAGDAVIADNASVMARNPAAMSMFDKTELSLGFETITTDIKVSDATYTSAMNPIGTPTSSNYDDAGGTSVAPNIHLIVPVNEKFAWGVNAYSNFGTSTDFGSDFAASEFGGETDIMSLNFGLAGSYRLNDQWSFGAGLDIIYGKGTLKRTTSTSVTPGGNSPLDGLTLVNIDGADGWGVGFNVGTVYELDENNRFGLSYRYSPEITAEDSKGQEITLPLPDMAEFSGYHKLEDTKFAVHYSLQWVGWKAFDKIEFGGTATTPDAAYEWKNAGHISVGTTYYLNNDWDLRAGYMYDIAAQDDLKSVSVPDSDRQWFSAGFTYHIDTASNVDFGFTYLLGEDVKNVNESTPLGTSVSATTRADAILLGLQYSRSF

SEQ ID NO: 1632 - protein, 451 aa, Shewanella amazonensis
MIMKKRLLTLAVTAALLSSTTQLHAAGFQLAEYSSTGLGRAFAGEAAMADNASAQGRNPAMLTYLEGRQLSAGGIYVMPNVDVKGDVSLSSPLLGPDPVKMQGGDALDVADSALVPNFYYSNQLNDQWTWGLAVNSNYGLATELPATHAAAIFGNKTSVTTVEFNPNVAYRINDAVSVGGGVRIVYGEGEIGASLPGWVDGIKPSLPAQVAAMLPPGGTELKSMKGDDIGYGWQLGASWQITPAHRLGLAYHSGVKLDLDGHASGVIYTGGQDVSIEGYLPLELPAFAEIASHHQLTDNWAMHASVNWTDWSVFDQLVAYFPGEVKPKGDLESDLVKEEHFEDNWRFALGTTYQVNNAWLVRAGVALDKTAATDEWRTTTIPDSDRLWFSVGAGYQASKNLNVDFAVTYIKATGDAPINEQQNLLNLATVNFNGEASGNVWLAGIQMSYKM

SEQ ID NO: 1633 - protein, 384 aa, Shewanella amazonensis
MKKTCIALMLPMLLVAINSQAIELYNDQKNSLDLSGWLGFAALNDSHDTSVIDDSSRVRFSFERSERNGWTAFATTEWGINMVSSDDSLVMQGGKLAAEKTEDFLYNRLGYVGMSHDKWGSLSFGKQWGAYYDVAGTTDLPNVFAGYSVGAYAFSDGGLTGTGRADSAFIYRNNFGPVQIALQYAAKTNGDVTLKNDDGSEMVNSKLNFDSSYGASLTYSLTDKFKLLAGVNRGDFEGHLGNTQVDETNEIVGIGAMYGDYYHYADNREASGLYVGFNAHKSKNNELVGGDLYDATGAELMTAYQFDNGFVPMIVLSYLDLDTDANTPIQGKWTRQFAMLGLHYRYSNDTVMFAEMKLNFSNMDDAALEAQEDNGFAVGINYFF

SEQ ID NO: 1634 - protein, 1070 aa, Shewanella amazonensis
MKQNRSTLSPCFRKTLIASLLVPLCSPLYSWAVQTASITDGSTMVISGGYDTEANNHSAVFVQGSGSTINGGSDVVIETTGVGAIGANASEGGTLGLTGSTIKTENSVAFGVLNDKGTVNLQGGTITTKGQTAYGVYSSGLGSNTDIHSSEITTSYSLTHAIYGAGGTGLTLNNTTLNTSGSGSYGIYLNGPGGSLTGADNTINSTHATNGAGIYISSGGSNATLDNTTLNITKGAVGVNVGEGSSITMDGLIATGNITNLFKVNGNASVSNANIELAAGGLLMAQGHSASNQAVIILNNVDAISNGGGTTLVDVNKDADVTINGGAYHSKGNNAKGIWVRDNNSSLNVDNVVIITEGVNATAIENRGTAIVKNTTVITQGNNSHGLYSEQSLDATNMAISTAGIGSIGAAAAKGGNLNLNDALIETTGNSGMVLGTFADSSISAKNITGLSTGAGAYALWVDDGSSILLEESQITTQGQGAGGIYASNTGTGSHTAYTQVTLNNSQIHSEQGPGIWANGADINVDVKNGSQLTGGNGLLIYASSNAGATSNVNVNGDNHAVLLGDIHAAENSNINLALNNNSVWTGAATNAKQVDIDSSSIWNLTGDADVESMHVLGQMNFISNSSDTNSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYKIDDYRWNLQSNLINPGPGPEPEIEPEEIAYRPEVPGYIAAPWLNAFYGFTTLGSLHERRGSAEGAAEGFNQDSWGRIRGQHNNFDAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDAISEIGGTDYSVGQVRAGLRLFSDSSEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 1635 - protein, 347 aa, Shewanella amazonensis
MKKTLISASVASVLTLVSFATLAEGPSFYGRLDLAVSNSDQGATTQNRKEGTVLENNFSNLGVKGSEKFANGIELLYQMEFQVENTTQTEGKNGSDEVVFKARNTFLGLKSDAGTVLVGRNDTVFKQSEGGIDLFGNFNADIDRMIGGQLRKADGLWYYSPVIGGLVTLNATYLMEDNYTDDAGKESYDDQYALSATLGDKGLKAHPYYVAAAYNTIGGIDAYRGVAQVKLGEFKLGGLYQNTESQTSDQEGDSFFLNVSYNLNGVNLKAEYGQDEAGFGSYYKNIKEATGTDVNITQITVGADYRISKSTLVYGHYAMYEGDHKVGTATVDLEDDNIFTVGARYDF

SEQ ID NO: 1636 - protein, 371 aa, Shewanella amazonensis
MKKSLIALTVLGAIAGAAQAQSSVTIYGTVDAGVTYSNNNVPANNANDGRLGGSKFGVGSGNIDTSRIGFKGVEDLGGGLKALFQLEAGFNTDTGGFEQDKSLFNRKSVVGLGGNFGSVLLGRQSDVLDDYGHQYTSVKDFGNFVGSPHVGDRLEGSRTQNSIRYNSPSFSGVTASAIYGFGEEAGANSNGQAFGGGVAYDNGPLGAYLGYYQSKAGKNSADTAPLFQLNPVAEGDTMNKTFSLGASYQAGPARLYGNWSRINVPEQYKQNIFELGTDYALTAPLHLLASVQHTQYSLDGNTEGNSSKPQVTQVNLGVDYYLSKRTDLYTLASYAKGKNGAPVGDYSAPAVQNDAGKSNQAAVAIGIRHKF

SEQ ID NO: 1637 - protein, 338 aa, Shewanella amazonensis
MMKKTLIAAGVAAAMAIPAIAAADVQLSAQLQAELFSVSGDPRNGTNMNGKGLYIGDAIEEGGDINSGNWSRVDLRASHDLGNGLTGYAHLSANPNITTGNALGASREVLVGLRGAFGDLSVGRMASAYGTAGKDPFNATFMQARGNGGQLGGFQGLGNGSYVNNAIGYKNKFEMVSLNATLGLDQSANTDALSEDNNGQHMYALRVNVDLSPVEVWVAHTNADEYGQATRTRPIDTNFQATKLGAQFKTGAFGVVGQYENIKHDTAGVDTNYAGNFYMLSGTYSMGCQHLHAGLRSVLRRERRPRPAVDRRWYASCLQPQCVHPWRCASDRVRSGCR

SEQ ID NO: 1638 - protein, 728 aa, Shewanella amazonensis
MITISRILICGGVTCCLCLFGYADEIGNETFSDTTESTKEKSSSSATRNVKLQKSIVTAASGSEKNVIDAPASVNIITKEELEQKPYRDLGEALKEVPGVSLDETSNKLGASAISIRGMPSGYTLFLVDGLRQNPSGDVATANLGAGVYNTFIPPMGAIERIEVIKGPMSTLYGSDAIGGVVNIITKPITDKWHTSFQSQIIVPQSSTFGNTYQNSLWTQGGLTKHLGLTFRVRQIHKNPSDRPKNDLGQDVSTFFGTKFSLLNVGTRLTWLPDSKNMLYADVDYTTSNYDNRKGEIGTLGVDVNGRGGYEKNVGVDKILGAIGHKGSYDFGTWKNTLQFMRTNNTGRLVAGNTNSPNIGKNRDIASNDVIADTRLLLPLGESNILNVGAEYRFENYYDLAATPASHNRHTFALFAEDEYNIFEPLTFTLGARYNHNDKFGSNISPRAYLVYEILDGFALKGGVATGYKAPYANQLIDAVYGYGSQGTLAFLGNPNLKPETSVSYEIGTIFDGRYIDFSLMFFRSNFKDKIENTRVNKNANGAFYEITCQNYGGTNTQCNLAINADSAFSQGVESSFGIKPIYGVGFDVAYTFVDSEITSGSNKGRPLSSVAKHNIVSKLIFTHKKFHLYVQGQHKAGLLNTNALGNTPDAIAIRNILGGTYYKPYTIVNLGLGYKITESIRLNGGVYNLFDTNFIDFRNYSASGNVNMHGAYIQEGRRYWANITLDF

SEQ ID NO: 1639 - protein, 245 aa, Shewanella amazonensis
MKKTILTLAAASAFTMNAQAEQYWADNSVSVLYSDQYEFNEDEATTTMTLEHVSGHSWGDLFYFVDRHNGGDYKETYGEFSPNIKLTSIDDSLVSSVKLAYTYEFGTFQTGDFNPGNPSFHSAFDNHLLGLGADLKVPGMDFTSVYLYRAFNDSSDSDDNQITLVYGYSNGNLIIDGFLDYSFGNENDSVEDEMNFTPQITYNVGPALGLKNKLKVGVEYSYWTNQFGIDGQDQNAVSLLVKAHL

SEQ ID NO: 1640 - protein, 196 aa, Shewanella amazonensis
MMKNMTYLVLSAVALVFAAGTAYAGGSGNGFYVGAAAVGSGVVVDSGGNTDKLDGDSNFSGGIYAGYKHRIFKGMFVAGEAFYHDTSQDETFSDGDRLELDSQYGVKTHIGYEWDSWSVYGILGAAALDYEITQNGEQTSDDHFRALLGGGASYQYNEKISTNLEVTTCGDEISIAGDKNKTMGLVTLRLGVSYHF

SEQ ID NO: 1641 - protein, 882 aa, Shewanella amazonensis
MRPSTFKKNVLATNIAFLLGSAVSMGAIAAENPVDEANMEKIEVRGMRASNKANINEKRFSNAVVDAVTAEDIGKFPDSDVGQALGRVPGVSVGRAFGQGSSVSIRGTDPLMTLTTLNGQNVASTGWYDQMNTDRSFNYSMLPSELVGGMEVYKSSQANLVEGGIGGTVIVKTRKPLDMEANSIFGSVKGEYGSVNEDWAPETSGLYSWKNESESFGILVAGSYIDRDYLRTGTEADLDWGGRSSIQPSSFLQEQERTAVDATIQFRPTDNLEFGAHILSMKLGADSIGANMYINTDTNWGAGDSNCHKFNAAGVCVVSVTPESAPTDVFFQNWARQGEMTSDSFELNADYQGDGFKLSAVAGNTKAEGGTQMSANFGYGWWGDNFGQVKWAGNVDATGKQIDINGRDMSFTQDQLDTTVGTSQWTGVQGPNRDEENYVQFDADFDLDMGILTKFETGIRYTQHEFEKSENKAVYDPTKTNSFNTSDLYSGTMKLGYDGWNVPKPNLNAMIDSTISLVDEFVYNRAAYGLIEEDNLSLYGMFSFDGEDFRGNFGVRYINTDVTSSGHVIDNSPADKLAVNSGWSEEIHSVSDDYSDILPSFNISYNVTQDVIARFAAAQAITRPNYDNLFLSSVSGYPDDRKGNEEITYGNPGLKPMKSSQFDISLEYYYGDGNLVSATYFTKDISNFIVATTDYNQSIGVINNDLDTPADDWTVNNFVNANDGKIDGIELQLLHAWDNGFGVNANYTFANGTAPAEVYTDSIGVFTESSEHTANLVGYWENDDFSARAAYNWRSEYMVREYGKYYGNRMHDAFGTLDVTLGWNITENIGLQLEIVNLTEEDDVQYGAASAGTKVKPALQDDFPTWSFKGETTYKLGASFRF

SEQ ID NO: 1642 - protein, 295 aa, Shewanella amazonensis
MKNVKMLALATTTVAAMSGTAFAADRGTDIHAGDYKWMQFNAMYSVDEHPIADGVDAKHDYLEMEFGGRSGVVDLYGYVDVFNLAKADSGDKTGNASKMFMKFAPRFSIDAITGKDLSFGPVKEVYFSTLYNWGGGAANKDGSGDVNMSFWGVGADVEVPWLGKTGMNLYGTYDINTKEWNGYQFSANWFKPFKFFDNGSFLSFQGYIDWQFAMDEKASGTNIDGKYNLTDNGGAFFLGLYWHSDRFALGYGAKYYNNVYGLNDRAFAGAPWAEPDWTGLNTTGWGHYLTATYKF

SEQ ID NO: 1643 - protein, 315 aa, Shewanella amazonensis
MMNAFCKTLLASALATATLASANAAEPLTVYGKLNVTAQSNDVADESETTIQSNASRLGAKGSFELSSSLEAFYTIEYEVDTGDEAKENFKARNQFVGLKGNFGAFSVGRNDTMLKQSQGKIDQFNDLSADLKNLFKGENRIEQTATYLTPTFNGFKVGVTYAAEAAKSQYAQDGFSVAAMYGDAKLKKSPIYASIAYDSDVKGYEVVRATVQGKVAGFKLGGMYQQQEETYSKTGEAVNGDSKTGYLFSAAYTIDAVVLKAQFQDMEDKGDSWSIGGDYKLGKPTKLFAFYSSRSYEGEENDDKFFGVGLEHKF

SEQ ID NO: 1644 - protein, 490 aa, Shewanella amazonensis
MSSLQILQGTFRLSDTKTLQLPQLTLNAGDSWAFVGSNGSGKSALARALAGELPLLKGERQSQFSHITRLSFEQLQKLVSDEWQRNNTDMLGPGEDDTGRTTAEIIQDEVKDAPRCMQLAQQFGITALLDRRFKYLSTGETRKTLLCQALMSEPDLLILDEPFDGLDVASRQQLAERLASLHQSGITLVLVLNRFDEIPEFVQFAGVLADCTLAETGAKEELLQQALVAQLAHSEQLEGVQLPEPDEPSARHALPANEPRIVLNNGVVSYNDRPILNNLSWQVNPGEHWQIVGPNGAGKSTLLSLVTGDHPQGYSNDLTLFGRRRGSGETIWDIKKHIGYVSSSLHLDYRVSTTVRNVILSGYFDSIGIYQAVSDRQQKLVQQWLDILGIDKRTADAPFHSLSWGQQRLALIVRALVKHPTLLILDEPLQGLDPLNRQLIRRFVDVLISEGETQLLFVSHHAEDAPACITHRLEFVPDGGLYRYVLTKIY

SEQ ID NO: 1645 - protein, 380 aa, Shewanella amazonensis
MNKTLIAAASATALFAPLAHAQSSVTLYGLIDAGIAYTNNVNGGSQWRMTTGTINGSRFGLRGTEDLGGGLKALFVLENGFNANNGALGQDGKLFGRHAYVGLSRSGFGTLTLGRQYDTMVDFVAPLSATAGDFGDTGFAHPFDNDNLNHSVRINNAVKYTSDTIAGFKVGALYGFSNSTNFAGNRAYSVAASYTNGPLKLAGAYLQMNGTKGSTSASPGATDVAEAKSVSQGGWSVGADRMRTYGGGVSYGFGPATVGFVYTRSQYDNSGSFGSTGQVAFNNYDVNVRYAVTPAVSLGAAYVYTDASVSNPDSKHGTDPKWHQVDLQAVYKLSRRTDLYAEAMYQHASGRGYQAFINTSGGASSTANQIVGTIGMRTRF

SEQ ID NO: 1646 - protein, 749 aa, Shewanella amazonensis
MLKNMKKLLLCILVGSLFLGEMNAQEVATMDGQVPDSLLKTFTMEEITVTGARGSMLQQVSEDDVRMLNPSQLSIYKVINMLPSLHQQSVDPYGLADISNYHESFRFRGVEATSGGVPATTANVEELPITGRPGGGASIYDLENFENLTIYTGGIPANKGHGLANVGGKIDMQVQRPGDGLDLQLKQDMGSSDWYRKSYVRVSSGDLPLGVGSFLSYSNTFMDKWKGDGSSTRNNAMFGLTKDFKDKLKVEAFALYNKSKIHTYRSLSYDQISNLSENYELDFSNDPNDLYYYDYNRNEFEDWQFFANIEFKPTASSTLSLKPYYWSDEGYYMETVTLSTGANMVRRWDIEHDVKGVLAQYKYSLFGADFDAGYLYHTQERPGPPTSWKLYAVQNGELVFKKWAVLSNKSNHEMHSPYLATKYRWGNVLVEGGLKYIYYKLPQLITYKTMGIGDVSYEDALATNPEIEDSASTSGSKIEKGLFPNLSLSYLLKSNLTAHVSYGKNYVYHVDIYPYFNSQKSKFYSKGITFQQIWDKKEMEVSHNFELGLRYIAQNWRIDPVIYFSIHKNKQAIFYDEELDATYPQNAADANGYGFEVEAEATPTSAIKCYASFSFNRFYFSENIYNSSGDLIDVEGNQVPDAPKFLLKGFVSYTISKFSFSPILRYTSERYGDIAHEEKIDGAATVDLDITYRDQIFGLKNLGVSLTFMNIFDKEYVSLINTSDYKTLGSSSYQVGAPFTVVASISLDY

SEQ ID NO: 1647 - protein, 919 aa, Shewanella amazonensis
MKKSYIWSAVKTALLVPTVAGLSMQATAQEASDDSNLEVIQVRGIVSSLKRAMSDKKEALIVSDGIAAEDLGKFPDLNVAESLQRITGVSIDRSGGEGQAVTVRGFGPQFNTVLVNGRQLATDSGGREFNFDVLAADQITGADVYKSTRADLQEGGIGATINVSTARPFDYEGFQLIGSVKGMYETLSEETSPSASFLVSNTFNDDKMGVLLAVSRQERDIQINTVGTAGWRPGQTISNRDDGVLFTNAYIPRNWDQAIDQQERTRTNASLVFQFAPSDEVNITLDGFVSKFEVDSQVTDLAAWFEPDRVGSATIDEATGTLLTFDQQIGLHGGSGDPASDFVSHTRNSRDSQSDGFGLNVEWDITPQLKGTFDVSTSSAENDRAGKDRFNVVGIINNYAFDGTSSVPSVSHDGFGGDSLPDASRARLHYNEKGLTFTDEDEINEFKADFVYLADSDVFQKAQFGVYRQEREKSAFQIYGSQCAFCGYGTPAPVDTIGFEAFTAKNFFPGYPETFYSYDGDAYIDFLAESGNPIEPTLQNNRYTINEDITSLYLDFTFMYDIGDMPLAVNVGARYAETDISVAAVQSFIKDVVPTTDLTLFANEFGPATDIQQGDSYSNLLPSVNVKLDLTDEMVLRFSVYDSMTRPTMSQLSPATVFNEPRRQNLTASGGNPSLKPFTSENWDLSFEWYYADASYFTFAVFSKEVEDFIVTLTGEETFTFSDRTSADGFRCNNDTGENLCAVGLALDDTRPDYDVVANTEELNGASEVYTVSRPQNTETTKVTGYEVAVTHVFENGFGVMANATVVNADTDFLEGLGDSQNLVVFYEQDNWQARIAFNNREAFLRNVDNGFNGEPVNTQTFGQWDVSASYDINENFTVFVEGINVTEEELVQTGRFDNQVYSVEDNGARYAVGVRAKF

SEQ ID NO: 1648 - protein, 416 aa, Shewanella amazonensis
MKLSPTLLGSALLVALAAPAAHAEIAIDVIGGSEMSLEGLVQADGNWFHNDVQDLNGPIGANGDNSEFSIRRAELVLKGKGPGNFEWVAGYDPSVLKEVTVRGTTIRSTGRFLDNNIKYKFGGNANNYLQFGQFKQPNSLEELSSTKNNDFVSKAAVTNTYGISRRLGVAYGMGDNNWSLTASAFGRELTRNQAHGSGYGARGTWAPINETGNVLHFGLSYLAYDTDDDTLRLRARPDADLTTVRLIDSGAITNVDNVGVAGAEAMWITGPFKLQSEYFQENANRIGANANDYKSDGWYVSGVWNITGETWGYKAGVPTTPLPNEPASGMWQLAVRYDTLDLNDGHLVANGNTPFVDGVLGGKMDVWTIGANWYWRSNFKFALDYAKVESTRYNSATRGLVDDNPSIIEARAQFYW

SEQ ID NO: 1649 - protein, 470 aa, Shewanella amazonensis
MLDIQTNNTNADSVIDTDTLELTSSNVADNNGNVYAGVFNIHSNDYTLNADLVNDRTWDTTQANYGYGVVAMNSDGHLTINGNGDINNGDEADASSTTDNVVAATGNYKVRIDNATGAGSVADYKGNELIYVNDINTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 1650 - protein, 328 aa, Shewanella amazonensis
MRPLPLLTVLALLAAPQARGAPPATVALLPATGSNVTDGQLAAAGDVLRAHLEATGRFVVVRAGGPAAGAEASPADAGAAARATGAALAVAVHVARLGETAIVRVAAYAPDGAVVHTDQLGALGVDDLDPALDRLAAGLARRGRAAELARIDTVTAREERPLRKMTAWMAYGMKIGSLVPVHRPDPAARAGSASGVGLVWHYDARDWLADVTLEGVTSNLDAWRPDPDRALALAIGVYKPFSRGNVAPYAGLGLAYAITRFGDVAGHGLQPRAIAGLLLGRLSNVAVRVEAGWFVDAFPVAERVTGRDVWVHGGLGSLTFVASEPTGR

SEQ ID NO: 1651 - protein, 696 aa, Shewanella amazonensis
MFTKSQLALVIGAVLAAPAVAEVQTTDEHLVVEGREFGYKADTNSTAMRMEMTQLETPGQVAVIDEAVIDEQRASTLGEVLQNDASVSAGGTSRNRERFSLRGFELSSSDGFLRDGRQHWSHYRQPIELLERVEVLKGPSGLLYGKSEPGGLVNMVSKKPTTETQASLSQDIGSNDHSRTVLDVSGALNEEETLRARAILAKESYGSWREYGDGTEPQTDRVVGGLVVEYDITEDIMVSAHYDRTKDDGSVDSGAYIVDGKPVRGDKYIWDAQWSNIDNDVENYGIDINAQVTDSVNVKAGYNRQDFKRFDVESYPKFDMYEEDGTIKHKGNERSDHWVFDTAYVDVTTDFSLFGTDNTFLVGANYLDYSYDRFMAFHDGEYVPAGETVAKPQPTSSKKWPTSEYDTWGIYAQNMMTINDYWQVLAGVRYDEKRSDELTESQVSPKLGVIFHPASNGSIYVQYSESFMPQGTVNSTDYTNDGEELDAERGISYEVGTKWELFDERLYVTGALFDITLENIALDVEDGVNAGGDVMYKKTQDGEQVHRGAEILAQGFVTEELSLTASAMYLDAEITESADYKGNRPADVPEFSASVWSSYKVQNNTNVNLGLIYEGERYGDAANTFKKDGYARIDMGVSYTHKYDENLDIVTRFNVENLFDTDYLAGGGSTNSKQDGASGVVIGEGRNYMATIQFKY

SEQ ID NO: 1652 - protein, 212 aa, Shewanella amazonensis
MATKNFSFIIALLFSFVFVNANTISNLEIDSSNLYKLPKNYYNINDLDDITKKTFKPSLYIAINGGWGQQTNMSKGGGTVVANLGYRFSESYAVEFVYQNFLVSQYNTTQVNNYFAGAAKYYYKINNYITAYAAAGLGIGYTNINGIANQRNAPASYLATNNTWGGFAVFPVGVMFPIKYVDNLSLKVTYTYSISFSGNSQNFVTSGLQYSF

SEQ ID NO: 1653 - protein, 1077 aa, Shewanella amazonensis
MLVLNFMYMKKSLFRFSSRRILFSTVIASALIAGGSQAVFADAGEVQVVLQTGTIKGKIVDSNGEPVIGANVMVKGTTNGCMTDIDGNFSLKDAKGTLVISYIGYKTEEVQVKGHETSLKIVLKEDSELLLEVVVVGYGSMKKESLTGSVTVVDQKLFKDKGTVSNPLSAMQGQVPGLRITRSSAAPGEEGWGVSIRGSVSKNKVEPLLIIDGVPASGVSEIAQLNADDIETINFLKDASAAIYGAKAAGGVILVTTKRPDAGRTKVEYSGSVTRKIVGLQPRMMSMDEWTDGVLQARLNDGYGEDDNWVRYARLAKAMKGSWINLHGGNNPDEDPIPGGFRGVADFVFHDMNWTDVLWGNATSTQHNLSISGGSEKSTYRLSLGYLNDQGTLQWGNNSNERYNVRLFNSFKINDRISLESNMSASRQHQVAPTQIGSILGSSIPQPGLPVSTIDGKPYAWGGIHTPNWSAELGGDNKLVVTTMNVNEILKVNILDGLDFQGTLGYSTNNAARDEQYLSIDWYQYDGTPIQNENSPYPAKEKSSYTKSSARTDNYTASAFLTYKKLFDEAHDISLMGGVQYDYAAYDYSGTKAMDVEAAIESLNGKGQIYIDKVDRWEEAILSYFGRLNYNYKSRYMVEVNARYDGSSKFLPKNRWNFFWGASAGWRITEEKFMENLRDYVNELKLRASYGEVGNQNGIGRYDGIQLYNYKSNSGALLGNSKGTYVESAGLVSTVRTWERIYNYNLGIDFGFFNNRFTGTFEIFKKKNDNMLVSRLHPGVLGGTAPSTNSGKFEANGYDVSLTWHDKIGSFNYHVGGTLTYMTNKLVDGGNIVVSAGYNEAVNGYPLNSVFGYRYVGKVQNQDQLDYYVDKYVGSNSIALPANLRLGDHMYEDVNKDGKLTQDDLVFLGSDDPKYSFSFNFGCEWKGFDFNTVFQGVGKRTIYREIDSWKVPFKAIWLNTTNQSVGNVWSPETPNNHFPTYSNSNDINNYNYIPSTWSADNGAYLRLKEIVLGYTLPKAWMNKSGFISNLRIYVSGADLWEKSYITDGWDPEATRKVENKQRYPFNRTVTFGVNATF

SEQ ID NO: 1654 - protein, 884 aa, Shewanella amazonensis
MMQFHSKFSFLLLLCLMHICIEAKGTEHDEPLVTLDMKQTPIRKVLAEITRQTGVTFSYESSLTKHLLPIDITITAQPLSHCLRILFQKLSVEYIQSGKYIILKKKQKNIVISGFIRDKSSSESLIGASIYDAKSHQGTTSNADGFFSLTLEAGNDVYLNISYVGYDSFHRSFIQLEQDTLLPVLLNSHQQLAEVVVTGEYTSSPLVQTSDMGHTRLNKDLIQQTPVLFGEADIIKTLQTLPGVSAGTAGLAGMYVRGGNGDDNLYMIEGNPLYQINHVGGLFSSFNAEAVKDVEFFKSAFPARYGGRLSSVVDIHTKDGNMKEYHGSAMLGLTSGSLNLEGPLVKDRTSFNFALRRSWIDALSAPTIAIWNATRNKGETQIVARYAFTDMNFKLNHQFNDRSRGYAGLYWGNDFLKGGEKREGDNGYESRNTGRLRWGNIMAFTGWSYVFNNQLFGNVNAAFTHYSSTLKGDYYQGTEANYVSQESSTQNRIDDLSIRANFDFRPNASHQLHFGTHYIYHRFHPVDEKSYFSNGMTTQTRQNNDTALPAHELGIYMEEDWKMNKRIRLNAGIHLGLYTIDGKTYTSLEPRFSSRFLINPQLSLKASYTRMSQYVHQVNESYINLPTDTWIPVSRKLKPMQSDQLAVGAYYTTGNKIYSFSIEGYYKWMKHLMDYKDNYQFLPPSTSWEDKLTQGKGRSYGVELIARKEKGKITGWAGYTLSWNDRQFTEINKGKRFPAKFDNRHKFNIIANWKIKPKLELTGSWTYATGNRLTVSFENYQAVSPQHPFPGGSLVPPYIDSGGLDYYTERNNFQLPAYHRLDLGINIYRPKKKNRMGIWNISIYNVYSYMAPVSIRKGWWYNNDCFYTLGIVPIIPSVSYTYKF

SEQ ID NO: 1655 - protein, 786 aa, Shewanella amazonensis
MLKTTHLLSSIALFALPMAAHAQEAPLDDAAPADEEIVVTGTAGGGISRQDAAFAITSINAEAIERAAPNSTADLFKVIPGVSAESSGGQNGANIFVRGYPSGGDAEFVTLTVQGVPFFSPPTLSFLENTQLIRIDETIERVEAVRGGTGALFGNGQPGLTVNFVQKEGGRDFEGLVKASITDFGDLRGDMLLSGPLGESTSFMIGGYYASGNGIRDPRFTAEKGGQITANVRHDMDRGSILVFARYLNDRGQWLLPIPVVRDGDKVRQFGNIDPGTGVLAGPETRLSLLPDGTRADLADGRGADLVNLGTNFDYEIGDGLQLRYRASYLKGDADTTGLVPASTATSADAYAASLGSTIGSLTYVNGGQAVAGSQPVIRAGTWIVRKQIEDFTNDLAVEWDSGNNKFTVGAYYSDFSSNDQWNLGNVQLLTAETNARLLNLVLANGQVATDRGFTQGSFFNVNAAYDGREYAFYAVDEFQVTPELRLDAGIRYQHYKASGTLENNDFGVNVDGDPDTLYDNGTAVLNGTFRNIAYKKGSWSWTVGANYDISSSVGVYARYNRGNTNPFFDNLRDGIFVSPRVDNYEGGVKVRTDLLSLYATLFHTRFRGLATTVITNGAPIASIGGARSTGVEIEGQIRPIDNVSIAFSGTWLDAKYRNFFADGGATDLSGNRVQRQPKWQWRVTPAYDIPFGNDGKVSLYSTFTYVGDRFSDTANTQSLPNYFKIDAGISVDVNQALSFAVTADNLTDKVGLTEGDPRQLGAGSQVVNARPILGRSFRFSAAYRF

SEQ ID NO: 1656 - protein, 791 aa, Shewanella amazonensis
MFRSRVLSGVSALALLAVCDDAAAQTAVQTLPGITVEAPRPAQASPRKKRTVARRTAPRPSQPRPTVAAKPSPVSIDSNLAILYQAPGGQTQTSIGRDQFDNRPSFSVADVLRDSPGISVKQGNGPRDFGISIRGSNARNGYGIRNLVIFDDGFPVTQPDGLSRSDLIDPRAYGAIDVIRGPSSALYGNYATGGALNFRTRRGAEINGIEYGLDAGSYGYLNNYLTAGKKIGNFEASLFASDVRGDGYFGNSWFNTQTVNFLGTLQATPDDRFTFKLINNMLDARIPIRSSLNQFDTNPFQRGCATAATAAPGCGTVTLFNNGFNATAGTDRETAEQAGLGRTDRRTIVGGRWEHDFDNQTTWRNQFVFDDRNINQPTGTTSAIGDYPSYNFMSDVVRRSQLLGMDATSYVGVFYNTLNWSGDTRNVMPGGNATLGRLSSNITGEHTNYGVRAREELRLTDSWTAIAGIGWETTHLKGINTAYAYAGPTGIATTAIKSADRQFQNTAPEFALQYRANKDWLFHARVATGYGTPQVGNLFVLPNGQNGNNTQLNPQKNLGYDLGFDWTPDPTLRVSATGFYEFFRDELVTQATPLGAPNSSYTFNAPKSEHRGVELLADWRFLPNWRVTAAYTYLDEIYTSYTENINNGATFGFNRAGNKIPGVSPNELTARLSYDQLSGSLKGVGAFVEFQWKDAFYMDNANLLKAPGYDLVNLNLHYDRPLQSDYLKSLHLFFEVRNVFDKTYVASANNIANSVTGAGIQNPASILANTGGSIYAGSPRTFIAGMRLAFR

SEQ ID NO: 1657 - protein, 349 aa, Shewanella amazonensis
MKQALTVGAALLLTTSMAQAAGLDRSGQGIGVIFEDGNSVELSFGSVRPSVSGSVALGATTQQSGNMAPDYTQFGFGVKMQVNDQISLALISDQPFGADVNYDTTPYPVVGSKAIVDSQGFTALVRYELDPIYSVHVGLRNVSAEGSVALVLPTAYASTYSSGSGSGYVAGVAYERENIALRVALTYSSEIDLALDGTAGNLTTTLPESYNLDFQTGIAADTLLFGSVRWVGWNGFALTDSLAGNLVSYTDDVYTYNIGIGRRLSDQFSASVSIGHEVSTGEVVSNLGPTDGYTSVQIGGAYDMGNGVEVSGGVRYVNVGDATTAIGSFSPEFTDNSVVAVGLKLAYSF

SEQ ID NO: 1658 - protein, 890 aa, Shewanella amazonensis
MTTQTTVARAVRFSLLALVSTSLSPLVFAADEAAVIDDKVERIEVTGSRIKRTDLENASPIVVVSAADIEKGGFNSVQDVLGNLSQNSGGSMTQQEVHGFTPAASAVNLRGVGAGRVLTLINGKRVPKYPFGAGGTDSFVDTANIPLGAIERIEILTTGASAIYGSDAMGGVINIILKKDVEQSTFKYRHSDTFDGGLQNNQFSFMTGVSSDKANLTFFAEYEDRQALKASDRPEWGTDIVSGNYYSSYSSYGANLVDSNGKLLKTLSAAECDARGYVMMANGKCGFDRSAQRDFSPEQKRYSTMINLTKNLNDNHQLYSRLDYTHASTYTEIESATVGEDFMFNVSGNNVTIVDELNGLSQVFDKNTAFGGDFAGAADGDYYYTRRMSELGPRTSDFETNNFSFLLGSKGYLTDSIEYDTSWSIARQTVESTTAGSPTYQSMWNYLTAGTNGNSLLDVISAEDAALLDFQGGKKGQSTLSSFNAGISGDAFELPAGTVAYAVGVEYGKEWFYDKSDSFTSNGGVIGKGGSSAQGEREQYAGYAEVAVPVIENLTVTLAGRYDYYDDLSDVGGQFSPQVAVEYRPIDNLLLRGLYAETFRAPDMQRLFGEPTAAYSTVIDTPTCEAAGGTGPACEKIDSLPITIGANPELEAETGKNYNLGMVWDYNDLNLTLDYWIVEIDNLVNSPSAQYILDHSDAFADKIFRDASGKLIQVNTQAINMSSQETSGIDFSVGYRYETSGYGDLSARLEGTYLLKWEEQLTPDSEPLDLIDGDGSAPQIRGNLNLGWNFDNFATNLLIKYTDSMNGQRKEAFINNGLADKYAVTIDSHVEVNWAASYMLTDAIKFSGGINNIFDAGPEIDETQNSWPHYPRSYYNVVGREYYLAVEMNF

SEQ ID NO: 1659 - protein, 785 aa, Shewanella amazonensis
MKVSRAIQLMSGLSAIALAAVPAGAMAQAAPDQAQAADAPTGGIGEIIVTAQKKAESIQTVPISIAAVGGEQLSAMNVTTLQALQGSVPNVQIDNFANTPNNAVFTIRGIGVIEPDPYAGNTVSIVVDGVPQFFSMGALLDTYDTNRVEILRGPQGTLFGANTTGGVVNVVTNQPDGKFDGYVKGTYGNWNRFDISAAVEAPLVEDTLSLKVSGIHTQRDGWTTNVWNGEDMGRKNVDAVRGQLYITPNADLRITLQGEYVAARNGAPIVVNGGLPGEGNYVPEGTFWNGAKLPMYQSPCSVEGQPCKAPDKYYSGNNEVPDQSDMTTKFFVGTIQYDNTPLGDITAITGYKRFTLFEYTDQDGTAKTNNATRRRTRGWQFSQELRSAFEAGDNFNAVAGLFYLKTHYNHYQMYHLDFALPGLVQYNEQDQGTESFSAFLQTYTQLTDQLKLSAGVRYTHDSVNARSTLDYGVGAPALTDPNWAIIPTIVVDGETLQVGRDLRTGPHDIDVGGKKSWDNVGWKLGLDYEIGQNQMVYASWARGFKSGGFTGRIGTASDGDTPYGPEKVDTFEVGLKADFLDRHVRTNLAVFYTNYRDMQVAQIYFDPDTNTQGNRILNAAKSEIKGFELEVQAIPFEGLTLRGSLAYLDTKYKSFLYFDPVAEEYLNLKGYALQNAPKWASTLGLNYTKTMDNGNSIVADVSWMYTGQKFYTAVVNTPRSSIQPTYYVDGMLTWYGPDKRYSIGLWGKNLFDKRYISTVYDSPGYMGLVGYAPPRQFGVSVGYNF

SEQ ID NO: 1660 - protein, 716 aa, Shewanella amazonensis
MSVFHSRRSLIALAVAQAFAFAPAAMAETSENVLPEVVVMSDSESDGIARNASVGGFSDAPLRETPASISVITHEQMQDRSIRSATDAVKYDASVQNAYNAVGLADWFSIRGFTLDMGSNYRKDGMVVLAHSMIPMENKERFEVLKGLAGLQVGMASSGGILNYVVKRPTNEPLRSVTLEASERGTLYGAVDLGGRSDDKRFGYRINAAGADIKSYVQGSNGERQFVSGAFDWRLSPKALLQIDLDYHHKSQLSVPGFQLLGPAQRIPTGVSAKTMLNNQSWSLPVTDDTNNLGIKFEYELNEQWHTTLQANKFELRRDDAVALASGCVAEGLSPGYCADGTFNMYDLRRDNDKRTVMSTQAMLQGKFNAGTIKHDLTLGMSTMNRRDNYANFLFESAGTGSIYYPKYNPLTLGPTNPVSLRRKDEERSVFVQDVLTLNDKFKLHAGMRYTQLQRTQFTSSGGLFRHTDKDFLLPNVALVFSPQSNWSIYGTYSQGLEPGAEVPSGLVNEETVLDPNKSRQVEIGIKADLSQDISVAAALFQIHRDNNYTSGLNYVTAGKEVHRGLELSAQGRATRNLTLGASMTTLQAFAENTGDARVEGKRIGNVPVLKSAVFMDYTLPQMPALKLNAMWIYSSSKVFAPNAQISELNKKVDGYHVLNVGAQYKTKVSGTKTTFRFGIDNVFDKFYWGDASNAYGGYLIPGAPRVFRLSAQFDF

SEQ ID NO: 1661 - protein, 211 aa, Shewanella amazonensis
MKLFSKDLFKKVTPLFLSVYFLNPTIMQAKSRFYVASQYQVGKMIMKKYNDLKRTIEGASFSLGWEINPTNYWFYSRYYFFMDYGNVILNKRTGAQANMFTYGFGGDLIVEYNKNPLYVFSLFYGMQVAENTWTISKHSANFIIDDWRSIQGFSLKTSNFRMLGLVGFKFQTVLFHHDASIEVGIKWPFAFEYDSAFVRLFSVFISHTFYL

SEQ ID NO: 1662 - protein, 650 aa, Shewanella amazonensis
MKAQISLAALAAALSTAPVLAAETTETTDDTIVVTGVRAPSLLERLSVTLDVIDRAEIDLKNQNTLVEALSATPGLAVVQSGPAGSTASVFVRGANSKHVLALYDGIRLNDLAASNGAFNFGSDLVGDAGRIEIVRGPLSSLYGSDAVGGVINILPRRAPESGSEVYGEASVGAFNTYHALIGGGVRSGRFNLAATAEYQESDGYDVNPSRISTATGDPDPSQFTVLSANGGFALTERLSIEALLRRRDSEVDFDTFSGGPSGFQRADDPDLRSEDDSTLWSLGLVYAHPGNAFESRLRAGRVDMTLDSFNDGLVTDQYDGERDFVQWSNAWTPDGLSALVDPVVSFGVEFQDETAETDTAFNAPLSVSEDLWSAYAAVQAGLTARFDVTGSIRLDDYEAFGSQTTWNLGAVYRLDALNTRLRASYGTSFKAPSLSERYSSSAFVAANPDLDPEEGKSFEIGFESAVSLLGREDALRFGAVWYDSEIEDLIEYVYDGALFIGQNRNVGEADLQGVEVFAEWSPVDQASLRVDYTYTDATNAATGAPLLRRPEDSWAVTGTWRPIEIASLSATWRYVGERLDATYDDDGFYASGAGRTPSYDTVDLTGVLDVYERVSMVLGVRNLLDETYEPVAGFAGAPRAVTFGVRVRP

SEQ ID NO: 1663 - protein, 1053 aa, Shewanella amazonensis
MGTKLRAALLFVLFLAPLFSAYAQSTTTRQITGTVSDEKGTTLPGAGVSVKNSKTAVSTSPDGKFSIIVPSGSNTILIFSFIGLATQEVVVGNRSVINVVLKSSATDLSDVVVIGYGNQKRGDVNGSISSVKAADIANVPQVSIDQMLQGKASGLTITQNSGAPGSSTSVRVRGVTSLSLSNEPLYVVDGVPISGDATNQATSGRTVGLSPNNGESAVSPLSSINPSDIESIDILKDASATAIYGSRASNGVIIITTKRGKNGTARVTYDGYAAMQQQGRFLDVMDLKQYAVLQNTLADVTGVQRRAEFADPALLGKGTDWQDEIFRNALMQNHQLGVSGGKDGTDYYISGGYLKQDGTILGSDYRRYTFRSNVNSQVKTWLKMGMSVSGSRSNENQGLSNNTGVVYNALLSAPDQAVRNPDGSFAGPIPNSNQQGGQINPVAQALDITNTLNRSNLQGALYADLQLTKDLTLRSELNGDFSYSAARIFTPTYQYGIYGNQTAKLQEYDSNNTYWGWKEYLTYTHTFNQKHNITALLGYEVNESSWGGKDASIQNFLSNDLQTLGLGDLKTAIIGEYKDSQALQSYFARGIYTFNNKYSLTATVRSDRSSKFADGKQTGYFPAFALSWRLSDESFMEGVRSVASAIKLRVGYGQVGNQNVPNYQYGSALTPVVTGLGTGFAIDKVSNPNLTWETAVQTNVGVDVTLLDDRINASFDYFNKTSKDFLFQKPLPAYLVGQTAAYSGIGVISPPYINGGKVTNKGFDFTLNSRNLTGNFKWNTTVVFSKYNNKVVSLADGVPFIDGKINVSFLQMTVTRTQEGGSIGEFYGYKVKDIFRTDEQLRNAPVQFGRAIENTSAGTWLGDIQYQDLNNDGKIDELDQTSLGNPNPKFTYGITNNFSFKSFDLSIFLNGSYGAKVLNALNYQLQGLSGLYQNQLASSINFWSSANPGANIPAPRGGDNPNLKNSDRFIESGSFLRIQNVNLGYNLPVNLIRKAKLARLKVFVSAQNLYVFTKYKGLDPEVGNQNYNVFLTNVDSGRYPTPRTLTFGINTEF

SEQ ID NO: 1664 - protein, 1006 aa, Shewanella amazonensis
MKVTRKSKRLLSILFVFLLPSHLFSQAASMPMEAPTEGEPVTEVQEDETDEGGNRTIKGIIYDEQGETIIGASVLIKGEETTGTTSDMDGKFTLSVPQGSTLVISYIGYHPQEIKIRKRTALHVILKEDNQLLEEVVVVGYGTVKKSDLTGSVSGVSTRQFKNQPVKRVENILQGRTPGVEVTATSGVPGAGMKVRVRGTTSINKSSDPLYVIDGIISSSGLDGINPSDIQSMEVLKDASSTAIYGSRGSNGVILITTKGGSEGKASITFDASVGLSTVRKQYDLLNAYEYATALNDIRGSSTISAEDLEAYKNGTKGINWADLITHTGITQDYRLSISGGNAKVKYLISGNMLDQEAVTIRTDYKRYGIRANIDADVKPWLTISAKMNASSLHKHNDGANWFHITNFSPTMEMKDPETGIYNRDPYNIANGSNPYGELMVNYSDSYSYNLNANLTLLFKIMKGLTFSVQGGYDYDHSPSYSFKSKLEAPGAINSMNNTSNMHNYWQNTNNLTWQRQFGDHNVTAMAVWEISRSWDTGLQGTGSNLNNESVGYWNIANAAIRNASNSYTEASLASGIIRANYDYKKRYFITAALRADGSSKFQGNNKWGYFPSAAVAWDIAKEKFMSNQHILEQLKLRGSFGVTGNQDIAAYSTLGMLSGATYGWGTSNAYTGYWGNQFPTPDITWEKTYQYDLGVDLSLGGFNITFDWFKKITKDLLFQKQVPKYNGGGTYWVNQGELKNTGVEFSVNTFPVKGTVTWETGFNAAYVKNEVTDLAGSDFVLTANYSDLGGAMQIMKPGYPMGSFYVYQWKGFDDKGANLYQKADGSLTTSPTSDDLVVKGQASPKWTMGWNNTISWKNWTVNIFFNAATGYNRLNISRYTAASMTGNSRFVTLRDAYFKGWDHVSNKAEAAYPSLTNTESKNYANSDFWLEDASFVKLKNVSISYRIPRRVAKFASIQLSVSAQDLFTITRYKGMDPEVYTSYDGLDYGAYPIPRTITFGAKIRF

SEQ ID NO: 1665 - protein, 1012 aa, Shewanella amazonensis
MVADRLRKVDPRTTTREVINMDVNVHQLNVLAAGVFLAFAVNLPVGAQAAYQETGRPGDAASWRSAEYLQDWGLDRMQANQAYAAGLTGSGVKIGALDSGFDAAHAEASSLRFHPVIASGNYQDGIGFQVSGVLNANNDTHGTHVTGTMGAARDGNGMHGVAFNAQVYVGNTNGNDSMLFGPGPDPRYFQAVYGALADAGVRVINNSWGSQPKDVSYQTLQGLHAAYAQHFGQDTWLDAAAQVSRQGVINVFSAGNSGYANASVRSALPYFQPELEGHWLAVSGLDKNNQQKYNQCGIAKYWCLATPGAAITSTVPGGGYATYNGTSMAAPHATGALALVMERYPYLDNQQALQVLLTTARQLDGSLTQAPGSLVGWGVPDLGRALHGPGQLLGEFKVNLEAGQGDVWSNGISDQALAQRQVEDAAEHQAWQQTLKDRGWEQGPGAQASQQELTDYAVGMARDAAAAQRLYQGSLVKSGAGWLLLGGDSSYRGPTTVDGGLLVVNGSLASAVTVNSGASLGGSGQVAALTATRGARVAPGNSIGTLNVAGDVSFQPGSTYAVELSPTASDRIVAGGRAHLEGAQLSLSLEHNANLLSAGQVRGLVGRQFDILQAAGGIDGQFALVQPNYLFLGAVVDYSASGVQLGLVRSAATFASVAASPNQRAVASAVEQLGTADPVYESLLLSASPASAQGALQQLSGEIYPALEQTLLNQGRDLREAFGQRLQRPGPNAGEGEASFWIKGLGGQARTDGDSGHSSYQGKGSGVLLGLDRDLDADTRVGLAAGYSDTSLRMGGASHSSAQIDSYHLGAYAGRDLGDLRLSLGASHSWHSAQVRRDLQYAEASAKQKARIDGRSSQLFSEAAYRLQLPALTLEPFANLAYLHLQRDAFHEKGDAAALRAGEDSAEALLGSLGARGLKRLSLSRGQPLELSSSLAWQHRLGHDTSSQHLAFASGGPGFAVDSASASRDAALLGLQARLGVTAQLDLSLDYQGQLGNAEQFHNVGLNLDWRF

SEQ ID NO: 1666 - protein, 431 aa, Shewanella amazonensis
MTRTKTLSYQPARWVLNLGIASFLLVGAATQAFGQDASAAERTASGQGYLPILSGADRSAETSWHLAGYADASFVFTDQDGGDSSSQFTRVRFNPAFHFQYQDLILFEAEAEIENTDEGTEFTLEYAQANILAHPNAVVVLGQFLSPVGQFQERLHPSWINRMADAPAGFGHDGVQPGSDMGVMVRGGFNLEPGLLTYSVALGNGPRVSHEGGLALEAFNTDDNDDKAISGRVGFLPMPGLEIGASFLSGRVSGVEAEEEEGGHADAKPFDKLGSETEEDDHGLELSDADVALWGFDVAYTGGAWDLRAEYLNSTRDPINTGFEGAEGIATLPELESTAWYVQAAYRLSGTAEQPWLGRVEPTMRYGEYEVEGLDELAEEAAEQRWDVGVNYWLAPSIVTRGVVQQREFTARHDDDVQEETRVLLQFSYGF

SEQ ID NO: 1667 - protein, 367 aa, Shewanella amazonensis
MNQTASHRLLAAGLLPFVALAALAGTNAHAEPGVTLYGIASSAVRYTSNLDGHHNGQAALVSGGMVGSRFGLKGDEDLGGGNHVIFRLEAGIGSDDGRSSYNMLFGRQAYAGLSGDWGSLTFGRQYNALNNIGWAFNPLDQGWGNFWSDPLYIGGDIFFQDYRINNSMVYKKTAGPFTLQLDYGTGEQPGSLARGITLGGGLMFQQGALALGAAYDQRKSADGGNTVRNYSVGGSYAFGKATAYLGHMGRRESAGDARFNIAFAGLGYQLTPALHVSGAYYRYWQGGNVTTQFQDVPALLGSGNADSIAVVADYALSKRTSVYLEADAVHARGGAVGRETEYWAGAPAAGVDRTTRVGVMLGMRHHF

SEQ ID NO: 1668 - protein, 879 aa, Shewanella amazonensis
MHMSQETPASTTEAQIKNKRRISPFWLLPFIALMIASWLIWDSYQDRGNTVTIDFMSADGIVPGRTPVRYQGVEVGTVQDISLSDDLRKIEVKVSIKSDMKDALREETQFWLVTPKASLAGVSGLDALVGGNYIGMMPGKGKEQDHFVALDTQPKYRLDNGDLMIHLQAPDLGSLNSGSLVYFRKIPVGKVYDYAINPNKQGVVIDVLIERRFTDLVKKGSRFWNVSGVDANVSISGAKVKLESLAALVNGAIAFDSPEESKPAEAEDTFGLYEDLAHSQRGVIIKLELPSGAGLTADSTPLMYQGLEVGQLTKLDLNPGGKVTGEMTVDPSVVTLLRENTRIELRNPKLSLSDANLSALLTGKTFELVPGDGEPRKEFVVVPGEKALLHEPDVLTLTLTAPESYGIDAGQPLILHGVQVGQVIDRKLTSKGVTFTVAIEPQHRELVKGDSKFVVNSRVDVKVGLDGVEFLGASASEWINGGIRILPGDKGEMKASYPLYANLEKALENSLSDLPTTTVSLSAETLPDVQAGSVVLYRKFEVGEVITVRPRANAFDIDLHIKPEYRNLLTSNSVFWAEGGAKVQLNGSGLTVQASPLSRALKGAISFDNLSGASASQRKGDKRILYASETAARAVGGQITLHAFDAGKLAVGMPIRYLGIDIGQIQTLDLITARNEVQAKAVLYPEYVQTFARGGTRFSVVTPQISAAGVEHLDTILQPYINVEPGRGNPRRDFELQEATITDSRYLDGLSIIVEAPEAGSLGIGTPVLFRGLEVGTVTGMTLGTLSDRVMIAMRISKRYQHLVRNNSVFWLASGYSLDFGLTGGVVKTGTFNQFIRGGIAFATPPGTPLAPKAQEGKHFLLQESEPKEWREWGTALPK

SEQ ID NO: 1669 - protein, 1039 aa, Shewanella amazonensis
MYKAITFKKKLLATAVASVAISGVSSIAYAQSNAVEEVVVTGIKSSLERSVDIKRTSSQIVEAITADDIGKMPDQNVADSLQRVPGVQIDRAGGEGTKVRIRGLGNNLTLLNGEAFVSGMEYYQAGEGRTEFDGSLEGVPSELLGGVEVIKTARASDIEGAVGGIVNLKTRSPLTLKEPVIAGNIKADIGDVSDDAQPSATLVLGNSWDNFGAIFSISAAKKTVQVDEAQNLNRNSFGWHGTDVDLTGSGTVGDDNQWYVVPGMQYETDKQFERERVGTSLALAWAPSDNSEITLDWFHSSLDIDDRSYSMKYTLNTDGGALLQNMPYTIDRNGVITSGSFSTSGENNSYRDITEITTDNLKLGFKVDASEQWSFDGALSYASADLKKDAAFADARYQPYSVRRLVDDAWEGSAPNISSTVGQGDRYISISQGSSGTPNWSLSPNAYAALQDPESFLYKSNWAYGDRSTNDSFALALNATYNIEFGDVKNIKFGIRQSNNEVDFVEGHYQVDLSCSNPYDPSSGTLATDGSVQGVGACIPDGHNLGDVDGDGISDNQLWGPTTRYVDANIDNPLYGSLTSNGSDLGFLLTGINASRWDGTSPGIIPWHTFVDNPTTGAVGKPGYYVRLNDFFPSGGAISSGLFVDPSKMSNPAAWLSSMAAGAPTRWYEDKVQSWNVDRDVTAIYTEANLEGDTVPYTLNVGVRVVRTETTTTGGQTTPDDIYSGTDSWNGPVLVQGTFSVKKTYTDILPSLNFSLDTADNQKVRFAMARVMSQPNAQDLGHGANYNFTRNDARGGYEFVNGTVGNPRLDPFRATQADLSYEVYLDSLSYLSVGTFIKAVDSFPAGISTPTEVADSTNEGSTVGQVNSTINGSGGIVKGFEIAYQMGFDNGLGFAVNYTYSDSKTDLESETNKALPLPGVSENTFNIVGFYEMDRIQARIAYTWRDEYLSPDYTLEQIAGVDAADGTVLKPISQFASFYDAYGQLDLSLSYDVTENFALTAEGINLTSEEQRRYIEYTNFFRSNTAAERRFVLGAKYKF

SEQ ID NO: 1670 - protein, 446 aa, Shewanella amazonensis
MKKSPLTMAIISALAFGASAMAQASESQVAEGFIEGSSLNILNRNMYFNRDFRKGGARVLPSGERSSYTEAWGHGIMANFESGFTQGTVGFGIDAYAGLGLKLDTGDGRYGPGGSVNMFPVDSDDRAEDSYSKVGAAVKARFADTVVKAGDVFPTTPVVHYGDSRLLPQSFKGVTVVNESIEGLTLQGGRLHAMSQPQESTSRGDFATFYAGQVDSPWVGYFGGDYELNDNLGFSLYSSRLKDAWDQYYAGMWWTYPLSEDLSLFGGLNYYNATDEGKKQLGDFSNNIYSGSIGVKYGAHRVALSHQRNNGDDDFDYLRQSDSIFLDNSLQYSDFNSPKERSWMVRYDLDMADFGVPGLSFMARYALGRDADYSNANSIYMRTDGAGNPLTDQKRWERNLEVKYVFLEGSLKDLSVRVRQMTTRATAYESDLDEVRVIVEYPLQVL

SEQ ID NO: 1671 - protein, 938 aa, Shewanella amazonensis
MSSSRTAVVPKRGVLQTTRLVTAVSFALAVAAVPAAAQQRGDGADDATQTLDQVNVTGTHLRRVDAETASPVVVIDRQRIEDSGQNTLGQLLQRLPMMAGFQAGPALNSGFSHGRALVSLRNLGPERTLVLVNGHRMAGPASSVASAPGVDVNAIPAAMVERVEVLTDGASSVYGSDAIGGVVNVILKDRYDGFAATVDYAQSTHGDANRRTLGLEWGKTWDRGGLILGLSRNSMNPVFNRDRSYAAKAVEYLDGQVSEIRGGNTRAFLTDGRRVTPVDGVRPGPVGQDAFRPYQPATDSYNVYDAQYLITPIKRTNASLHGSFDFTPGVQGYMDVFWTRSKTISRLDAYAMEMQDAVDNYYNPFGDALDRYLLRSTQANTRVYTSTMFQTNVVAGLRGRVDGSSWQWDAAAGYARYKDTLVRTGFSITSALNNAVGASFLDSDGVVKCGAPGAVIAGCTPINIFNPNDPATIAALRDTQRPVDLIDESQMRFVDISANGDLFKLPAGMVQAAVGLVYRTNKFAQGTTSDVAAADADGNCDYNDGCILKQGREESVREAYAELLVPLLRDAPFANVLNLNLGSRYSNYDAWGNTTNSKVAIEWRPIANLLVRATGSQVFRAPALGDLYGSPYNSVVDNTGDFEDPCTGFTGAPNPACANVPNDGSYTNTAQFNVVTSGANNVGFKLKPERGRSYNVGLVYDPDRVRGLSLNVDSWRVVLDDMLTGVGLQQVVSDCFDGSEAAFCPLIQRDANGQLTRVSVPFAYNSGKVDIRGYDAGIHYTLADTAWGTFAMGLDATFFSSYRFAGDPHNYVGENSSWGNMPRWRAVANLAWDNGPWHASWNTRYLGRTVNGSQYEDFCADTNADGSCAYFRIGSVVYHDASLSRKIASLHSTLAVGIDNLGDRKPPRFYSYSNAANTEASTYDTLGRYVWSRLRVEF

SEQ ID NO: 1672 - protein, 676 aa, Shewanella amazonensis
MKLKALSVAVTVALTSFTALAADETETVVVIGSALDQLVQTEINSDILEKKQASDIKDVLNTMPSVTVDGNARYSRKVFVRGMEDKFSVVTIDGARQEGQLFHHSGDQAIDPAMLKRAEIELGGNSALSGSGAINGSFSYETKDPSDLLKPGESIGARVKTSYQTAYERFATNVAVYAKVNDKLQFMGIANYSEDGDLHIPDQEAVTSKQGELKSGLAKVVFIPNDANEFKLTFNRYNDGGKRQLSGEKAGALYADDEHNYHSLNRDTVTLQHEYDAGSDLVHLKTNVYYNRQYMERDALVDTAWDKDANGDWIKDGKIAIPDREYNVTTIGGDIRNISWVGEHELTYGLDGYKAEQWIDAGDGVYQSGSKQGETKKYGMDGGTVTAYGLYVQDMYEFSDFRLTTGLRYDVHKLGGVYTGDFDQLSPKFKGEYQTTDNLKLRVGYGRLFKGASLPETLTMKAAPDVDQSDTKAMTGNNYEAGFDYELTRLLAADYAILGFTAYTYNLDNQMHPTKNNSTLANQYDVEVWGVETVLSYELDALSVYANHSYSDGEQKSLKNGKTSHMNKTGIHNFKAGFNYSINSEFVFGWDSRFVPGNDYTDEDGDEIKRAGFATHNIWAAYTPTFAKDLEVNLGVDNLLDKKYAEHTGFGISWGSDKYTSYEAGRNFKASIAYSF

SEQ ID NO: 1673 - protein, 704 aa, Shewanella amazonensis
MNKLYCYSSTKRAMQRSSMAAIAVAVAFPAQAQEAQSDGLAEIIVTAEKREENLQSVPVSVTAMTGEALTATGISNVEDLQFFVPGVSITNDSMAIINIRGIGTSAFGVATDPSTTVHYDGVYISRPTTNYQDLFDVERIEVLRGPQGVLFGRNSAGGTLNIISKMPTEDLTGALGLTVGNYEKRSLSGTISGPLGAGVRGRLTLLANQRDGIYRDVVSGRRYQNEDNLAGRLTLAIDASDRLEIVLRADASRDRETGARSVRPFYPQGFVDAGATIPANDKEAALDRLPRYDVDAWGVSSTMNWDGGPVTLRSITALRKSKVVQALDVDSTDLFLRDIEFYERSRSFTQEFQLLNNDADKLRWIVGAFYLNEKGNDEIRIIEPGRRLAIPENNTTNAFALFGQASYELIDRLRLTGGLRYSYEKKDFGYRVLLNGNQVDAGQPKSSWTAWTPKIGIDYDLADDVMAYASATRGFKSGGFQLGDGRPFLPEYVWSYEVGLKSTLLDRRLRANFSAFYYDYTNLQVVEYNNGVASTTNAGKATIKGVEAELMARPFDRLTLTSTIAYLDARYDVYFDDVGASLKGKRLPNAPKWNITLGGEYKASLGGGMLTLRTDISWRDSIFFKPSNNPLFSGNATTLINGRVAWQPASEAWEIALYGRNLTNERYVSYSTIGTDATGVSNPTLPLYIYGEPRQYGLQLRYFF

SEQ ID NO: 1674 - protein, 459 aa, Shewanella amazonensis
MSLKFGYKALSLAVFSTLTATAAQAAGLDRSGQDVTAFLQDGTYAETVYTYIDANVTGKDTAGKDTGDIAEAYDFFRYGVKADINDTFSIGVLYDEPFGAAVQYDGNSNFVADKNATATIFAQAINQATKAQLNDSLAYKSIKPVLDSVKSPQRALAVASIVETNSAQAKPIADRLRAAAAHAEATDGQKTNVEIRTNNLTMLVGAKLGANKNFQIYGGPVAQRVKGEVHLRGPAYQVMTGYDAKIATDTQLGWAAGLAFYKPEIALKAALTYRSEIEHDSEIAETIPVTGYAGKKDFKVTLPDSWNLDFQTGVNPTTLLTAKVRYVPWSDFDIRPTQYTETTKLRYPQGLPIISYDKDQWSAEVGLGKRVSDRLAVSGAVGWDSGAGNPASSLGPIKGYYSLGLGARYNVTPEWSLSLGGKYFKFGDAQAQLPTKDKVGNFDSNDGYALGVKLAYHAK

SEQ ID NO: 1675 - protein, 310 aa, Psychromonas ingrahamii
MKKTLLATLILSSFVSGAASAATVYDKENTKLSIGGRAEVRALFSDAVDGSMLDKSRARINFEGQTKISQDLTGFAFMEYEIEPGSTVNNRYLFAGIGTKAGDFSYGRQDSASVQISNMTDIASYHSGAQQIIAAASDKESNNFVFANNSIQGLALKANYIANGVKKTATSTTPEDAFGLSALYSMDMGIDLGVSYAEQDKQDQVTLGAGYKFEDLYLAATYAMGSKATNNDFTSLEVAAQYKLTKEFRMIAMYTMADQDLSGVTTDTADSVALEGQYRFNDSLRTYASYKLDNLTGGDDELVAGLRYNF

SEQ ID NO: 1676 - protein, 324 aa, Psychromonas ingrahamii
MSKMNYILPLALLISGVVNAATENPWYAGARVGGTSYSGLSIDSRSSDIDKEDWGGGAFLGYNIVPWFAVEGGYTYLGEMDFKADDASIEQQGLDLVGKFTWNVTNSIDLFAKAGGFYYFTDGSGAISGSDDGIIGTAGVGAEYFFNKNLSARLEYQYYNDLELKDASWDTHFYGISLVYGWGAPVPVAVVEPEPEPAPVPVMVQVEPITVALPFAFDSDTLSQQDIDQLQPIAQRLVNFPETELFVIGHTDSRGAEAYNQNLSEERAAVVAGYLATHFGIEQSRIQAQGRGELEPVATNDTEDGRGQNRRVEVFTPGFEMEGQ

SEQ ID NO: 1677 - protein, 708 aa, Psychromonas ingrahamii
MMKAALIVSVSGLAFAATAFAQNEEDAPEDDVITVYGTSNPIPAIDYPGQVSVIDRSEIDARLVSTVSDALRDVPGLQFSGGPRRTGEVPTLRGLSGQNVLVLLDGARQSFLSAHDGRFFLDPDLIARAEVVRGPASALYGTGAVGGVLAFETVDADDLLTADETFGARFRAGYQSVNEEGAGTVTLFGRQGRLDGLASLTLRQSGDITLGSGADLPSDDDILTGLLKGSFTATDALTLEASWQRFDNTAIEPNNGQGTSGLDDGAINVEKEIVTDTFRIAAAFNPSSDLIDARLTAYWTETTVDEFDDSVPQLLTRDVETTGISLRNASRFTLGGLDLTATIGGDWFEDKQIGTDDQTEDFTRGGVPNGSAEFVGVFGQLEAILDRPLGLPGELIVIPGVRFDSFKNSSEAAGTDNEDEAVSPRIAASYGPSDWFRVFGSYSEGFRAPSLNELYLDGVHFPLPHPILFDPAGMPPNFTFVNNNFIPNPDLEPEKTATTEVGIALDFASVITQGDRFQAKLSRFESDVENLINLSVDVAFDPTCFAPPFFPCTAGTTESANVADAGLTGTELEARYDSDLFYGYLSYSSIDGEDEATGADLGTLTPGRLALDLGYRTQGIGATFGTRLQVADEFTRRDLVDGELEIAEERDGYTVLDLYATWVPPFADSFRVDLGVDNVTEEDFERVFEDVSEPGRNYKASIAYRIAY

SEQ ID NO: 1678 - protein, 822 aa, Psychromonas ingrahamii
MKKAIKLNLITLSLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLGVNDVITDDKPFGIILKGMTGSNATKSNFMTTAAGRKWLDNGGYVGVVYGYSQREVSQDYRIGGGERLASLGQDILAKEKEAYFRTAGYVLNADGQWAPDLSKKVWYCHGDKTSPANKNYNGDCKGYNVDPKKEVRKKILKQLDEGKKPQDIQELQGNESGNFGVKPTDKSFEDNKEQYSVAPIEPGSLQSRSRSHLLKFEYSDDHHTLGAQIRTLDNKIGSRKIENRNYQVNYNFNNNSYLDLNLMAAHNIGKTIYPKGGFFAGWQVADKLITKNVANIVDINNSHTFLLPKEIDLKTTLGFNYFTNEYSKNRFPEELSLFYNDASHDRGNYSNLGRFKGAKSLLPQRSVILQPSGKQKFKTVYFDTALSKGIYHLNYSVNFTHYAFNGEYVGYENTTNKDKDNEPILHKSGHKKAFNHSATLSAELSDYFMPFFTYSRTHRMPNIQEMFFSQVSNAGVNTALKPEQSDTYQLGFNTYKKGLFTQDDVLGVKLVGYRSFIKNYIHNVYGVWWRDGMPTWAKINGFEYTIAHQNYKPIVKKSGVELEINYDMGRFFANLSYAYQRTNQPTNYADASPRPNNASKDDILKQGYGLSRVSMLPKDYGRLELGTRWFDQKLTLGLAARYYGKSKRATIEEEYINGSRFEKMPCIVKITMP

SEQ ID NO: 1679 - protein, 358 aa, Psychromonas ingrahamii
NDASDVQWWAERTLGFKTSWSAPEDTPETCEGSYTWNANLCPRVDPEFSYLLPIKTTGKSVYLFDNFVITDYLSFDLGYRYDNIHYQPKYKHGITPKLPDDIVKGLFIPLPNNSNNDDEVKKNVQQNIDYIAKQNKKYKAHSYSFVSTIDPTSFLRLQLKYSKGFRTPTSDEMYFTFKHPDFTILPNTDLKPEIAKTKEIAFTLHNDDWGFISTSLFKTNYKNFIDLIFKKQETFKVGGSGKGETLPFSLYQNINRDNASLKGIEINSKVFLGKMAKFMDGFNLSYKYTYQKGRMNGNIPMNAIQPRTMVYGLGYDHPNHKFGFDFYTTHVASKNPEDTYNMFYKEEGKTDSTIKWRS

SEQ ID NO: 1680 - protein, 682 aa, Psychromonas ingrahamii
MPRLVLTHLLGSVAGLAWVSGSGFAADAQDSGSLRDVVVVTGTRSEALQSQSPLATAVLDREEIQQIGAHHVSEALNRLPGVNLHRGNGAEHLTAIRSPVLTGSQGAGSFLYLEDGVPLRAAGFANINGLFEAADSLAGRIEVVRGPGSAAYGSNALHGLVNVLTPEPETAGRTVSLEAGSYGRAGLRASLGGDTRFGSGWLGLGLRHEDGWRDDAALDRRVLQARLDGRSAQTDWSLRVSAVDLEQETATFVNGFRAYEDEGASRRNADPEAFRNAYALRAALHLERSLSETLSAQTVLFARSNDMQFRMHFLPSEALEDSGHDSVGIQSALVWTLDRSVIRLGVDADLTEGVLSEIQTRPTLGPFVQGVHYDYEVSARTLASFLMAELQVTPRLRLDAGVRWEGTRYDYANAAPDGVVGRYLRLPDRQDSFDTLAPHAGWIYTVNDVVSVFGRAARGVRAPQTAELYRLQPGQSVEGIEPETLDSLESGIRLNSTSGRYRVELTGYVMRKDNVILRDADGLTVTGAKTRHHGVELEAGVSLTDQIRLQGAVSWAVHEYDFNGGASAGSEQIRKGARIDTAPEWLSNLRLIWDATDRLRFETEWVHVGEYFADAGNTALYDGHDLLHVRAAVEVRDNLSVYLAARNVLDERYAERADFAFGQYRYFPGEPLTLNLGVRYGF

SEQ ID NO: 1681 - protein, 365 aa, Psychromonas ingrahamii
MKKTLLATAVAGALGASAGIAQAATIYNQDGTQLDLYGNIQLAYRSIDNENGDAEDDLFDNGSTVGFSGQHVINPGLTGYFKAEFEHDADEEKTGAGLDTGDQAYLGLKGNFGDARVGSWDPLIDDWIQDPITNNEYFDVTDSTSDLGGLYGGSTVDAVDTDREGDKIQYMSPSFGGLQFAVGSQYKGDAEEEFNSDNGTANVSSNGSNASFFGGLKYTAGAFSIAAVYDDLDNYDLRDETTGDEYSAKAYGVNAQYTMDALRVSAKVENTDVDYAGENGDIMRYALGARYGYGFGDIYGAYQRVDADEEVATVVDSGGDDSFNEFSLGATYNLSPAMYTFVEYAQYDRTNDEGDGVAVGAVYSF

SEQ ID NO: 1682 - protein, 883 aa, Acidovorax avenae
AENVQAGQAQEKQLDTIQVKAKKQKTRRDNEVTGLGKLVKTADTLSKEQVPDIRDLTRYDPGMLVEQQGRRATSGYSIRGMDKNRLSLTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRRAGEIRAHEDAGRGVQSFNRLVRLRIPSQYANFNVEEECEGKYYETCKANPKKDVVGKDERQTVSTRDYTGPNRFLADPLSDRSRSWLFRPGFRFENKRHYIGGILERTQQTFDTRDMTVPAFQTKAVFDENKKQAGSLLGNGKYAGNHKYGGLFTNGENGALVGTEYGTGVFYDETHTKSRYGLEYVYTNADKDTWADYARLSYDRQGIGLDNHFQQTHCSADGSDKYCRPSADKPFSYYKSDRVIYGESHRLLQAAFKKSFDTAKIRHNLSVNIGFDRFGSDLRHQDYYYQNANRAYSSKIPTQNGNQNISPNGQDKTLLGQHRRGNVVTGQICRLGNNTYTDCTPRSINGKSYYAAVRDNVRLGRWADVGAGLRYDNRSTHSDDGSVSTGTHRTLSWNAGIVLKPADWLDLTYRTSTGFRLPSFAEMYGWRSGDKIKAVKIDPEKSFNKEVGIVFKGDFGNLEASWFNNAYRDLIVRGNEAQIKNGKEEAKGDPPYLNAQSARITGINILGKIDWNGVWDKLPEGWYSTFAYNSCRVRVRDIKKRADRTDIQSHLFDAIQPSRYVVGLGLDQPEGIWGVNGMLTYSKAKEITELLGSRAKLNGNSRNTKRTARRTRPWYIVDVSGYYTIKKHFTLRAGVYNLLNHRYVTSQNVRQTAAGGRRYAAPARNYTFSLEMKF

SEQ ID NO: 1683 - protein, 822 aa, Acidovorax avenae
MQAGPGSSHADDRRSAARAMPSRLRESTSSEQSEAGGKRSGPRGADDSGACGVRSGGGGGRGNPSMSRAQHAPSRRRAFERSFAAAAARAAHGAPAAHGPHACLAAASRRSTAVERCVTALACAVTASGALAADADPAESARDPHRELPTVRVTSDAAHASPLSTPLTAGSRLKLASLDMPASVEAITSGQMAARGDRTIVDAVTRATGFSTAAAPGNGGTALSVRGFAGQESVTTLVDGVRLYPGAGTVTFPFSTWSAERIEVLRGPASVLHGEGAIGGVVDVVTRRPRRERSTTLQASIGTQGEKRVALDTTGALGPRLSYRFHLSDERTRGFVERGDAHATAVGGALKLDVDSRLSITLDYDYGRQKPATYFGVPAANGVLDRALRERNYNVGDATIAYHDTWTRLAATYRAGNGVTLDAQLYYLATRRHWRNAESYALDAAARTVARSDYLEIFHRERQFGERFTARIDSRVFGRANRLVVGAEFNQIAFDGANNAPYRGESTVAAAGFDPGAFASPDPTLPRFRTRTHQAAAFIENRLEVLPRLAWVSGLRYDHLSFHRDDLVAGGAFDKTFAHTGWRSGLVYEIAPGLTAYAQYTTGAEGVGSLVTLPASQANYTLATGRQWEAGVKHEIDDARAYWTLAVYDIVKRGLVSVDPLNPARAQQIGRQSSRGVELAGGVRLPGGVTIDANAALLRARYDAFGQRVGDTVVQRAGNVPHDIARQTANLWIGWAFAPGWRANAGLRYVGRRYGDDANRVPVPSYTVFDASLAWQATRDVGLALYARNLANRTYAASTSNGGAQWLLGPSRSAELVATLRF

SEQ ID NO: 1684 - protein, 817 aa, Acidovorax avenae
MPRQAGLRRRADQRDRSASPQIPAPLRAGSQDRTMSSRLKTGLLLGTATLAVCSPGAPSARAQTALPEVTVTAPSPIQRRPHTETKPRPAPRVAASARQRGPAPETPPVAQATPAAQPGILPIVTDQFATVTVVPNEEIRRSGGGTLGDLLANKPGITGSAYAPGGSSRPIIRGLDVNRVSIIENGTGSNGASDLGEDHFVPVDPLSTNQVEVIRGPATLRYGSTAIGGVVSATNNWIPDALPPCAQPFQSYGLAKPQTLFGGTGCMNGEVRSAVSSVDRGVEGAVLLDAGGNNVAVHADVYGRNAGDYNVPSYPYAAPGMPFNGRQPNSAATAAGASVGGSYLFDGGFIGASITQNNSLYHIPGVEGSQNGTRIDAKQTKFNVKGEYRPDAAAIDAIRFWVGATDYKHNEVGQATAGDPTTDGVRQTFTNREQEGRLEVQLAPFNAGFAAITTAVGVQASHQELTAPSPDDPGSPLNGLFDPNKNTKAAGYVFNELQFTRTTKAQVAGRIEHVELSGTTPAFVPEIFDLNNDPSAIGPATQRNLSFTPKSFSVGLIQALPWDLSASITGQYVERAPKPAELFSRGGHDATATFDIGNPNLKIETAKSVEVGLRRATGPFRFEITAYYTQFSGFIYRRLTGNTCEDGSCVDPGTGTLELNQAIYSQRDATFKGGEFQSQLDVAQLYGGTFGIENQFDIVRATFADGTNVPRIPPMRVGGGLFWRDANWLMKVNLLHAFAQNDVAPIAETTTPGYNLLKAEVSYRTKLDPNAWGAREMLVGIVGNNLLNEDIRIATSYSKDNVLMPGIGVRAFANLKF

SEQ ID NO: 1685 - protein, 978 aa, Acidovorax avenae
MPLSFKSSSFCLLACLCSASCAFAETRLGGNFVPPITNQGEEILLTSDFVCSNFLGASFSSSFINSSSNLSLLGKGLSLTFTSCQAPTNSNYALLSAAETLTFKNFSSINFTGNQSTGLGGLIYGKDIVFQSIKDLIFTTNRVAYSPASVTTSATPAITTVTTGASALQPTDSLTVENISQSIKFFGNLANFGSAISSSPTAVVKFINNTATMSFSHNFTSSGGGVIYGGSSLLFENNSGCIIFTANSCVNSLKGVTPSSGTYALGSGGAICIPTGTFELKNNQGKCTFSYNGTPNDAGAIYAETCNIVGNQGALLLDSNTAARNGGAICAKVLNIQGRGPIEFSRNRAEKGGAIFIGPSVGDPAKQTSTLTILASEGNIAFQGNMLNTKPGIRNAITVEAGGEIVSLSAQGGSRLVFYDPITHSLPTTSPSNKDITINANGASGSVVFTSKGLSSTELLLPANTTTILLGTVKIASGELKITDNAVVNVLGFATQGSGQLTLGSGGTLGLATPTGAPAAVDFTIGKLAFDPFSFLKRDFVSASVNAGTKNVTLTGALVLDEHDVTDLYDMVSLQSPVAIPIAVFKGATVTKTGFPDGEIATPSHYGYQGKWSYTWSRPLLIPAPDGGFPGGPSPSANTLYAVWNSDTLVRSTYILDPERYGEIVSNSLWISFLGNQAFSDILQDVLLIDHPGLSITAKALGAYVEHTPRQGHEGFSGRYGGYQAALSMNYTDHTTLGLSFGQLYGKTNANPYDSRCSEQMYLLSFFGQFPIVTQKSEALISWKAAYGYSKNHLNTTYLRPDKAPKSQGQWHNNSYYVLISAEHPFLNWCLLTRPLAQAWDLSGFISAEFLGGWQSKFTETGDLQRSFSRGKGYNVSLPIGCSSQWFTPFKKAPSTLTIKLAYKPDIYRVNPHNIVTVVSNQESTSISGANLRRHGLFVQIHDVVDLTEDTQAFLNYTFDGKNGFTNHRVSTGLKSTF

SEQ ID NO: 1686 - protein, 338 aa, Acidovorax avenae
MKKSLIALAVLAASGAAMAQSSVTLYGVADVGFAHEDNGSTSVNRMDSGNLNGSRWGLKGSEDLGGGLKAIFTLEAGFSLDTGAQADAASFFNRQSFVGVSSNFGTVKLGRQMNPVYATASTWDSFGDALAGDSSHLFSYNGSRTNNMISYNYSANGFYGELQYGLGEVAGNNSITGDNSAGRSAAMFVGYMRGPFDVVLTHQNIHNSGPYTTATKMTLLGGNYDFGVVKLFAAYAVEKTLGVGAKDQKDAHLGLTAPVGTAGTVELSYLRKKDDLVSNANAHQVAVGYVHTLSKRTALYTSYAQMSNESAAAYSAGKLVVPAGNSDKVFDIGVRHSF

SEQ ID NO: 1687 - protein, 442 aa, Acidovorax avenae
MRINPPLSLSVLAAVLGLSPMAAVAAEERPEGFVEGSRLDLLLRNFYFNRDDRKGQSSPTGNGYSEAWAQGLIGQFESGFTQGTVGFGLDAFAMYGLKLDSGTGRSGGGGSFGMLPLNHDNRPADSYGKAGGAVKMRALDTVVKVGDVFPKTPVVHYGDSRLLPESFRGVTLENTSIDGLNLQGGRLHAMSQPDSSGMRDGFATFYAGKVDSPWVGYFGGDYRLNSNLNFSLYSSRLKDAWDQYYFGVAGNYPLSDQLSLFSGFNYYKAVDEGKKLLGEFDNNIWSAKVGATYGAHTLALSHQRNNGNDDFDYLRQSDSIFLDNSIQYSDFNSPKERSWMVRYDLDMQPLGIPGLSFMTRYARGSGADYSHANSVYMRRDAAGDPLTDQRRWERDIEAKYVFQGGSLKDLSLRIRQATIRSSQFESDLEEFRLIVEYPLALL

SEQ ID NO: 1688 - protein, 998 aa, Acidovorax avenae
MKKNLFTLCMMLLLSMLSFAQGSLTISGVVTEKKTGEPIIGASILLKGQSSGTITDFNGNYSIPNVPSGATLVFSYIGMKTQEVKVTASSKLDISLEEDNQLIDEVVVIGYGIQRKSDLTGSVGAVKSKDLTKVATPNVANALQGRVSGVYISANGAPGSSPEVRIRGIGTTNNSNPLYVVDGMFMDDISFLSTHDIESMEVLKDASATAMYGSRGANGVIIVTTKQGTEGKAVVNFTASEGFQFNNSSFEMANATEYATLLNEALVNTGGKPKFDDPASLGKGTNWFDEIFRVASVRDYQLSVSGGSEKVRYNLSAGYYQQDGIITGNTYNRFTLRANNSYKISKRLTLGHNLSASFSHKKNENSAVVKAAYTISPVKRPYNEDGSFMDSESASSANPVATLHYTNNDDWKERIVGSAFLNWNILNRLDFKTSLGIDYINGRRRNFVPKYYVSETQKNETNSLSKTWDRDFTWLWENLLTYDWKINDKNRLNLLGGITAQKRVYELLEGTGRDFFSDNENYWYLDQASAGSKSVANNGYHETMMSYLFRANYALMDRYLLTVSVRADGSSKFGPDNRWGYFPSVAAGWRVSEEAFLKDRVQWLSNLKLRGSWGQIGNDKIGNDKYRALANISPSYDAVFGGVFYPGGTITSLSNRSVHWERSEQMDLGFDLGLLNNRFSLELDYYRRDTKDMLVTVDVPASVGLTPVETNVGAVRNSGVDFTVKWEDSLKDFRYGIRLTGTTIKNEVISLGGKRIASGDIGAGKSVQMTEEGKPIKYFYGYNVIGIFQNEAQIKEYNERAAAATGNAGQQYQNNVGPGDLIYEDVDGDGYITANDRKDLGSPTPKFIGGLGISASWKGFDLSIDFQGNFGNKIFNAKQVERFSGSDNWDRSFLDRWTPENPNTMTPRMTLEGNNYQVSSRYVESGSYVKLQTVELGYTFPKSWMQKVSVQNLRVYFSGNNLAYFTGYNGFTPEVLGGIDRQIYPVTATCRFGLNVTF

SEQ ID NO: 1689 - protein, 393 aa, Acidovorax avenae
MTQSGRDRDVSFEQEIKTKETEYQMKKIPIIAVAALSAYASSAYSQSSVTLYGLIDEAIRFDNHQTPSGGHNITMGTGGAILGSRWGLRGVEDLGGGTKALFTLESGFIANTGAMAFPTPNGQTREFGRQAFVGLSQSGWGTLTFGRQYLLAYTMGASHDTFAFANYAATWGFQSAGLVGGARLDNTVQYSSDSLHGFKVNGAYTFGGAAGDVHRNSSPAVSVSYDHGPLSIGAVYQVVNDIGGAVPADSAYGNTYFGVAIPDSTQKLFMAGASWATNRATLYAQYIYSHVYPADYRDDSMSLGASYRFTPAWEIREAVYVDILHHAAGEGTRITTGPILFYHLSTRTDLYTGFNYNHLTGQWIKLASSSGFTQSFNGYNSLFEGVLGMIHRF

SEQ ID NO: 1690 - protein, 691 aa, Acidovorax avenae
MGLSLALGPTGPALGAEAALPPVVATVPRLDVDPDDYPAAVSVVGREAYASGRRLSLDQGLDRVPGVHTQNRYNAAQDLRLSVRGFGARSPFGVRGIRALVDDVPYTVADGQSQLDALDPAFVEQLEVIRGPASALYGNAAGGVFRFTTLEPPESGEFLGGEVLFGSHGERAQRVWGGRAEEAWRTAVTASNQEMDGYRDHSGAAQRRLNIKLDRDLAGGERLRFIANLLDAPEAQDPGGLSREQVRDDRRQATDNAVDRDAGEEVEQQTGAVILTAEPSATEFWEGRAFLQRRDFYRRNPFPGGNGDPGGIVTFERYYGGVGGRHVRRTEAAGRPVQVSVGTDAEWQYDDRQRYVNNNGREGERTNDQRERAQVVAGYLQADWEVAPRWRLVGGGRLDWTRLSIDDREAGLDTDSQTYTEPSYLAGVRYAVAEDHSLYAKASSAFETPTLWELWDRDAGGIDDTIEPQQARSVEVGVKGRALDRRLRYELTLFQVRTEDELVPQEDADGPTRYANAGETRRRGVELGVEAFPTERLEVTAALAYGQFTFRDFETSELEGVSGAEDPDQVRGNRIPGVPRAHGYLETAWQAPSGWRWAADVRASEGIWADDRNTQRSSGYTEVGLHASRTFVTDAYEAEPFFGVNNLFDATYDANVRINAANESDNSLEDGGYFEPAPERTIYAGIRFATY

SEQ ID NO: 1691 - protein, 680 aa, Acidovorax avenae
MHTPHHPRTLLSVALLALSAGAHAEDETMTVVGKRSQHEEVATATRTNTPAKLVPQAIDSVKASELTAFGQPTLSEALTGIPGVNASGDTRFDGVNIRGFSASNDFYLDGFRDDMQYTRDLGNTERVEVLKGPAAVLYGRGSTGGIVNRVSKKPQKGLESSVSAQVGSFDSRRLAADLNGEAGEQVQVRLNLAQEDKDSFRNGVTSKRTLLAPSVNWEISDKLNWLVQYERNEHDRTPDRGIPGVNGRPADVPKEYVYSDTRRDFIDDVAQSTRSRLTWDINDQWQLRQQLGYTSLDSQFDNTYVTSVKGDQVTRSRWQQDLKANSLISNTEAEGQLQTGPVEHRLLVGFEQNWQERTPKLYQNATAIPAGNLYDPGSLPTYDGAMKLSSDANHKVRGYGLYVQDQLSLGDWHLLAGLRRDDFTVTSRRNDLNKEETVSVTSLSPRLGLVWNPIEEHAFYASYSKTFTPVGGELIGITPGDKNNNLDPQHTRLYEGGVKSDWLDGRLATTLSLYRLEMYNKRSKDPLDPTKVILTGLQRTEGIELSARAQLTDELYLRGGIAIQDAEQVKADADLQGKRPMNVSRQNGELFAGYQSGKQGWFGETGVTAVGDRFADNANTTTLPGYARFDARAGYRWQQWETQLSVENLTDHDYFVSATSASQIMPGTPRQLHLSAAYRF

SEQ ID NO: 1692 - protein, 371 aa, Acidovorax avenae
MRNIGKGLVGASMLIAAGGAAAQSSVTLYGVADTFVQFLGNGAVHSWSMRSGGNSGSNFGLKGSEDLGGGLKAIFTLENGYTINNGGFFVDSSTMFYRQAWVGLSAEKYGSLTFGRQYQPTFWAVYPTDPFRGDEVLSPLSAAASALDRHTFATQSAAGRSSNAIVYQSPIVAGLKLYAMYGFSATVTQPVPQTLGNILDLALTYSGYGAYVGLAYQNQHAGTAAIPGLPSALNLLGTERFTGALGYRIGIVNLQFNYTYNRSKDAPAGSLAARLGANNSYSIAEVGATIQASPADTVEIAAIERDVRGVHDNTPGVQLGFEHLLSKRTTLYARAGYMKNNGSAMMSWPGISVSGQNATQTMVATGMSYRF

SEQ ID NO: 1693 - protein, 387 aa, Acidovorax avenae
MNTHKAQKLMCAVALGGLAGAAHAQSSVTLYGLIDAGISYVNHAQNASGGSSSLVKFDDGINGGNRWGLKGAEDLGGGYKAIFTLESGFGLADGSISQGGALFGRQAFVGISRSGVGSFTMGRQYPFSHDYLNRYSTGGLTAGDAYAYHIDTLDLLTSVRINNSVKFDSVRMYGFKVGAMYGFSNAAGEFGGSDGDNGKGGSSRTYSFGVDYKNGPFSMGFAYTDITYPLQEVPPLKLTLANLDPLGERDLRTLGLGAKYQFGKVLGYALWTNTRLENLDHTAATLNIYEGGVVYQVTAPLEAALGYTRTQVRGSSTGTWNQINSSVEYSLSKRTSVYALAIYQKASGNNDGVPVQAMIGKSTSYFGNSGSDAQNQLAFRIGMRHRF

SEQ ID NO: 1694 - protein, 411 aa, Acidovorax avenae
MRGVPLVQEISELTTMKTTRAKRSFSFHPVYASAAVLCAGVSMHASAQSSVTLYGVVDNAIAYSSNQGGHSNTYMNSGALAASKFGLLGSEDLGGGTTAVFRLENGFAADTGAQSKANTIFNRQAYVGLANKDYGQLTMGRQYTPYFQYVAALGPTNVLTGAVGAHPGDIDAMDTTLRVPNSVTYTSPTFGGLQAGLQYGMGEQAGSMSNGSAFSAAMRYDYQAFAWSAGYVRLKNVPTFQNNTGDFANNAPINKGYATADTAQIIGTAARYTVGKLMMGLNYSNVQYRPGAGSPAGFAQTASFNTFGAIATYALTPALTLTAGYSYTAENKRNGVDNAARYHQISMEQLYSFSKRTALYFVEAYQKASGQTLSSAGGVVNAVASVGDSQNGTPSNGRSQFVGMVGIRHSF

SEQ ID NO: 1695 - protein, 702 aa, Acidovorax avenae
MNPHPLRPVVRSIALMTLIVQPPLMGAAWAQASAPVEPTLKEVTIVQQREDRVSSGATGLDLDIKETPQSISIVTTEQMRDFGTSNLNEALRLSTGIIVDEWETNRTTFTARGFDIANTQIDGVGLPNDWGIVTGAMDSFGYEKIEVIRGANGLLTGVGNAAGTINFVRKRPTNKEQGSLGLSYGSWGTTRVEADYSRPLTADRRWAGRVVAAREEGGSHLRSFDRERTFLYGVVDGQVGDNGLLTLGLSHQQSDSTGNMWGALTFMNADGTQNAWGRNASTTQDWTRWDTTTKTAFVEYAHQIGMDWQLKLAYNYRAIDNDSKLFYAFPSGSSLVGYAWGGKDTMDAHLATATVNGRFEMLGRQHEALFGVSWAKSEYTGNGYAGSDCGASACSAIALPGFPYPGNLVPEPQWGPLALESTLNQKLQRAFGTMRFTLTDRLKAVVGVNHAQYSRDGTSYGVASDLSRSKTSPYAGLTFEFTPSVLGYVSYSDLYFPQSQADANDRYLDPSKGTNYEAGLKADWLDKRLLTSVAVFQAKQSGLATPTGTYNQNGQAVYAPEDVKSTGVELEAVGRLNNHIDLTAGYTTLKLTGPDGGDTYAWVPRHTANLALKARLPSLPALSFGTSARWQSKISNMEASGFTVRQGSYAVLNAFVAWQLQPKTTLRFNVNNITDEKYINTLRYAGYYGAPRSYQLSLNHQF

SEQ ID NO: 1696 - protein, 103 aa, Acidovorax avenae
MFRPFLNSLMLGSLFFPFIAIAGSTVQGGVIHFYGQIVEPACDVSTQSSPVEMNCPQNGSIPGKTYSSKALMSGNVKNAQIASVKVQYLDKQKKLAVMNIEYN

SEQ ID NO: 1697 - protein, 957 aa, Acidovorax avenae
MQANSHLAKAIRFALISGVAVSAATTFNTVAAEDAANTAPAVERISVTGSRIIREGAVAPTPVTVITGDELLSTGVTNIGEALNQLPALGNTYSLANSGRFIGTSGLNLLDLRSMGTARTLVLVDGKRHVSSSAGTSSVDVNTIPSVWIDRVEVITGGASAIYGADAVTGVVNFILKKDINGLDVSATKGWADDSGHNKDRFSLSYGSDFAQGDGNVAFAVEYSAQEQLRAFDRDQTSTAFSSLANKNRTEDNNDPSDPDKIWTPNAGHYTISNAGTFNLDGWKSFNPDGSLSDVYSGQNVDGIRCANCDVTNLNQFVELQPEFERYNINFKANYQLNDNHNVYFEAKYVNSQSTDEGQPAFFFGNPVNDIKIDNAFINPELVALMKANKDSDGNSAPLDTLNIRRFMTDLGARIEDDTRETQRYVIGLEGIVFQDWDYDAYAIYGQTDLERVNKNNLIYDNYTNALDSVLENGIAVCRDQSARDAGCVPVNIFGFGAPSQDAINYINTASTGTSIIKQTVLGGSLTNSSLFELPAGYAGFSTGVEYRKEESEIFEPSNAAGTFFNALGEDKGDFDVSEIFAEITLPLLADLPMVRQLDLDLAIRFADYSTIGNATTWKTGLSWEVDDQIRVRTTYSEAIRAPNISELYGAASQTFFSVDDSCRAKNLNDLADPTQRQANCAALGIPAGFDADYDDKTLEGLSGGNRELQAEESKSFTLGIVYQPDFIDGLSITTDYWNIEIENAISAVGAQDIIDRCVDSKSGVNNEYCSLITRDSTSHEITQIRQFSLNIASLEAAGIDFDIGYNFEAFSGDVRTNLIATRLLKRKDFSFQDEPDTFEELAGTAGYAEWQANWSLSYSIDSWDVSWRTRYVEGVSLYTDKELALNANPNSNMEFGDYFINDMAVAYNFDSGIRLKFGIDNVFNRELPYGYTGTDTDSSAYDNVGRFFHTTATYKF

SEQ ID NO: 1698 - protein, 422 aa, Acidovorax avenae
MFSPRNAGAVFASGICAVLSMPASGDFLADSKATLTLRNFYMDRDYKGDATRFQSQSRQAEWAQGFILNVQSGYTEGPVGFAVGLTSKTGVKLDSSPDRVGTGLLAYGPDGKAESSYSQFDFVLKARAAQTELAVGGLTPMVPILVSPTVRLFPPVFRGAQMKSGEFRDLTLHAGYFDRIEERNSTNFEALRIASPWGRFESSAEGSHFAFVGADYRWTPGLVTNHYFGYLDDVYKQHYLGVQFSHALGPGKLQHDFRYFSSSEQGEARAGDIDNRYAGFFSTYKYKGHAFGAGYYRIFGEHGFVGINATFTHTHSQGLLDGEMGNPDERVWQVRYDYDFAASGLPGLLATFRYADGSHINMPAFSASRAHESERYLELSYVIQSGPLKDMAFRVRQADYQSSYSRDVNELRINMDYTIAIW

SEQ ID NO: 1699 - protein, 799 aa, Acidovorax avenae
MPFSSSRFLAMARLGAMSLPALAMGIPDDVSAQTALPGIVVNAPSPIVRHARPAPTTPARTARRGTTRPSAPQPPEIASAPQPASSDLRGTLPIVTDQFATVTVVTNEEIRRNGAATLGDLLNDKPGITGSSYAPGASSRPIIRGLDVNRVGIVENGIGSNGASDLGEDHFVPIDPLSTNQVEVIRGPAALRYGSTAIGGVVSASNNRIPEQMPCGPTPWQAYGFGVKPPVTANGCLNAETRSALSSVNNGLEGAVLIDAGADNVAVHADAYGRRADDYAIPGGRYQANTSNRSMGASVGASYLFDGGFIGASIAHNNVLYHIPGDHGADFKERIDGRQNRVTVKGEYRPDSALIDAVRIWLGAVDYRHHERGLEDAHDLSSDGIHQTFTDRSQEGRLEVQLAPYMLGAIPVTTAIGIQGGHQDLTASSPENAGALYNGLFAPNSNSRIGTYIFNEFQLAPTTRAQIAGRVEHVWLNGTMPDFPASFMPDGSAQLPIARDLSFTPASASVGLLQDLPGDLVASVTGQFVQRAPKPAELFSRGIHHATTTFDIGNPNLKIETAQSVEVGLRRAKGPLRFEATGYYTRFNNFIYRRLTGAFCDDDFASCHTHDHHDHDDHDDHDHDDHDDHGHDDAHGHGHHLNQAVYSQRDATFRGGELQFQYDAIPLWNGMFGIEGQYDIVRATFTDGTNVPRIPPQRLGGGFFYRDANWLARINLLHAFAQNNVSDVETPTPGYNRLRAEISYTTMLPGNHWLGGQAVTVGLVGDNLLNEQIRNAAAYNKDQVLLPGLNVRLFANVKY

SEQ ID NO: 1700 - protein, 759 aa, Acidovorax avenae
MRHVPTAVSSPRLLVSAIGMAITATSAYAADPAASNAVTLDATSINGKAEQASTDYKVEKASSQKYTAPLVDTPRSVTVIPQQVIKDTNALNLQDALRTVPGITFGAGEGGNPQGDRPFIRGFDAQGDTYLDGVRDTGAQSREIFAIESVEVAKGPNSAIGGRGAAGGTINLVSKRAHLGNSLDGAWTWGSDQTQRYTFDGNYQFSDSVAGRLNLMTHESNVAGRDKVNYDRWGIAPSLAFGLGTPTRVNLDYYHLESDDLPDSGIPYSVPRAGSTARTSAHPDKPVDGGDSDNFYGLTGRDFRKTRVDIATFAIEHDLSDTLTLKNTLRHGNSMQDYVLTQPDDSAGNVNNNGVWRRANTRVGNTATTTNQTDLFGEFYLGGLKNSFSTGVEFTKEESDRQSYTVTPNSKLTCTGPGSGGSCTSLDNPNPDDNWVGTVARNYAGTKTSSKTRALYVFDTLELTPQWLLNMGLRYDHFDTDFRGYNADGSTTVSSKGVPAKGQDTSEFITGQLGLVWKPADNGSIYVSYATSATPPGAMLGEGTEGNPLGNTTDRSGNLLGSDMEPEETTNYEIGTKWDLLDQRLSLAAALFRTEKENARVQVDTTTYENVGETRVQGIELSASGKLTDKWQVFAGYTYMQARQIDGGPLGKANDGNQLPNTPNNSASLWTTYQLTPKLTIGGGAFYVDDVYGSVANTTMVDSYVRYDAMAAYKLTKNIDLQLNVQNLTNEVYYDKAYSTHFANQAAGRTALLTTSVHF

SEQ ID NO: 1701 - protein, 953 aa, Acidovorax avenae
MIHLHHRPLAVAVALCVTALAPLGAAAQSTTNLDAVEVTGTRIKRAEVEGQVPIQTLTRGDIERTGLTSIGEVLQQLTGSGSALNAKFNSSGNFGFPPDGSGVGAGSAQVDLRHLGAKRVLVLVDGIRWVNESSASGVGSATDLNTIPLAIVERIEVLEDGASSLYGSDAIAGVVNIITRRDFDGGQVTLNYGEYSKGDGTQKGVDLAWGKSGDRYSLFLGASWTKQDPVFAKDREQSRFPIPGTGLAFGSGGIPQGRFRFTDPNTGAVQDIVPNTGASNPRYDGSAGCNRSDDYHCFTSADRFNFAEYNMVLTPSERKGLFGQFRFDITDNVQWYVKALGNRRESTNQAGPEPLFFGPDGATGNPLADNIVVSRLNPYNPFGFDLVSSGNMALIGRRPVEGGARVFEQKVDTTYFATGLVGDFHAADRSWYWDVNGMYSKNKAEQTNYGSYNIYNVNMALGDPAICAATPGCVPLNIFGGVGSITPDMLKWIQPVVRDRSQNELSLFTANLSSELFSLPAGPVSFATGFEYRKYEGSYQPDPLTVAGHYNGVPSQPTSGSYDVNEAYLELSVPIFADSSFGKKLDLSLAGRYSDYSTFGGEFTPKYGLRWQVTDDFVLRTTYAEGFRAPSIGELYGSAARADLQLFDPCSVGLGGTPPRGSAANCAALGVPAGFQQANSQISVTTGGNRELDPERSRSFSAGFVWSPWFGNNTSWSERFDVEVTFYRHAIDGAIQAINAQTQLDLCVDTLDPIYCEGITRANTGAVSSFNNRLTNLGSIKTDGWDVDLFWTLPQSSIGQFKLGWKNTFVGRYEATGAAGQKQPQKPGVEVADSSIPEWTSNASIGWTLDRWSANWTVRHISELTENCGDAAAFPVCSNQAAGTNTLSATTFHDMQVGYKIDWMKGLQLTAGLNNVFDKDPPICLSCSLNGYDASTYDIPRGRYWYLRADLRF

SEQ ID NO: 1702 - protein, 1018 aa, Acidovorax avenae
MPLFLLSFAMIATGFAQSTGSITGKVKNLSNGRLLYNARVTIEETGQNTQTDEYGVYRFSNVETGTYTIKASFVGLRGKSIQVTVDSGVSTNGDILLVSNRLEADLDDEEVFELEAFEVDGSGTYDSNAIALNEQRNSDNLISVQHAEAFGEIAEGNIGEYLKNLPGVSVNYVAADVRSIKLRGMAPGFTQVTVDGSQMASAGSGNKIRSFELEQVSLANVEQLEVSKLPTPAMPANAIGGSVNLVSKNAFTAGERKLSYKVSLNMNDQESSLGKSPGWPADVERSKVLPGVELNYSDVFMDERLGFNMTYKQSNMFNVQQRFRWREWDLSPQGGSGDADDVYFLRLEAQDGPKKTSRESFSTNVDFKVNENTTFSFRGQANTYDSTFFNRNRSWRISAEDDLSDIGLNGSTDDLSNAGYTAGGNRGLGFGGSFRSKYGSTIHLDFGMKHYVNDWAIDYGYTSSVATNHYGDNDRGFLETWEAGYRGDAEYIVFDQTMGDQFAFSDVKVYDEDGNLLPDRGFALGDYELRRTRERPKESVDRIDGLRFNARRNFSIGENQGWFQFGGRTSRQEREGYQLELRYEYDGYNTDGERIWFSDIKDDVYSGRSPGFGYENWDWASIAQIHTIYNSDRSVWDLDEGRAVDRTIGTWFELQENIDAIYGMAKIEMLDNKLGILGGVRIEETSVNGLVPLSGSSQNYVLSPTDFNFETLSVQSDYRTSHPSLHITYDATENLVLRLSYAKTIGRPDFGDMFGPTVIREPDPTDEDATEGYIETTNPGLLPRKSDNIDLTAEYYYGDTGVLSVSLFQNDMTNYILSEERDVVATDVQTFGLPSYVFGGADQYRIDTTYNAGNAKVEGVELRWDQDLNFDALPALLRGSSIYANGTFLSTTGDFGNDFQDFAKTSINYGYLFDYGPVDFKFRWNVRGDEIGGSSRGYTLEGESGDAFLYRERRLALDFDFGYKFNDKAKLFVNARNLNDAPHRQGYYVPGTDGNRTLILEREERFGVQWTVGVKGEF

SEQ ID NO: 1703 - protein, 304 aa, Acidovorax avenae
MRSFLHQSRPFVNWRVKQQALGIYAQEQLTFDDRWIVTLGGRWDQVHTTADYLDSGTSDDDTASAFTKRAGLTYKFTPNLAAYANYSETFQPLVAQTANGYAVTGSLKPQQGEQYEVGLKYQPDGFDGLFTLALFDLTQTNVPSYVSPLVQEQIGKVGVRGIELEGKAAINDRLNLTLAYSYWDAEIREDGTGGNVGNRPSRVPRHLASAWLDYTIPGDGWRGDLTIGGGVRYIGQTYGNDANTVSLTSYTLVDAAVSYKVTEDVTLAVNATNLFDHKYLATSYYGTEFYGDRRKVVGTLKYSW

SEQ ID NO: 1704 - protein, 723 aa, Acidovorax avenae
MQKTFMHTTIASAVLFALNFAYAQESTQSEQLEAIEISADASPDGLSKEFAGGQVATGSRVGILGNKANLENPYSTTSYTNKFIQDKQARSVADVLKNDPTVRVARGFGNFQEAYFMRGFITNSDDILYNGLYGLLPRQYIASEMFERVDVQRGASAFLNGMAPGGGSIGGTIALMPKRAPQEDLNRLNIGYSSSERTNVGADISRRFGNNKEFGVRLNVAHTEGESEIDHDNARNTVFHLGLDWKGEQARVSADLGYQKNNLSGTRPSVTLSSVSSVPAAPKATSNWAQRWTYSDERDVFGTVWAEYDFLPNLTGYAAYGFRDGKEENVLANLTVQNVNGDGTEYRFDNARRNIIHTGEVGVKGSFATSAVDHEVVLAANRYQEKRKNAYVMDRQNTFATNLYRPTYINGISYSANVRKGNDLASPALTNRVVLNSVALADTLSFLDKTLQVTLGARWQQLYTQNFAYNTGALNRRYKEAHVSPSLGVVYRFTPEISAYANYIESLAQGETAPSNAHNKGDMLSPYVSKQKEIGVKYESQSGFGASLALFSTEKPRGYVDKNLIFSEKGKDRHNGAEINVYGQVTDNVRLLGGTTFLHAKQRNTGSADTDGKYTIGVPKFQANLGAEWDVPALQGLTLESRLTYTGSSYANAQNTLKVGDWTRVDVGARYIVMLGNTPVTLRARIDNLANKKYWESVGGYPGRGYLVSGAPRTLSFNASFDF

SEQ ID NO: 1705 - protein, 959 aa, Acidovorax avenae
MQTQEVVIKPTLKVLLKSDSQNLEEVVVTAMGIKRSEKSLGYAVSSVKGDEITKARESNVLNSLSGKIAGLQIAQSSGTVGGSSSIQIRGASSIGTVSSPLFIIDGLPIDNGSYNPDRTNGIVDVGNRAGDINSDDIESINVLKGAAATALYGARAKDGAIVITTKKGKKNSPVFVTVNSSTRFENVLKLPDFQNEYAQGSYGVYNVKMLNGWGPKISSVQDQQFTDYKGDKVTLKANPDNVKDFYETGMSYINNVSVAGGGEKADFRLSFTSTNQTGVVPGSDYNKYAFSVNAGMNFTSNFTGRISAQYIRSDSEGRPAQGANDSNLLIPLINGLPRTIDIHDIKQNWIDENGKQVTLDPEGKSNNPYWIINKNKFTNNLDRMIGNITLTYKPIEGLTITNNAGTDFYTEGRRKLYAKGTVGALNGKFQTWNLYKRIINNDLMVSYEKTFANDYHFKAMVGHNLYQEEWKNENVQAQNLVVDGLYTYTNAKSTTPVNYYEKKRLVGLYGDISLGYKDMLFINVTGRNDWSSTLPINNRSYFYPSISGSFIFTELMENKDILNYGKIRLSYANVGSDEDPYNLAFKYTPASTYFLQYLGNVNTFPHMGLVGFTGPRVLPNENLKPQNQSSFEVGADLRFFGGKIRLDMTYYSNITKNQIVSIDVPLSTGYFANNINAGKIANKGVEVTLGLTPVETRNFKWDLDATFASNKQTVEELAEGLDEYTLTSGLSGLQIKAAKGDSFGLYGTAWKRDDQGNYVINSKTGLRETVNNVRLGDVYPDFTMGINNTLTYKGLTFSFLIDIRHGGSLYSETVANLRSSGLAAETVAHREDASFIEPGVILQDDGTYRPNDVPVKSMQDYWQHVANSSNNEGNIYNASFVKLREVQLSYSFPRKWFKSFFVKSLDLGFEARNLWIIKDHVPHIDPEANFFGPSQIGGGVEFNSIPSTRSFGFNLRLTL

SEQ ID NO: 1706 - protein, 991 aa, Acidovorax avenae
MLPAHHHRPPCRSIAPLSLAIAGVLLSVAVPAVAQESKDKATDLARIEVTGSNIRRTDVETASPVQVISKQDIQNMGARTLLQVLDNLPAARPAQQDSRSLFTGSDGASQANLRGLGAQGTLVLLNGRRLSYYGAPAGFQTQFVNIDAIPAAAIERMEVLTDGASAVYGTDAVAGVINVITKRNFQGAEVSFTNDTSSRIDSYGERQASITAGFGDLTENRFNIYGAVNMYRRDAIPLSDFYDKRPDQYYVNKPNYLNDLRLGVGSKPGEFNPGSYFAFDPVTGRRVQEAAPGCKNVLTSEAAGPRCVWETWMNNEIDAGAKSERNTAYLNGTFLVGESTEIFAEATYTDIDLRANGGTPRTYGTTTGNPTSWFSRNTGNNVNQFLYPFLGPNNEYNHASPQMKAMMGGVVGLNYLLQDAGANYFGQRNTDKSYRVLAGARGSRGDWNWEAAFASAGTHSTTYQTINVNTKGFEKAFGPYTIDPGTGRVIISDHPAYKFGEISEANAALIREAFPTFDIQSWTRLHTLDGKIEGPLFQLPAGEMRAAFGFNASRETFYTPGNADAANGLITQQGGSWFDGKRNTYALFAETVAPITDKLELDAAVRVDKYPNFSANIAPKIGFKYQAFDQLMLRGTYSTGFRAPSLAESGNGGVFAQLGGYRDELRCNETNAIANLLLRSQRPGDVDLGKTLLNVDCSRTVARMTQPNKDLKPEKAKIATLGFVYEPATWLSVSADYWFIYRDNEIVAPDYRRMEDIISSSRSPITDSDRANLAQLAAMCADPASGVNCPSTLPGYSAGNVASVVGQYKNRGKTLIDGFDIDARSRFSLGDWGNLNIGLAATIANRNRFYMDEASGWYYGDVVGYYNNPRLRATLNADWTYKQVTTSMFVNYVGGTKWATDQVDEKSNNKETCTGGYLALQKSKCDGAPSWWTANMSVTWRPDDAWNLSFTVKNLFNRLPFYDPNSFLGDSSDYATIFGRGYSVTIGYRFK

SEQ ID NO: 1707 - protein, 127 aa, Acidovorax avenae
MARFGNNRAQGRFDLGQRFGENKAFGVRANGKLRHGDTPRHGYREDNKEFALNADYRGEKLRVTFDSIYAKRKINGGRARMQDIQNAGGRLFDAPDGKINLLPSWNWQNTVGETNMLTFEWDAFDNT

SEQ ID NO: 1708 - protein, 282 aa, Marinobacter aquaeolei
MSSYANHQALAGLTLGKSTDYRDTYDASLLQGVPRSLNRDPLGLKADNLPFHGTDIWTLYELSWLNAKGLPQVAVGHVELDYTSVNLIESKSFKLYLNSFNQTRFNNWDEVRQTLERDLSTCAQGKISVALYRLDELEGQPIGHFNGTCIDDQDITIDNYEFTTDYLENATCGEKVVEETLVSHLLKSNCLITHQPDWGSLQIQYRGRQIDREKLLRYLVSFRHHNEFHEQCVERIFNDLLRFCQPEKLSVYARYTRRGGLDINPWRSNSDFVPSTTRLVRQ

SEQ ID NO: 1709 - protein, 440 aa, Marinobacter aquaeolei
MMRKPTRIKNTGGFQQNLSAALLSTTLLVSGTAQADQGKWQDAFDFQASYTGESATNVEGGERRGSAYAGQLFVGGELDLNTLFNWEDTKIHVAMTNRHGKNLAEHYIGNSTSVQEIFGGQNTRLARFTIASTFLDGDLELEGGRTVANISFLGSELCQYFQTNAACGNPTFVFRTSNFTWWPVSSWGGHAKYWLSSNTYFHTGIYEDNTSHQDLGDHGFDWATNEATGVVVPFTLGYQTTWDNDALPRRYEIGGWYDGADYTDPVFDEQGNYAALSGNDYAVRNGRSGVFARFEQTVTRPNPSTKEGLTLFGAVLTGTSGELIEDYYLKAGLVMRGTLASRPNDTVGFVFTRQQYTDEALEDQRILRAMNGGVGTPPSSQTMLELSYGYQLNQHVRIQPNVHYIINPDQFAERDRVSELDDAIVLGLRFDVNLAGLLIQ

SEQ ID NO: 1710 - protein, 813 aa, Marinobacter aquaeolei
MCYCYITSFNTLLFMNTSRLLFLSTLSFLLTLQVSFGQTKGKVEGFIKDAEGIPIEFATVRLHSLPDSSAVTGTLSDTSGYYSFENISYGNYFVIVSTIGYTDTYLPSFTLTKDHNKQQFDAVVSEHDASEEILITAQEPFIRQEAGITVVNVEAGILNAGLTAADVLQRTPGATVDKDGIVKLKGKGGVLVLLDGKPLYMDDAQVGALLKSIPADQIKEMEIITSPSAKYDAAGNAGIINIKLKKGAYEGLNGSVNSSIAKGVYPKALIGINLSYKKKKLTLGGGYQYSYKKDLQRSSVNRAYTSFQDSSYYTSTEYAHPKNTQNVLLNGSYDLSAKSTLLWDGTALYQHSTWKGNTESNLYTPSGNRSSYFLTNDQSTSEYYNINSSIGYKYLMDTVGSELFFQGEYKKNNSKSDQVFTTDYYDANGTTTQPSTSYKSYIPVNVDQWGAKADFTKTLVYKIKLEAGVKYMGVKTNANVTSSYVAENTFIYTEHIQAAYAILNKQLNKWKLSGGVRVEHTLSKGEQKTLDSTFNRNYTNFFPSAAVSYQPTEKTSYTVLYSKRIQRPSYHDLNPFIYYSDPYNSYSGNPYLLPEYTHQAELTTSKWNGVFLATLNYSYTLQPLAEGFKIDPNSLATTYTSRNLSNQKNLGVSFSVNSTIKHWWSMNNYVYFYNNSLTGDVGFGMQTVSRPAWMVNATHTFKFPHSISAELSFNYESPNYFGTILYREVWQLSAGVQKKMMHETVSLKLSVTDIFWKYVYVGSGTFGDIKTSDSFKWDNRVLMFSLTYRFGKRIASVLNSNKMPMGDGGGRKK

SEQ ID NO: 1711 - protein, 938 aa, Marinobacter aquaeolei
MHKNNLLAKSVRFALISGVAVSTLSTFTAFAAEEDGSKVERIEVTGSRIKRTDMETTVPITVLSREDIAQTGAINVADILNSSPVTIAGSDQSNSAFTTSTVGLNTTSLRNLGDSRTLVLVNGRRFVSGVDPSSGYAVDLNAIPTSMIERIEILKSASSAIYGSDAVAGVVNIITRKDFDGVEVNAQTGISGESDRKTKTVSVTSGKTWSGGNAWISLGYDDDEGIKATDRDFSKQDLAILLDDDGNEYAGPVNSSFPPQGRIGKYNGDGTLYSGTTGSFNRASYRQLVTPLERKYAAAGLTMELAENVSMFTELNWNTTKTKDSTIEPTPLDVVNDVWLKNRNGKGGMDINSPLIPDALRNALIADGITNLNQTSFVRRLVEFGARSTDLERDTVRIATGVDWAIDDTWTSQTYLTWGRTDQSQDNGGQVNKERAALALDVIKDANGDLVCASELARLQGCVPLDMFGAGTVSDAAVKYIESPAKANGQAEQFVLGSSVTGSLPVALPGGDIGVAMGLEYREERGVYSPGDLAQTGASSTNQSDPTDGKLYSKDVYVEAILPVLENLEFDLAARYADHSITGGDWTWNAGLQYTPFESFKVRASAATAIRTPNISDLFGGRGETFGNVADPCDGVTAATTGNAAANCRAIQAVSDRIAADGAFTLTQAERQGTGGTQGGNPDVKAETADTWSAGIIWQIVDDLAFTLDYYDISVKDAISTTSRTTVLNRCFDVDASQFSQNCNGAAIRDQKGALIEVHSGTSNENNIDTSGIDAEFNYTTDLGPGSFKAQLVWNYTNEYVVTGILSGEAIDYVGDVTHPEHRANLNLSYALDEMSFAWRMRYWDSVVDSVDESNGNFTDGASLTTFNDIDAVIYHDVNASYTFANGWEAMVGVRNLFDKQPPLLPQGTNSGATGINTASEAYDVTGRYFYAGVTAKF

SEQ ID NO: 1712 - protein, 732 aa, Marinobacter aquaeolei
MSGVSQKNNRRHGAARRALSQRYLLVPAITAGLALASPVRAQAEEGKPQSLAASPGDAAAVMLPAISVEGEQISQPLTGFQMPVTPREVPQSVSVVPKERIEQQNLFNMEDAMKQSTGVRVERIDANRVNFYSRGFEIQKLQIDGLTTTMDDRLFLSPDLSMYESVQVLKGPAGLLTGSGGAGGAVNLVRKRPRGQAAVTGKLSAGSWDNYRGTLDATGPLNGSGTLRGRAVGTYQDRNSFIDQAWQKNATLYGVLEYDLTPSTLVTAGAGYQWLYAKQPWTLPAYSDFELLDVSRSTYLGADFNRDRFARTSAFAELEQALGNQWLAKVAFRYGDSKLHSDQAFAWGAVDRGTNLTDMWALKFDYREKQTGATAYVTGPITLLGQEHQLLIGTNYERINFHNSNFTAASEFFPYPNPVNVFNPSTDFPKAQFSRSDVTTLIEQLGVYGNARIHLAEPLTLVLGGRVSWWETSLDETGQQKQRDKFNAVLTPLVGLIYDLNNTYSLYASYAETFQPQNFRDADGDLLDPLQGEQLEAGIKAALFGGALNASLAAFRITETNRAQRPANNPDPQVFVARGKVRNQGFEAEISGQVQPGWDAFAGYTYTDTDNPTLGGGGPDGGSAFSVIAPRHLFKLWTNYRLPGDWNQWSLGAGLRATSKIFNEFEDGERLTQSGYATVDARLGYRVNQRLSVSLNVTNIFDKKYYQRINTVNSGNLFGQPRAFMLTLRGQL

SEQ ID NO: 1713 - protein, 491 aa, Marinobacter aquaeolei
MTTTMKNTTPGFSLHPSLPTVPARSLADIRLAMAVSPRRREAPREIRSENETVAPLARSMALSALAAVLAIPSMAQAEFIKDSKATLSLKNFYINQDVRNQDAPRSEEWGQAFFLDYKSGFTEGPVGFGLDVLAMHALRLDGGGRSGKADIERSPGGMFPLESNGKGKTDFGRVGVTGKLRFSRTEARLGTLLPKMPVLVYNDGRLLPQLFHGAQITSNEIKDLTLTAGKIEHSTERNSSDSYGLSISGANSGSKAQFSNEFYFAGADYKATKDLLLQYYYGNLRDFYKQHFFGLVHDWKLPVGSLKTDLRYFYSDSDGKNESASGRAEGYVSSGADGSSGEVDNDLWSALFTYSLAGHALSAGYQKVSGDSDFPNIFQGSGRSLYLITDSQLGKFASAGENSWVAKYAYDFAQVGVPGLKASLAYVSGDDIDAAGSDKREWERNIRVDYAIQGGPLKGVGLSWRNAALRGNDSRDLDENRLIVTYSIPLL

SEQ ID NO: 1714 - protein, 320 aa, Marinobacter aquaeolei
MKKTILAMAITGLFAATAAQAATVYDADGVTLKLNGDVKINYGSDVRKFNDNKVDSNYIELDDADFSFALGYEIGNGIELGATMEISGEDDNIALSDTFLSVAGDFGTVTVGKQPLIFDDAGIGEDFKFGFDTYANTTDSGEQVIKYKGDWDTFYAGVAYMLNGDATSNGDGTTGEDDKNQVDANFGVRFAGIDAAVYYSTGTNNLKQDNNAYILQAMYNADAFKVGAFYSNETIENSNGSDLSDLNHYGVSGNYYMDAWNFGLGWGAEKDNLTSNNDRNDYYANVAYAFTSNIQSYVEVGYSDEDDSEVGYVVGMEVVF

SEQ ID NO: 1715 - protein, 406 aa, Marinobacter aquaeolei
MAISVKTLLGATALWLAASAVQAQTLTLDRALQTAFANNPDLAAAQWEIDIAQGGRQQAGLMPNPVASWDAEDTRRNTRTTTIKLSQTLELGGKRGARIDLATRAQDAAALTLEQRRNDLRADVIDSYYGALRAQERLDLAQRSVALAERGLVVANGRVRAGKSSPVEATRAQVQVSQIRLEMDRAQIGLSDAYRRLAAITGSAAPDFQAVATQSQSAPPLPAFTPLLARLEQTTQLRLAELHIQQNEASVGLEKAQRIPDLDVSIGSQYDAGVRERVNLVGVSMPIPLFNRNQGNVLAASRRADQARDLRNATELRLRTETRQALDLWQTANTEVRAFNQQILPAAQSAVDSATRGFEMGKFNFLDVLDAQRTLIAARTQYLTATAQATDAWVRIERIYGDLAQF

SEQ ID NO: 1716 - protein, 594 aa, Marinobacter aquaeolei
MTQNISQRSAGLRHLPTGFGLAIVATALVATASLSRAQDSGALIDKLVQKGILSSKDADEVRTEIQQDAAQSQIGKIALSNSVTQLRLYGDLRLRWQYNDSQQQIPDGNNVSQQSRWRYRLRLNADWQLGNDWFAGVQLQTGQAADSGNQTYSNGFNNDSIFISRAFLGYQNDWLKIIAGKQANPFYTTDLVWDPDINPAGLTETIALHKMPLFGGSAGPDGKDGISVPTHVSPWEATLVAGQFIFGDNNEFSNTGDLSSDPWIFDEQLIVKYNFNKDTSVTFAPGFLVESAGHVSGALDSLPFTDAGAISSGTTAVQTTVQNANQVQISYDAKGVPTKTITPLTTTTTTQTTITPNNRTVGSATVSGPRTITSTAASGRNGGVITLTGKASGLATDPSKANQTTTSVQTTQKQTVSTTNNVTLPGITGETRALHILTAPGDISFKLGGIKTKLYWDVAYNLSGRDRFDNVYELKDFGSRPYKTRDGLSWLVGLQLGETKKKGDWQAYINYREVGIASIDPNLNDSDFGLSALNTRGFKIGLAYALTDFVVLNATGYITWNLDDNLYGGRATSAGGIAPYNAANEVQLDVNIKF

SEQ ID NO: 1717 - protein, 481 aa, Marinobacter aquaeolei
MSLNLVSEQLLAANGLKHQDLFAILGQLAERRLDYGDLYFQSSYHESWVLEDRIIKDGSYNIDQGVGVRAISGEKTGFAYADQISLLALEQSAQAARTIVRDSGDGKVQTLGAVEHSPLYTSVDPLQSMSREEKLDILRRVDKVAREADKRVQEVTASLSGVYELILVAATDGTLAADVRPLVRLSVSVLVEEDGKRERGASGGGGRFGYEFFLADLDGEVRADAWAKEAVRMALVNLSAVAAPAGTMPVVLGAGWPGVLLHEAVGHGLEGDFNRRGTSVFSGQVGELVASELCTVVDDGTMVDRRGSVAIDDEGTPGQYNVLIENGILKGYMQDKLNARLMGMTPTGNGRRESYAHLPMPRMTNTYMLPGKSTPQEIIESVEYGIYAPNFGGGQVDITSGKFVFSTSEAYLIENGKVTKPVKGATLIGSGIETMQQISMVGNDLKLDNGVGVCGKEGQSLPVGVGQPTLKVDNLTVGGTA

SEQ ID NO: 1718 - protein, 1058 aa, Marinobacter aquaeolei
MRRRFLFASALVSLTVTAPAAFADREITDEITTPIATSTAGDGGVPDNIVISAGGRVTLVPGATAVTIDSDNDVTNSGSIILEGDDDGGVGIHAIGGNSGTITHSGLIQVLAETRAGDTDDPADGMVDGPLAVGSNRVAILVDGNAVFTGDIIATAGSTMTVIGNDSAGLRVLTGLDGNIDLAGNVRAIGDNSFGVEIRGHVTGDVEIDGRVEIQGEDSGSILIASDVDGGVSIGATVTATAYRFVGRPGEEARASLEAEDTGQSGSPVLINGNIGGGVFFSGYSADRPSTPSTSITVRGSAPAAHILANASSGDIVLGEVVLEAIADDPDTADVDESVAAELIGYALVNRGAINAQGNLDGIDTIGLQVSGADGHTVSLTGGFLNDGNIGGSAWSATSTGVVMGMGAIVPTFANTGDILVRTNGEGALARGVYIDTGASVPMLVNSGIIDATSLNGGGAVALTDLSNSLTMIENTGEIAAYHLNSVVGTDPQVDDLVAIDLSANTIGTTIRQYRAADAADDHVEEIIGEVRLGSGDDVLQIESGVVTGDIAFGDGADQLMITGGIVTGGLTDSDGNLVVEVDGAQLSLGANTSANITTARFGDGSVIRFQIDDESGTAANITASGDITFQSGSRVAATLANLIGDGATFVVVSANNLVIEESLDILQDTEAPWLYESNLEFDPNNANALILTLRRRTADELGMNANQGAAYTAALEGWQNNDELGQAIASLLTQDEFFAAYDQLLPEYSASAIQFALAANDSAVGALANRLEAVRRSPEESGGLWVQEFGYFADRAGSAFGPGYRGHGIGVAVGFDRPVGPFYAVGLNVVGAASEVSEVNGVDEPMSAITAQIGSYAGARFGTFDFDVYGAVGYDSFEHNRRVLIGAFDASPTADWTGWHTSASARIARDIAVGDSWFVRPAFSVDYLRLSESGYTETGGGVGVDLTVDDRETSSFSGTGLLTLGARFENTNSWWSPSVRVGFRNEFGGGESETDASFADFDDTFTLRSQSMPGTGGIFGFGIAAGSGYSTFSFDYDADVREDFIRHTARLVMRMVF

SEQ ID NO: 1719 - protein, 365 aa, Marinobacter aquaeolei
MKKLLLATAIAALSVSAANAAPTVYGKAFVAMNYVNAEADAEYNYSDINGNVVYSYSENVDENTVDINSHASRLGFKGSEAMTANTDVIYQLEYGIDVSGNNRTISSRDIFLGVNNKQFGEFRAGRNQSTLARIDNVVVNQGYFDNLGNNDMENDVVKGLNMADSGRINSSVIWTAPKYQGLPLQFSAMYSAEDQEEGKDDGFGAALMFDQGTGFTAGVAYDKDQNIEGDIVRGTATVDLAKYMAAPVTLGALYQVADYDFAGSKKEKGLVVSAEMPLTNFARPASIYTQYNKTDNLGGWDNVNSDQIVVGGKYMYKDNIIAHAYAGMNNADADGSMSSSEPGFLATYRADAEVFVIGTGLEYKF

SEQ ID NO: 1720 - protein, 1023 aa, Marinobacter aquaeolei
MANSNKSKMKTKLNGILTLFLALVVQFAIAQTVTGKVTDASGEPVLGATVLVKGSSNATTTDFDGNYSISAVATDVLVYSFAGYTPQEIPVGDRNVIDIVMEEALDAVVVQAYRTASVAKSNVAATTITSEDIVDRPNASVIQRLQGQIPGLTVQTNTGQPGANSLIQLRGISSINGNTEPLIVVDGVPVDEDAFRTFNPNDIETTTVLKDAAATAIYGNRGANGVIVITTRGGKYNTPLTVNYSAQTAFTELIDTDYNLYDAQGYLSLENRRGTGRGATLTQAEIDAFDVNTDWRDTFFRTGVSQQHNLSLRSGGENLTQFTSLNYTKQEGSLLASDLQRMNLRTNISGKSDNGKFKFSTTAALGFSKNNSQTEPETRNNAIYFNSIFNANNGLPYFDPNNIDVELENWVNTLQAVYAPYVTLDNVRLNGNQEDEIKLILGGDASYKITDKLTARYRIGVDYTSEVGLRYADPRSGLARVRASFIGPDEVEGFQTESYFRDFRFNSNVNLGYATKFGKGETDRDKKHSFLANVYLEYVKAHFKSFNFSQTGLDPRTFSPGNDGGAFISDNLDNDEFVPTVGSSKASTGLFSYFGEVDYDYDERFGFTGTLRRDASSRFTEDNAWGTFWSVAGRWNLHKEKFMENVSFVNSLKVRASYGTTGNDRIAGTYYGALNNTRTLFTTGLSYADNQTFVRAQLGNTDLRWETIKQANLGIEFAMFDSRLRGTFEVYDKKTEDLFFNQFVSLVNGVSSVNANLGDIQNRGVELGVSYDVLRANNKDQLGVNVYANVNYNKNKVLFVDLPDGIQDNGTNVIQVGEQINEFFVVPYLGVNPANGNLLFEDINGNPTEAPTLEDRRLTGTDSAPDFQGGFGVNLDYKNFFFETQLNFMTGLSRFDFNQQDYYDITSLGLYNLSADLERAWTPTNRITDIPSLDATNSDPGVTSDRFLKDSDFLRLRFVQLGYNFDQKLLDKTFLSSGRIYVNAENLVTWSEWLGSDPESQRLSEYNRYPTPRTISVGLDLNF

SEQ ID NO: 1721 - protein, 651 aa, Marinobacter aquaeolei
MKLMKAQLVTILIGAMMVGGAASSYAATTDDGVYRLGEVVVAGEESIVESVGTTHKVTAEEIEKRGVRSLDEAIDMLPGVHVRTAADGAPRIDIRGFRTRHVKLLLNGTPFNSTYDGQFDPALISVENIAEITVTTGGGSELYGSGGNAGVINIVTKKATKGVHGSVGAELAEVDATLLRATGAYGTDKYDLFISGSIYERDAYRLSNHYGEEKYEDGGDRENSDRERDNLFVNLGYQPTDATLLGLTFSYLNGKRGKPPIALEGDKKKSGYDPFAKKIKYERQEDEEFNVQLAASHDFAGPLSVKGWAYFNTLDVEETQYKNSDYDEIKSQLDSETEISGANLQLAYDLKNYGHVTLGVMAENDDYEAVDDDGVKSDGDFQLYSASLEYEVTPLNKLGVVVGAGAHWQDRENDNEEDFSYLVGLTYDLFEGTRLKASHSRKVRFPTIRDLYDTDDGKINEDLSAEISWHYEMGIEQMLPASTMLSVTGFYIDIEDYIEKNEDDVRENYEEYEFYGVEVAAENRYFDSLFLRASYTYMHTEDKSDDSDRDELQNRPEHKVTLESTYTLPWGLTAYAGAQYITDNYYYSSDGTQQDRLPSTFLVDLKLNKSAANGAIDLYVGVDNLFDEDYEQSYGFPLAGRTIYGGATWKF

SEQ ID NO: 1722 - protein, 278 aa, Marinobacter aquaeolei
MSYHLFHKRQSFTFRSNSAFLLLLAGYDKPAFIGVNLMELKQLACATLIMSSSSCLYAQPIWQDFSITGLYGEDYAVVDNQQTTITLEYAAKVPYADVFFFMDRMRGGDDHKSTYFELSPRFSLGEMTGHSFAYGPIKDVLISTTWESNNDDFSNFDNFLYGFAVDLNIPYFKYAALNFYRANNERTKDDYQMTFVYGLPFTVKSEEFLVDGFLDWSTAEGDHASEMNWTTQYKWNVGKHISPKTRLYLGIEHSIWNNKFGLEGRDERNVSALIKYHF

SEQ ID NO: 1723 - protein, 303 aa, Marinobacter aquaeolei
MSRFYLCIFLLLTTNASFAESFNDDGGWYLGGKLGATVLDIEAANQTSDPDPSTASMGVVAGYNFNDFLSVESDLSSFGKFKQGAEPEKLVAFSTYLLGRYHVSDRAALYAKVGNSIIGNDLNLSGGIGLKYQISQQLELDTGYRLIGDVPNTEDDLYEFSVGINYKFGKNKPAPKVVPPAEPVIVPTTLNSNTLFKFNSAEISDSSALAKLAKKMSASHVEINVEIVAYTDTSGPEAYNLKLSKKRAEAVRDYFIKQGVNKQVINTAWKGEANPIASNKTRAGRIKNRRVDIIYIENNVVYH

SEQ ID NO: 1724 - protein, 1001 aa, Bartonella bacilliformis
MNIKSVRERLLASTMICGAALATLAASPVSAQTTPAPAADEVEEIVVTGSLFRRTDTETPSPVTVLTSENLQRAGISTASDAIRSISADGAGSIGTGFQSGFSAGGSAVSLRGLGVSSTLVLVDGLRSANFPINDDGHNAYVDLNSIPFSLIDSIEVLKDGASSSYGADAIGGVVNLKLKKQFVGVKGSAEVGQSDRSDAEHRRADVTLGYGDYAETGWNFYVNAEYQKDDRVTSHSRGFPFNTQDLRSIGGLDLNTADSSLTTATPNAVVVRTTQTDLNNPLAGGASLIPSGTYVDGDGKTQNYSNYTTLNTNCANGPYTSTSLSARGSGCKWDLVDTYRQIQPLQKRYAFNGRLSMRLNENIEAYATGSYSNSYVSIKGAPTAVRATQPFGGAPSLASSNPGIVLPVYVCTSGINCATAGAPGQRLNPNNPYAAAFANDPANGAARLYYLFGDIPAGSERSNEVIRGTFGLKGSFGDDWNWSVDAAGARDNLKITQHGLLNIANLMNSINTGSYNFVDPSKNTQAVRDFIAPDKTTPSHSSMMSLDGLITKSLWTLPGGDLQVGVGAQIRKEVLVNNNQNVRLDTYGLTTASAFGKHTVKAAFFEVNAPVLEQLELNVSGRYDDYSEGFSHFSPKFGVKYTPIKQLAFRGTFSKGFRAPTFAESGPRSQYAGFVSTTPPAAFVNAHGTSSANNPYAQQYSLGRGVAGNPNLKPETSRSFTIGAIAEPTSWLSLTVDYYNVKKSDLITSGPDISKAVAAYYGQTTQAAGCAAIAAGYPGYSCNVVDAVDPLYPTAQPRVLIINVPYVNANYAITSGVDFAATAKVPVTDNIKWTSRVEVTHLLKYDLHTSTEVQKYAGTLGPYDLSSGNGTPDWKGNWQNTVDFGRYTVSATAYYVGSIKSVAADTNGSTDCPKGNPYGGAANPAAANKFCKIKSFVNVDLNGTMQLNDGVQLYGNVGNLFDERAPIAPGAYASAPNFLTTFHYAGLIGRTFKVGVRFQY

SEQ ID NO: 1725 - protein, 719 aa, Bartonella bacilliformis
MQIKQTVLAIAITPFISQLSLAQETKISSIELDTIEVNEQQENLLKQQAVMSNEDLVRYSTDMGVPQTGRFGPQGFNIRGVEGNQVAVTVDGISQAASNNYATFSRYSYYNKSRPEIDTELMSDVTIEKGSSTKVGNGALGGSVNYKTKTVSDILMKGRQFGGMLKYTYNGQNKENIETAGIAADGQYADALVMYSHRQGHETQTTSKGPDIMGSGRGLPNPYKNNQYSYLAKLGLKWNDENRLELKTSKQRSKNAGQELSYSTVTLRDFLDVQEIETYGVTYLYTPKNSILENIKVAVTKQDTEISGINDQITIARGTKTDNTKRAFNTKNVEGSLGVTFKPVDLGNTEHKLSTELGYGVSDFSFDMQTYTAGITPTDQNMQSPAKTKSFHILMGDSILLTQNLSAHLNARYEQSKLHSDDNSLSDKTFNNWAGDIGLNYQLSPVWQIGYKLSRGFRTPTASEMFFNREVQGRGASQTFLANTNLKPETSLGNEISLVGNGSLGSLSVAAYHTHYRNLIDLATIGNNIYQSQNVNRAKIKGVDINGTLDLNTAWNAIPQGFELNGGFGYARGKRNDGTDLLTVQPLKALFGIGYRAVNNDWAIHLNGTYTQGKKAKYAQQYAILANTGYLSYDKSLTTYPYLSNSATVFDLVAHKKFGERAIVKVGVYNLFNKKYWTWDSLRTIGITSPGVANSITGEGLNRYLAPERYVMASVEFKF

SEQ ID NO: 1726 - protein, 696 aa, Bartonella bacilliformis
MQYKNIFLSVSALLIFQTFAHAEEQIDLPVTPVTANPLGVSSDEFVIPFSVLNGRELDVQRGNNLAETLENTPGVSFSNWGPMVGRPIIRGMDGDRIRIMRNGINSLDVSSFSTDHAVPIDPLVIEQIDVIRGPATVLYGGGTIGGVINAIDHRIPRQKISGATGRAVTRFGGANSERSSAVVGDIGIGNLVIHLDAYTRKTGNLSLPGYSVSSRLARSDSEVNRNSYGRKGQLRNSGSDSDGGALGASYFFEKGYVGMSYAKHDSEIGNPLTTTGFFDQETNRWDLHSEFHDLDGFFNHFKFKMAHSDYKHDEHHEPGEIEATFENRGLDGTVELGHHAIAGMSGVVGLHFENSTFKQPNGVLLPTANTDSQSVYVYEELPIDEHKLTLGLRRGNHDVKRNAFTGDGGCSVTYTDLVDCAGSGGTEDDQAFGETEKTFQTNNAALGGIYKINQNWSVNSNVAHSERAPAFFELFPYGAHHATEQVHKGNENLNTELSNTIDLKVNWKKNGHYFSVGPYYTKFNRFIGLFDTGNELYHLHEGEDEAEAMSVFQYRSVGATFKGLEFDGNYQINDQFNFSYKGDYVRAEQDNGDELPRISPLRLGAGVSYEKNRWYARMDVLRAFAQDNIAANELKTDGYTNLTAYAAYQFPIEYNLQFFMKGHNLLDQEIRDHASFMKDKFLRPGRSVLFGLRGDF

SEQ ID NO: 1727 - protein, 1079 aa, Bartonella bacilliformis
MKNEKHKVNSLVKRVCLVLSLLTPGSSMMVIASDEIAIVQQTGNITVTGTVVDQTGEPVIGVNVLVKGSTNGTITDIDGKFSLKGVSPNSILTVSYIGYKTETVNLNGKKVLQIILKEDSEMLNEVVVVGYGTQKKVNMSGAVDAVSSKVLENRSLSNAGLGLQGAVPNLNITVTDGNANSSPKYNIRGIGSINSDSAEPLILVDNIPVTADEFSRMNANDIENVSVLKDASSAAIYGARAAFGVILVTTKSAKSEKISVAVNAYYSTRKITRLPEHVTDPYQVMTIQNQARTYSFYTEEQMAEAQKRVNDPSLPAVIVDPSDPNKWAYYGQTDWMDETYKNAAPSYTVNFNIAQRTKKAGYYLSGEYYRQDGMFKKGNDIYDRYNMRAKVDFQLTNWLNISNNTSFAFRKYDKPNIDMESFFHEVNRKSTLDVVRNPDGTYTKSGGAILGLLENGGRSVNDRRDFSTTFAATIDLLKDVWQIKADATFRRDSERTRRASLPYSYKQGPEMALEQNTTTSSARNDSQFYDNNVFNIYTDFHKTFAGQHFVQAMVGFNQENTRTNSYWSSRDQLISTSFPTIELATGTVKTSESITDWSVRGAFFRLNYVFDNRYIVEFNGRYDGSSPFPKNDRYSFFPSVSAAWNVSQEKFMENLKNKIGLNTMKLRGSYGSLGNQNVGAYAFSPQMKAEESKWILDGKKPLQVIMPGIVSSSLTWEQVRTINGGIDLGFLNNRLTAGFDYYVRYTEGMLTKGKSLPSVLGTSEPKENAADLKTRGWELSLAWRDQFNLADSPFSYGVRFIISDSRSFITKFDNYVWDTDKNGNKIRTSIWTNDNHYVGKELGEIWGLTTEGFFQNEEELANHADQTKVGEDDMGYKFYVGDLKFKDINGDKEISNGKGTLADPGDFKKIGNSSIRLPYSIDMDANWKGFDLRIFLQGIGKRDWYAGGGNHYFWGIYAQPWTNVQKGNLDHWTPENRNAYFPRVKPYIAESTGSELACPQTKYLQDASYLRLKNVTFGYTLPKTWTSKVGIERVRFYFSGENLCELQHLKANLDPEALDSSSKTYPLQRSFTFGVNLNF

SEQ ID NO: 1728 - protein, 731 aa, Bartonella bacilliformis
MKDSLHDLIARAALTIALALSVPAEPLPVAMADDPAGHNLIQRTNSEPEEFGGLDIEQLSRVRIVSATLTPTQVRLVPAKTTVLDEATIAQSGARNLNESLEIYAPNTQLILHNTHLDHFGIRGIISDRDDKYLLRVNGKVMNNRFFVGAESERDLPLLGDFRSVTLVHGPASATYGAGALAGVMNLETYNGLTFEGTDAQVRQGFRDQFTAGEFRFGQKFNEESGLFLYVGVADQSGSNQHDSPYVFGKSFATPGSGPAVVSGQPVTFPEPNLHDAGDILKMKYHASYVNGPVEIWARFTQGGGVVRPMRTSLQTVDISIAQKGRANLDRQFTAATKYKQDLSKVFNLETFVSYDWYQYRLWVYDQFADPQNRQEHEAYGRMLGTWTPNEKQSLAFGLEYSHMWFDGPRLGFGPGPGIPPVEDAWETDTISFLVEHQWHLGEKWTTFASARVDKHTYTDWLFSPRLALVFTPGSKDTLKLIGARAMRRSGEGELREEHVRSGTQGDTETLDSLEFRYERQHDAHWNFGCSVFIEQNDAIGFDAAANRSVAVGTFRIWGVEPEITFRSEKTRLTFSHGYTKLFDSSLASAATIQGITAEPYGFGHDLANWANNITKLALIQELNGKWAASTSLRAYWGFPGAKALADWNGAQSQPRSFALADPGYDAAYGPSVFWNAGLEYRPTKHLTVRADAFNILGWADQTLNKRIYFFRGSDYSSEAASVALSAKLTF

SEQ ID NO: 1729 - protein, 1364 aa, Bartonella bacilliformis
MNKIYYLKYCHITKSLIAVSELARRVTCKSHRRLSRRVILTSVAALSLSSAWPALSATVSAEIPYQIFRDFAENKGQFTPGTTNISIYDKQGNLVGKLDKAPMADFSSATITTGSLPPGNHTLYSPQYVVTAKHVSGSDTMSFGYAKNTYTAVGTNNNSGLDIKTRRLSKLVTEVAPAEVSDIGAVSGAYQAGGRFTAFYRLGGGMQYVKDKNGNRTQVYTNGGFLVGGTVSALNSYNNGQMITAQTGDIFNPANGPLANYLNMGDSGSPLFAYDSLQKKWVLIGVLSSGTNYGNNWVVTTQDFLGQQPQNDFDKTIAYTSGEGVLQWKYDAANGTGTLTQGNTTWDMHGKKGNDLNAGKNLLFTGNNGEVVLQNSVNQGAGYLQFAGDYRVSALNGQTWMGGGIITDKGTHVLWQVNGVAGDNLHKTGEGTLTVNGTGVNAGGLKVGDGTVILNQQADADGKVQAFSSVGIASGRPTVVLSDSQQVNPDNISWGYRGGRLELNGNNLTFTRLQAADYGAIITNNSEKKSTVTLNLQTLKASDINVPVNTVSIFGGRGAPGDLYYDSSTKQYFILKASSYSPFFSDLNNSSVWQNVGKDRNKAIDTVKQQKIEASSQPYMYHGQLNGNMDVNIPQLSGKDVLALDGSVNLPEGSITKKSGTLIFQGHPVIHAGTTTSSSQSDWETRQFTLEKLKLDAATFHLSRNGKMQGDINATNGSTVILGSSRVFTDRSDGTGNAVSSVEGSATATTVGDQSDYSGNVTLENKSSLQIMERFTGGIEAYDSTVSVTSQNAVFDRVGSFVNSSLTLGKGAKLTAQSGIFSTGAVDVKENASLTLTGMPSAQKQGYYSPVISTTEGINLEDKASFSVKNMGYLSSDIHAGTTAATINLGDSDADAGKTDSPLFSSLMKGYNAVLRGSITGAQSTVNMINALWYSDGKSEAGTLKAKGSRIELGDGKHFATLQVKELSADNTTFLMHTNNSWADQLNVTDKLSGSNNSVLVDFLNKPASEMSVTLITAPKGSDEKTFTAGTQQIGFSNVTPVISTEKTDDATKWVLTGYQTTADAGASKAAKDFMASGYKSFLTEVNNLNKRMGDLRDTQGDAGVWARIMNGTGSADGDYSDNYTHVQIGVDRKHELDGVDLFTGALLTYTDSNASSHAFSGKTKSVGGGLYASALFNSGAYFDLIGKYLHHDNQHTANFASLGTKDYSSHSWYAGAEVGYRYHLTKESWVEPQIELVYGSVSGKAFSWEDRGMALSMKDKDYNPLIGRTGVDVGRAFSGDDWKITARAGLGYQFDLLANGETVLQDASGEKRFEGEKDSRMLMTVGMNAEIKDNMRLGLELEKSAFGKYNVDNAINANFRYVF

SEQ ID NO: 1730 - protein, 240 aa, Bartonella bacilliformis
MLKKLCVILFISSITINSHAKNMYDNVDTATSYDSTYYENEGSLVFKMRLGGIFASAKQKGLPTHSSVQPVSVGEIAKNGYGGDASTTIFFNNYLAAELSLGFNVLRTKYTSLAAVAHNYGINNVKLGKHKPIYMIPATLTGQFHIAPYGGIRPYIGIGYHGSYMLTQATGLKIRNGYNAVGQIGVDFYAKDDTLINIDVRQFFLKPKLEYKSNLVGNKKVTSKVKLNPLIVSIGIGFTF

SEQ ID NO: 1731 - protein, 821 aa, Bartonella bacilliformis
MKMRSLLSLSIAGLLSAPVYATTVTGKVTDTAGQPVAGAEVKIEGSRRVAYTDENGVYRFDDVKQPHIHLHVYSSNFIHGDNDLGDVDTDQNVDFVLKPASVENIVVTANALQSSVLESVTPVTVIGAEKLRKIEAPTLGETLKNAPGVHSTYFGPVSSSPVIRGNDGPRVKIVQNGLDVSDVSRVGPDHNVATSLASATQVEVLRGPATLQYGSGAIGGVVNVVDKRIPQYQLDGVEGEAETSYSTVNNGSYTRADVTGGSDNIVWHVDGFYRDTDNADIPGFASIDPDEDEPNGELESSAMETRNVVAGLSYVAEEGYFGFAVEQLDNEYGVPGHSHGHEDEHDEHDEERDELDGNHEDEDHEGEEGVLLDVDMTRYQAAGEWHSPIQGLTNLKFAAAYTDYQHAEIEDGEPGTVFTNESSDIRLSAYHEEVNGWHGVLGVQFNHSDYNAVGEEAFTPGNSTSSYALYVIEQKNVGDVTFELGGRLERTTLDAEASEIELEVLHEAHEGEEHDEDHEGEEHEEHAVAFTFPDYDFTSVSLSAGANWEYQEGHSIAVTLSRSERAPSQQELFSAGQHLATQSYEVGLVFDMDDEGHIEETLKGVKEEVSTNLDLTFRKFTGDWGYSVSFFYNQADDYIYQTSKGLIALTEHEEHDEDEAVEEEHDEHGNEEGLPVYYFQQADADIWGFEAETYVDLSDSLRLTVFGDYIRAEVEDDNLPRTPPMRFGSELSYVNDGLSADVGFTWYDEQNNVASFETTTDGYTLVNASVQYEFATQNIDWVVFARGDNLTDEEARVHTSFLKDQAPLPGRNFTMGVRALF

SEQ ID NO: 1732 - protein, 300 aa, Bartonella bacilliformis
MNIKCLVTASVCALISASAAQAADVMIPQEISPIISAPTFSWTGLYLGGQIGGLSGKHDFKAIGKDSEWPFANKDLKVSGFVGGLYAGSNIDLGSGLVLGVDTDIVWVDKEGKLFSNHRAETQDDADAFKQIFDENKIEVAKGQIKELTQNFSLKEKWAGATRVRIGFGADRIMPYVSGGVAYTQVQAIGSAILKGTKDTGTEGGGGTEGGGGTEGGGGSASKAVRSEALDVLASGTITDEKKTLLGYTLGAGVDFAMTDNVILRTEYRYSDFGKKKFVKDAIETNYKTNDFRVGVAYKF

SEQ ID NO: 1733 - protein, 1072 aa, Bartonella bacilliformis
MNKKNLIKGTTLPVALFFSFALIPTFGNQGQAVAAVDIVQQQGSIKGTVVDDKGEPVIGANVLVVGTSVGTITDIDGVFKINAKAGAKLKITFIGYTEQVVVAQNNMRVVLSEDATTLQEVEIVAYGVQKKVTMTGAVASVKTEALTRTSIGSVSNVLGGQMAGLTTIQTSGEPGADAAEVFIRGKATWGDASPLIQVDGVERSMNDIDPNEIESISILKDASATAVFGVRGANGVILITTKRGREGKAHISFSTSASIQMPTKMVETANSYEYAMFYNQMMANDTPAGEKPVKTFSDGVIQKFRDGSDPIRFPSINWIDYIMGDATLQSQHNLNISGGTDKVRYFISAGAYTQGGLFNEFSLPYGISYQYRRFNYRSNLDIDVTKTTTISFNVAGNVNSSEKPRTSQGSSGMVKNIYYSTPFRSAGFVNDKLVYTTTDSQSDGLNLPFVGDADPFTYYGGGAAHSINNSLNADLILNQKLDFITKGLSFKLKGSYNSSFTINKNLSGGTEMTYTPVLQSDGSVGLRPIDGSKYTNVSYGITRGKSRNWYMEAALNYNHSFGDHNIGALVLYNQSKEYYPKEYSDVPRGYVGLVGRVTYDWKNRYMVEANMGYNGSENFAAGNRFALFPAASVGWVASEEKFWESVKPVISFLKLRASFGLVGNDKIGGSRFMYTANPYHVNLNGYVSNSGYGTGNLAQLQAAYGYLFGQGGQTSTVSLGAHEWAINNANVTWEKAFKQNYGVDINFLNDRLSATIEYYKEHRWDILLQDGTAPSMLGFAQPFSNLGEVNNWGWELSLKWNDKIGKDFRYWAGINLSYNQNEIIERKEAPQEYDYLYQKGHRIGSRKQYAFWRYYDEQTPALYEQTFHRPFPAHSVVLQDGDAVYVDLNGDRKIDENDMGYDYGFTDDPEYMVGMNLGFSWKNLEVNTQWTGAWNVSRMISDVFRRPFLSSSGNVAGGLLAYHLTNTWTKENPSQDAKYPRATWENADNNYAESTLYEQDSKYLRLKTLTIAYNFQFPLMKKLGMSTCQLSFSGYNLWTLTPYLWGDPEARASNAPSYPLTKTYTLGLKLGF

SEQ ID NO: 1734 - protein, 709 aa, Burkholderia mallei
MRTQFIARWGTQLIVSSLTITAGMLWKSSSIIATEVLQISEFPQEEGSAKDLQPVAEVTSQNTTETEPDIELTVIDKLLNEPVFSPFRREGTVKDSTRPVYVITGEEMEAQGARTVREALRFLPGILGDGTVGTEVNALSGQFIRGSNTGQVLILLDGRPINNLGGGGFDLSEFTTNNIERVEVLPGGGSTLYGSDAIGGVINIVTRRPTEQITTETKVNFGSYGLNQQSIQNSGKSGDISWVVGYNRTQAQNNYRFRIPEANFEGTRRNNDALFNNFNVKLEANLGKRNTLTLSTLYLGKEQGVPGGVPIPFPQFGQGFFNSLTENNRKYTDQVLTDLTWNSQLGSGDDSLLTARVYADFLNTRFDNRSGAITSQNRFDTKQDSYGIQVTHNWNVAKNQTLVYGFDYRNTNVRNTTFNYGTNITRENYDDAIGQGAIFGKYEVNFSPSFSMNLGVRQDFSSLVNGSFTSPSVGAKFALSDATTIRANYIRNFRAPTIANLFNTNPTNIGNPDLKPEQGDSFDVGIDQKLGNIGLLRLTFFSNRVSDTIAFKSLIPPVNGNTGTWENIGLVQTTGIEASLNLQLARNVYAFVNYTANNPRILESANPAEIDKELRFAGADKLNLGVSYENPQGWYFGVLMNSLNGYPTNNINTEFLSGYTTFDLKMRMPISDSLTLTGSLDNLFDQRYQLFPGYPDGGRVFQVGLSSRF

SEQ ID NO: 1735 - protein, 371 aa, Burkholderia mallei
MGFQSRKMMAALVAAGPALACAQTSVTLYGRVDGGVEYLNHIAKPSGGSASRWSAESGDWGTSMFGLKGAEDLGGRTSAIFNLETAFQVMNGTTGGGRMWSRRAYVGLKNDTWGTLQAGRNLFIDSDGVWEFDPFVQQAFSSASLVRGRNWQQTSNNVEYHSPVFGGFDVQAQYAFGNQSRGFNYGAQGDFGRSEGVMVSYHSPLLDVRGIYDELRDSNGRMSNIFSSSREYFIGANVKVQKFKIQGAYTHYSAPDTPAGLADRADHFWLGATYQADPQWAVTGGGYYVRVRGGDGGDASHDPSGHAIMYALGTTYNLSKRTFLYGTLAYVRNGGNSNFSLLATPRDATPNTSPLAGESQTGAYVGMMHTF

SEQ ID NO: 1736 - protein, 1131 aa, Burkholderia mallei
MLMTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASDGDRIDYALGVARETAYQAREYQGSLVKSGGGTLTLAGANTYRGPTTVDGGELRIDGSIAARAVVNPAGWLTVNGRAADIAVNGGVATIAGTSANLSIDRQGRAAVTGTTADVRVASGFASLGGTSGSVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVREAALERLWTARGAPGRAGAWARLLGAWGSARGGDVNGYTSSTGGFLAGADAALLDGVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFIVSSVPVAKDAAVLNVGAGLELGKNGWLRVGYSGSLASRQSEHAVQGSLHWKF

SEQ ID NO: 1737 - protein, 384 aa, Burkholderia mallei
MKKHVILTAALAACAAPVLAQNSVTLYGLIDEGFNYTNNVNVNGLGKTNYQLASGYAQGSRWGLKGSEDLGGGLKAIFTLENGFDVNNGRLGQGGRMFGRQAFVGLSESRFGTLSFGRQYDSVVDYLAPLTANGNWGGTLFSHPFDNDNTDNSFRVNNTVKYASADWNGLTFGGTYSFSNSTGFSNNRQYSLGAQYSLAGLQVAAAYLQANNPGAGNAGAIAADDANFVADRLRIFGGGINYTFGPATVGFVYTKTDVKNPVSTVYLPASTFSGLGLSATKFQNFEVNGKYQLTPDFYLGAQYVYTDGKFDAAAGSFKPKYHTVGLMADYSLSKRTDVYLQGAWQKVAGDKTGTAADGGYVVGTDGPSSSSNQFAVRAAIRHKF

SEQ ID NO: 1738 - protein, 1183 aa, Burkholderia mallei
MADMNTQSMRQVSHGGRMTKWKGSVASMAPALVSVSIIALSSGPAHAQTVISTDETSQQVIAIDEDVTVTETGSVRLVGEDNLAAEDNLAAIEINVADYTSDVLLQGPLRVHGGDGSSSTAGLYLTGNLSGTITNQGVITVYEVLDSNSVSFNGIFVGGDVSGTITNEGTIAIDAAAIDYYASAIGVYVSGTLSGTVRNDGMIAVEAITFTEGATAWGVYVDGVTGTALIENNGTITARALTLDEGPAEAYGIEVEGGLVAGARILNNGLIDVEAESLTYAATGSGIYVDGDAAGEITNTGEIRVAAIGIGVTVETMSAYGIYVSSTLSGTITNDGLISVDIMSISGNDDYSAAGIYTGDVSADGAITNNDTITIAVQPEDVPVTSTIAGIWVDNMDGTLTNDGAITVDVNIEEVWGGELYAYGVFVDRDMGGSILNSGTIDVVVNATAADTDISVYGISSRNISGSITNDGSIDVAVTLAGSGSLVQVTADGIQVGTVGTTGSIDNSGSIVVSATVTADSNTDNASARAIGVEAGNVDGTVSNDGTIEVTATATGFAPGEGFFPRGFGIKVAKVRVDGSIANDGTITVAAMASGTATTVQALAFGIGSDDMYGSISNDGTIEVTATADGSAPSGLSALAYGIEADSVQTGSTVTNDGSIEVSATASGNSLFGPISAYAAGIKVDASGGSVTIDGAVSNGGTIAVVAVATGSGFSAGSANAYGMEMGIVDATGSVSNTGAILVEADAYNDNTSAPSTSQAVGIDIDTLNGTLFNSGTVMASTANGGDAFAVRVASGTGAALFTTQSFFAGELSLQNDELTVESVAGAGSIYWDFTDIPGSVTLDDANGPTLYQSGNVVATVEPANLAFSGQIAADVAGLGASTVAAVLNGTPTSGATVSRNAKAATPTFGAGISTFVQGDYVSRQLDDAVGRELNVDVASLTAGIVGGLQNGLGYGVTLSAMNARGSVYNGFANDTVDTNGVVLGGYGNTAIGSASLTFGATFGLLSNERIRSVNDNLAPGGVSTVLANYDSSFFSPSVELSLASVQSGAVTIQPYVGYRFTQLSVDGYTETGGNAAATFGSRNVSVSDFTIGADMSMALGMGMLTGSAEIMRRDVSDDGTNVTFFGTTGNTATAATDFTALELGVGYDIDLETGTMNFGISGMVGDNGVSGYGLTAGYNVCF

SEQ ID NO: 1739 - protein, 374 aa, Burkholderia mallei
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHPLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTIRADNYEANVKYNLTPALGLGVAYTYTNAKANGESTHWNQVGVQADYALSKRTDVYAQAVYQRSSKNANASIYNGDLSTPFSTSINQTAATVGLRHRF

SEQ ID NO: 1740 - protein, 400 aa, Burkholderia mallei
MHIRTWIAAGVAGAAVAPACAQSGVTLYGTVDTGVIYSTNQQVTHADGSTSGDHAWQMGGGNLVPSRWGLQGTEALGGGLKAVFALEQQFLSASGQALQGGAAFSRQAWVGLRHDRYGTLGVGRQYDSYTDTLGAYVSSNSWATPYGSHLGDVDNLNAAFNFNNAIRFTSADFHGLTFGGTFGFGGQAGDFSARRGYALAVAYNRAPVSFGIGYLNLRQPLDAALGGANGYIGDFACGNAGAMYCLLQDAVSMKAFGVGGSIAFGEATVALTYTHTRLGDSAYFAAAARAQRASIAFDIAELNATYAFTPMLRGGIAYVFNRAKADSRGVTRFHQLNVGVNYSLSKRTALYAVAIGQIASGRGLGSDANGDPVNYAQIPVLANSNSNRQLAMMAGVKVDF

SEQ ID NO: 1741 - protein, 383 aa, Burkholderia mallei
MPTMKKSNVAVMGALALAIGIAPGASRAQSSVTLYGILDAGITYVSNTGGSHVFKFDDGVSYGNRIGFKGTEDLGGGLKAVFVLESGFRLGNGQLGFGGAQFGRQAYVGLQNNWGTLSFGNQLDMTEEMVYLNNISAWASGYAIHQGDFDRFNGDRLPNSVKFLSNDFSGLKFGAMYSFGNVAGDFHRNSAWSAGANYTHGDLSVGAAYTHLNNPSGIYAFDPYAMIGTRTFLGQPTVSVDPATGKVTDLFANTPMNIDSQGTFGVGASYTIDKLTLSGNFTYSTIKGFGNTSHMQVYEGGGLYQFTPALSFVAGYQHTRFEGHHWNQGSAGVHYLLSKRTDVYLSGDYLRASNGVDAVIGYSFTPSTTQTQADIRIGMRHSF

SEQ ID NO: 1742 - protein, 95 aa, Burkholderia mallei
MKKAAAAWLVAGSMCAGAHAQGTVTLYGIVDAGLGYTSDQRVAQTKGALGSPVGYRNESSYGFASGTWSGSRWGAEGQGGAGRRSCSRVPARERL

SEQ ID NO: 1743 - protein, 1130 aa, Burkholderia mallei
MARRNKQKTMKRRGATLLAPVVVAAAAAVAARPGWTQAAPYQDPGRRGDPASWRTPEFTNAWGLGAMHAEYAYAAGHTGANVAIGVLDSGYYAQHPELPGSRFVPVTAAGVSGVLNANNNNHGTLVSGVVGGVRDGVGMHGVAPDATVFEGNTNATDGFRFGVSDPKFPASDAKYFSEVYDALAAKGVRIISNSWGSQPANENYSTLNTLTDAYKLHEAVRTATGQGTWLDAAAKVSRDGVINNFSSGNTGYDNASLRGAYPYFHPELEGHWMTTTGYDQLGGQVYNKCGVAKWWCVMAPTGVPSTSYSGGAAAPTGATYANFNGTSAAAPHASAALALIMERFPYMTGEQALSVLFTTAQNMEADPSRPDYTNNGLFSPVHPAKPGASGVPNGFGGWGLVDLRRAMNGPGQLLGTFHAALPAGVADVWSNDISDVALAARKLEDDAEHRAWLDTLKTKGWERGLPAGASDGDWIDYALGVARDAAYQAREYQGSLVKSGGGTLTLAGANTYRGLTTVDGGELRIDGSIAAGAVVNPAGRLTVTGRAADIAVDGGVATIAGTSANLSVDRQGRAAVTGTTADVRVANGFASLGGTSGNVAVGALGVTVITGRTADVAVDGGRASLDGASGNVSVGNGGIVNGNGTVRTLTAAANGTVAPGHSVGTLTVSGDVRFAPGSAYAVEVSQGGASDRIVAGGRAQIDGGALTLALENAPPPLTPDQSRSVLGRRFEILNAAGGVAGRFDAPGGYLFVDPVLAYGPTSVSLTIDRNATPFASVARTANERSVADALETANPGSAVYNSVLLAASAQAPQATLSQLTGEIYPAAYAALVNESRQVRDAALDRLWAARGEPGRAGAWARLLGSWGGARGSGDVNGYTSSTGGLLAGADAAVLDGVRAGGFAGYRHTGVNLRNQPSSASFDSFQLGAYAGWQPGALGVRVGAAHAWHRGGVDRAVQYGTVAESETTTLHAETTQVFGEAGYQLALGGAATVEPFFGIAYVHLKNEGTTETGGAAALRVQEGNHDVTFSTLGVRGETRLGLTSRLQLTLQGSAGWQHALTDGQPTGALAFATGSNTFIVASVPVAKDAAVLNVGAGLELGKNGLLRVGYSGALASRQSEHAVQGGLHWKF

SEQ ID NO: 1744 - protein, 209 aa, Burkholderia mallei
MAGGFANDRLYGAALQYQRGGLTVGAPYPKMNRARSADAAGAVTGDNTFDASSQRNVGIGATYAFSKALIGFAYSHVGVYDPTSNAYFTGTTRPAGGHWQSWKFDHFEINGRYRVTPAFYAGAAYTYTQARADSTAGAFHPKWRPLSTKLDYDLSKRSSGFAEGVYQHAQHAMNARTGTDFDHAYIPGAAHIASGPNQYVVRLALPHPF

SEQ ID NO: 1745 - protein, 359 aa, Burkholderia mallei
MDKRLSALCGLGLASAGACAQTSVTLYGVADAYVEYATNQADAKGEPAALARMGSGGKSGSRWGIKGTEVLGGGWRAAFRLESGVNLNNGAGTGAGGFDRSAWVGLEHPRWGALRFGRQYTTMFDIMEHYSPTGAYSTLYEPDGAIVGISFRENNVVKYLATAGPLTFEAHYAFSNEPGAFQASAAHGAGFEYTGGALSFAFAYDDVHTPQAGGFAHLRRYAAAAMLTVEATQLIAGAAHGQGNVATPSVVTRYTFWWIGVRQAITPVVQLIGALYAERVRAQNPASPPAARHASGTPQQATLQLNYFVSKTTTLYAATGYARHAALDFDNYNYSFLHYSLAGARAGSAGVAVGVRKLF

SEQ ID NO: 1746 - protein, 308 aa, Burkholderia mallei
MMNAFNKTLLVSALTAASLASAQAAEPLTVYGKLNVTVQSNDEAGESETVVQSNASRLGVKGAFELSSSLEAFYTIEYEVDAGSDAKENFLARNQFVGLKGNFGALSVGRNDTMLKIAQGKVDQFNDLSGDLKSLFKGENRIEQTVTYLSPEFGGFKVGATYAAEGAKSQAGEDGFSLAAMYGDASLKKSAFYASVAYDSEVKGYDILRATVQAKLAGLVLGGMYQQEEKSVDGDSKTGYLVSAAYNIADVTLKGQFQDMEDKGDSWSIGADYKLGKPTKIFAFYTSRDMESAEDTDNYIGVGIEHKF

SEQ ID NO: 1747 - protein, 431 aa, Burkholderia mallei
MPAARARNHIHRRINWFSVRFPVRIVQRFERQIDHEENHHMKQTKHLAALAVPAGFLLSAGAHAQSSVTLYGIVDAGIAYVHNVQGADGRNEASLFKFSSGNLSGSRWGLRGTEDLGGGLAALFQLETGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAAVIDAQASVGSYGANSGTDSQELAIVGIRHKF

SEQ ID NO: 1748 - protein, 681 aa, Burkholderia mallei
MSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGKLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 1749 - protein, 366 aa, Burkholderia mallei
MTQHNFDANNSLNENIDNLAKNEVADNHNLTDESKINSTTEKDFENSENNLVHYANNSLTSTKDSTTTEFAPRRVVNNTDILISNIDNRLNSLTRSFAALAAGDEEQIYGFYINPFIGKATQKETKEISRYHSTSKGTIIGHDAHLNDSLQLGANFTRVETKFNFPRYKTTVRSNYYSLYGLYTPSNQNIFTSIIGIYGISDIINFNQIKNTHKAYTSTIQVMLGSNYKLFSTTHIKPMLGLKYSKIREASYLEDNLSIASVKERTIEGILGVKLANSNTLKSVIITPEIYAFAHKNIKSKIPSAQTNIIDNRILPIYIRKLPLSFSYGAKLSLKTKSIEIGINYNGTKANKFISHLGSINFKINL

SEQ ID NO: 1750 - protein, 673 aa, Burkholderia mallei
MDFAWDLAFMIRTNRTREMLVAGTMLAGLGPLATSVAAADLPVKARMAQTVFDWTGLYVGAHAGYTRDHASATLSDPTGVASAGSRFNGLTGGVQAGYNWVTRSGLLLGLEGDFSFPNYLTSNHTVAMLGTPGASVSELWDYVATARGRVGYANGDWLAYATGGVAWTGGRFINTDPAGNTEKRLTTRLGWVAGAGIERAFAPDWSWRLEYLYYGFENGGVRFGNGASYNSALDFQTLRVGLNRKLDFAGGQELKLKKDPSDTESDRWEIHGQATAIAQGYPAFHARYTGANSLTPASQLQETWSNSLYINARLWDGGEVYYNPELLQGFGLNNTVGLGGFSNGEAQKSDFPYPHYNTSRLFLRQTFGFGGQQEQLGSGQLQLAGKQDISRLTVQVGKFAVLDVFDGNAYAKDARKDFMNWSIWAPGAFDYAADKLGLTYGATAELNQKNWALRAGYFLVDSTSNSNSFDMNVFRRGGYVLELETRYQLFSQPGHLRTIGFFNNTFSGSYRETLDNPALNADITQTRRGRPKYGYVISFDQALSDELGLFGRWSWNDGKTEIMAFTDIDNSLSFGTSIKGNRWGRPDDTIGIAGVTNGLSRDHRDFLAAGGLGPLIGDGALNYRRETIIEAYYAYSINKYLTFTADYQFVNNPAYNADRGPVSIFSGRLHGDF

SEQ ID NO: 1751 - protein, 383 aa, Burkholderia mallei
MKKSLLALVALGAFAGAAHAQSSVTLYGIIDEGLLFNNNAGGKHLYSMASGVMQGSRFGMRGTEDLGGGLKAIFTLENGFDVNSGKLGQGGLMFGRQAYVGLSSPYGTVTLGRQYDSVVDFVGPLEAGDQWGGYIAAHPGDLDNFNNAYRVNNAVKFTSNTYGGFSFGGVYSFGGQAGQFSKNQVWSLGAGYNNGPLVLGVGYLNARTPNQFGGMFNNGSTSSSVSSPIYGAYANNANTYQVIGAGGAYTFGAATIGATYSNTKFKGFSAGPFVNQSATFNNGELNFKYQLTPALILGAAYDYTQGSKINGSSAAKYHQGSLGVDYFLSKRTDVYAIGVYQHASGNVLDANGNVIQATAAINGLAGSSTSNQVAARVGIRHKF

SEQ ID NO: 1752 - protein, 756 aa, Burkholderia mallei
MSRAPHAPSRRRAFGRGFAAAARAAHGAPVAHGAHACFAAASRRATAVERCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGPRLSYRFHLSDERTRGFVERGEAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFSQRVGDTVVQRAGNVPHDIAQQSANLWIGWAFAPGWRANAGLRYVGPRYGDDANRVPVPSYTVFDASLAWRATRDVDLALYARNLANRTYAASTSNGGAQWLLGPSRSAELVATLRF

SEQ ID NO: 1753 - protein, 290 aa, Burkholderia mallei
MRGPRAHRAIEVLGDLMKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGHGVIRPPGPSGSLGNVDLDKPANQPAVKNARQWSPTIILNYYFNAPSAKFRPFVGIGVAYSWFSNIELNGNFAKDINDNLGSVLAAGAGKPGPTSVEGKASSSFTPVYNIGASYAIAKHWALTATLSYMPLKTYSSLVIKAADGTTLATTRTRLKADPLITFVGISYKF

SEQ ID NO: 1754 - protein, 874 aa, Burkholderia mallei
MTTEKLRSRLPIKPLVGSVAALLLCSHAFGKPETSDITWLTAPSDNNWFNSSNWSPAIVPDNSGTTAHFDQSNITNPDLGDSFIQLGGITFNSGANAYTINVNDSSVQFWNTGIVNQSKVTQNIVVGGGSDGGGTIEFFNSATAGQNTTITLLGSVTGGEGSVVHFWDTSSAGGATIVAMGNGGTLSGNVGGGAGIYFLDDSTGGTAAIKVYGNGFLDISNHNPGSVMIGSLEGNGNVFVGSNNLAVGSNDRSTIFSGSIQDGGEGGGTGGSLTKIGTGTLTLTGINTYTGNTIINGGALIVDGVIASPFTFVNPGSTLGGHGIIGGSVINNGLVSPGNSPGTLTINGNYAQTSIGGLLIQVATHHTFDHLIIGGAASLSGTLYVQPLDIPKLKKGEKFQFLTAGGGVSGTFGEVVQDKSTLMRFKVKYGSNDVTLRTYVAPFTSIGGLTPNQQSVASALNQLTNDKNASKLINFLATQPIGNLSGDFDKLAAEEFTSIFTIGTSFDNVQSLTLQSYLDSLRSGTGYSAGGLALNGFSVNYAGPISFRTGAAGPNGDDGKSSKEVQQVAPAENRWGAFLTGTGQWVGVSDDFNARGYDIATGGFTLGVDYKVCSHCAVGIMAGYVGTSVDAADGGRVLVNGGKLGLYATMFQNRQPAPPASTGLSKDSSKESKQVVVPAEVDPGWYADIAVVGGYSSYDLHRSGLEGTARGDTDGGDLNVLFGAGYDFKRGNFTFGPTASFNYTYVGVGSFTESGSLAPLRIDSQGQESIRTAFGMKASYDWKVGGLLIKPELRAAWQHEYGDSAYALNSSFADGNAGNFTVWGPRIGRDSFLLGAGFAIQLSDRLSTYFYYDGELGRTRYDSHSVTGGVRLAF

SEQ ID NO: 1755 - protein, 407 aa, Burkholderia mallei
MSARAARQLPGNRRLARLAGAAAAACAAGFGASTAHAQSSVVLYGLIDTSITYANNQRTHGAGSPGGPGWAVTSGALNASRWGLRGREDLGNGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGQFGNNAAWSAGLSYANGPLKLGAGYLRINRNPNAANANGALSTTDGSATITGGSQQIWAVAGRYAFGPHSIGAAWSHSATDRVSGVLQGGSIAKLDGNSLVFDNFTLDGRYVVTPRLSLAAAYTYTMGRFDARSGETRPKWNHMVAQADYAFSIRTDAYLEAVYQRVSGGNGIPAFNATIWTLTPSANGNQVVVALGLRHRF

SEQ ID NO: 1756 - protein, 738 aa, Burkholderia mallei
MEWATSTRVRAIAAAAGVAFCAAASHAQAQAVRPGADARQPGSQVNGDTAAGGTLPAISVSAGAERDASVGLVARRSTTGTKTDTPIVEIPQTINIVTAQQIEATGATDINQAFRYIPGFSTYGSDNRSDWYAALRGFTPTVFVDGLQVPNTINLSSWRVDPYMIDSIAVLRGPTSVLYGQGDPGAIVDVQSKLANGERIREVGVQVGNYARKQLMFDIGDKIDKDGTLSYRIVGVGRDGNAQTGPLADQRVSFAPSLKWQPNANTSLTLAATYLQDWGDTSSNFLPSRGTVLPNPNGMISDDLYTADANFDHYRKKQWSIGYQFEHKLNPVWTFRQNVRWMHLALDDASVYGGGLDGADPTMATMTRYAGLFQFNYSRFDVDNQAQAKFTTGPLSHTLLFGFDYNRQTTTDSEWLAKGPGLNLYRPVYTPIPADIFSGPNAYPRTDTKTTLNAFGLYVQDQIKWQRWVLTLGGRQDWTRTSQDDIANSASFKQNDHAFSGRVGLTYLGDYGLAPYLSYSTSFNPQIGVKLAGGGLATPTKGRQIEAGLRWQPPGKNLMLNAAVYQINQTNVAMSNPNDPTSSTFVQVGEVRSRGVELSAVGNLSRELSVIAAYVYQDVKNVQANDNTLNKWPVDVPRPRQIASLWADWTWRNGPLTGFGVGAGVRYMSAAAGAADNSLTVPSYTLFDAALHYELRNWRFALNATNLFNRRYVAGCQSDSVCMYGNQRTVIATAKYNW

SEQ ID NO: 1757 - protein, 869 aa, Burkholderia mallei
MRRQARFAAGLFVVCNPLSLLTNAQRLGIRMMTILGAARSPAGLFFSVSFVGLAAFGGREAAAQGVFDAAAAGPFTSSFFGEATYATGSSCFGSYVRSGGMSASGLAVGSAGKVCETPYISVNAVEVPIIWTFGGAGLDSGGVTELALPTARLDNFASGAATGVDAAGKTVVGVVLGADSTQTYYDIYPYVWQATTAGAFTGVVPTQLPLHGADSDGAAYGISPNGSYATGWSGTLQFDAAWPHRITTSTSTMQAAVWTLASNSVQLLGATPDPVNSPASSGKAVADNGTVVGWYGLFPRDAFTNDVNLARGSGLLLSDISGYGDYATIWQPKPFVWTLASGIMTRLGMTPLNDSATTYAYGEARALNAGTGSVATASVAVGWLGNSASSFEAVRWSSTDNWATHSTLQLAAVAPTDADNLGRIGAVANAVDASGNNVVGRVEYACTASSSGSCSQAVYWSVSADGQSSSGATLASILASVGISTSNVTLTDATAIAVSTTSSSSQILILGNGTRNDPGSTQDLFLIKLDRVSSSTPATSGGITSVLEQRSSLGSLGVVANQGVTATDAAMGALATAADYYRCVRTAAGEASQWCGFAYGLVAGNSSYGTSGTELSGSFGLARAIGPSTSIGFSVGVSGLRNGLASGGRFDAPGATFGTYFAHRPDTGFQFLAMAVASLYPDLTLTRGYLNGTMLTNSQGATHASSAGAMARIGWAFAVAGLKATVTPYAQLSHVNARVGGFVENGGLFPASISAFNAAATTLRVGAQLRGSLTERLSAFGGLAWAGNLRNDAPAVQGSLLAADCNSTSPLTAFCGMSGLGPRLSRSWVEGSAGLRYELAQGSAAMISANAASQNTLTYGLQVGYSRAF

SEQ ID NO: 1758 - protein, 355 aa, Burkholderia mallei
MTTLRLRSPHRCRPPALAAAATLAALSGPAHAQSTLTLYGVADAGVQYLSRADGRHAAWRLQNYGILPSQLGIKGEEDLGGGWRARFQLEQGINLNDGTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSRGLSASAVLHRSHGTAQGGADRSAQRRDIGTFAARYAFASLPLTVHAGVQRLTGELDPARTIVWGGARYQASGRFGFAGGIYHTDSPTPQVGHPTLFIASTTCSLSKRTVAYLNLGYAKNSGRSAQTVYEYDPTPLAGASQFGAMLGMYHVF

SEQ ID NO: 1759 - protein, 610 aa, Burkholderia mallei
MTIGSKTKLALGIALAMPAAAWAYTFYALGDSLTDNGRVVRLTGILPNATSTIFRGGRSSNGPVWAEYLPGLIGARFAPDDDYAINGALSGHGGYLNIIPTRPTWRTLPGFADQVEQLIAAHPRLRRDDLVGVWIGTNDQDLTKASLNGIEPFLGVPRPANIAEMSAYTLTNLNAQLQRLIGAGARQFVILNLNDAGGTRPGYVDYNGKLPEDLARFSRQGVNVHLFDVSALLNQMRRNPSAYGLNDTPDVQCRYVPSCSGGSVELQNTYLTADGTHMMTSVHEYIARYLANQLNAPAAISTAPVLGLDVARAGALSALNAADGGPLGPARVAWSDRLSLFADVGYTRNFHGAAGGMNAFDSDVEMFSIGADYKLSEASRAGALLSSGNANGSLAGGQGRIGLHAYRLGVYHAFERAGLFVRAYAGAGWSRYRLDRAAVLPGAVRASTSGFDFGALVKAGYLFALGGVRLGPVADVGYTQLVARGYTEDGDPILAQNVGVQRLKGVSAGAGVRFAAPLAAIGLRAGELSAEAQLRHDAFGDRTLVTAQRYAPGLPIGTAVDGASATYERLSVALTVNPAKRWRGKLVVQTDLGTAQRRSYTLLALLGGTF

SEQ ID NO: 1760 - protein, 362 aa, Burkholderia mallei
MKKVMLAAVLATAGVAAHAQSSVTLYGRLDAGIEYMNGLPSANGGSASRWRAESGNWGTSLWGLKGSEDIGGGNKIVFQLEGSFDTMSGNGPGGGSLWNRWATVGISNDAYGTLLLGRELAIANGVWDFDPFGQSSWSTASLVRGRNWNKTSNNISYQSPKFYGFDVYGQYALSNATNWNGNGSTNQGRSAGLQLTYTTSLFQIRGLYDEARDPTNGKLDDVFNYSREYFAGVNVFLGQFKLQAAYQASHADGGPAVNNGITTTQQVWGGVTWQATPAAALIAAVYHVNANHGGGNANIFTVGGSYNLSKRTLLDVQVATVRNSKTANFGLNANPAGTDISTGNPKFGGSQTGVYAGIQHLF

SEQ ID NO: 1761 - protein, 764 aa, Burkholderia mallei
MRTNLTVACLVFLISAVEAAETTMTLGELIGLLEVEGARIVYSTQLVPEGKTVSLDSPTLDVLEEALKELGLTLRYQQGVIAIVRGPEYVPVAEAESVASALEDEPQLETVIVTGSRHRFFGPETTNPTRSYSSSEIGAQPLFASDPLRVTTRLPGVSTLGVSARPHIRGGLSDELLIIRNGIELLEPFHLADFHSAYSAIDISSLDSLDIYTGGFPARYGNRMSGVMDLQTRERSEQRNLDIGFSTFATRVALYGDVDFAEGGNFLLSWRGGDLDDVASFIEHESGVPEYSDLSASFHVDLTPDSSVAFGFTQAKDDILFVGDLVGQETALSKVVTDHLWAEYLVDGLGRWRTRLTGSAIDLSRRNEQFDNEEIEQDQEGGFLQHQQDVLRVAVRNDWIRDGLGTTYELGWQAEFNRGRYQHQSEIERGVIADLIGTPRNESRDINLKPEGWSGGGYVQMQVPVGERLVIQPGMRIDFQDYYIDRGFETQLSPRLGVAYTVSDEMTVRLDLGRFQQPEAVQELQVRDGLDRFFQPQIADQVAVALEWRGGSLLLRGEAYYKQYRRPKGRFENLFNPFVLLPQLEEDRVEIQPDQVYASGFDVSVERAFSRSITGDLSYSYMDAKDRIEGRSIPRRWSQRHTMNLGMRYELGDFSLAGALTWHSGWNSTALPSFIADGDVVPVSSILNNSELPEFLSLDVSARKVWDFPRVRIEVFADVSNLTDRKNIAGIDFDERRVEGGYALEPEREFVLGRVTSLGVTLSF

SEQ ID NO: 1762 - protein, 778 aa, Burkholderia mallei
MFHQLAAPGARRRLAAACAAALAWPAAHAASTAAAVPADSTPAAAAEMTASGKTLDTVKVTAQRAAFAPDAPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSATASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 1763 - protein, 377 aa, Burkholderia mallei
MKQTTKITGLIGGAVLAIAGQQAMAQSSVTLWGVADVSLRYLSNSNAQNDGRFFMTNGAITNSRIGLHGSEDLGGGLKAIFNLESGVNLQDGAFSDSKRIFNRAAYVGLTSQYGTVTLGRQKTVLFDLLSDTYDPLTVGNYLENAWLPVALGAGLYADNSVKYRGTFGGLTIGAMYSFGTDSTATGAGGFSGQLPGHMGAGNMYGFSLSYVAGPVSVAAGVQQNSDNSNRKQTIYHANVVYAFSKAKIYAGYLHSKDDTGFVDTVLAQQPGLFTSGAPKRTGRIDDGPFAGVSWQATPALTLTGAFYYDRMRNATIANGQLDSGNRYTVVGLVEYALSKRTEIYGTVDFNKVNGAATVEMPGRSNQTGVAIGLRNIF

SEQ ID NO: 1764 - protein, 504 aa, Burkholderia mallei
MKKKTLHQMLVKSGVASGLPLLLSLGIVQPALAQAPSPAAAPAENAAPPAPATRAPDGVPGGNGATAAQTDAAPTGFWDRSNLFGDMGGLRTKLGDHGITLNLQETSEYLRNLSGGTSRGGAYDGLTQFGFSVDTEKAIGLPGGTFNVSGLQIHGTSLTARNLQLLQTASGIEAEATTRLWELWYQQSFANGRADVKVGQQSLDQEFMVSQYASTFINATFGWPVLPAVDMPAGGPAYPLSSLGVRLRAKPSDAWTVMAGVFDGNPAGGVGDAQQLNRHGTNFNLRNGALFIGELQYALNAPPADPKAPQAGLPGMYKLGVWYNSERFADPRYDTNGVPLADPASNGVAATHRGNYGFYAVADQMVWRPGADSPRSLNVFARVMGAPGDRNAVDFTLNAGVTLKAPFAGRDNDTAGLAVSYAKIGSRARGADGDTGVFQTPGYPVRRAETLIEATYQYQVTPWWQLQGDFQYAFRPGGGIPNPNEPGSRIGNEAIVGVRTTITF

SEQ ID NO: 1765 - protein, 232 aa, Burkholderia mallei
MRKALCTALGVAALTPLAAHAQSAGSNVVTLGWFHVMPQQSSTPLTTNVAPTPINTPLRLPPSFTSAGTGLSTSGADTVGLTVSHFLTDHIAVTSVAGVPPVFKVSGHGTITPPGPAGALGTQNIGLAQVNPIVKSVRQWSPAVVFQYYFAQATAKFRPFVGIGVSYNWFSDLQLNTNFIKQTQDNLGAILAAGAGKPGVTQVSAKASSSWQPVFNAGLSYNITDHWGLVAS

SEQ ID NO: 1766 - protein, 862 aa, Burkholderia mallei
MKQKLTYTIALLSLGLSNSVLASDGCTVNGNALVCAENAQYDPNAHGGKQLQDYDSINVTTTENNKFGYVQWSNQTQYKDFTITTSGSAADGVRLINWGPTVTFNNLTVTTTGYSADGINLGRDATDSKLSVNGTTKIKTEHGMGIRAVSSAILGSTGAHTIILNGKSDIGTKGEGSDNSGYAVYAGNNENGCGPFNLPLYACKAEGPGEIYLLGKDSDVHSITSSGRGAHAIFANGHAYIKAKNINIETSGAGAHGMAAQRLSSNYYYSSANTGSQDYAGSVELIGNVFINVKGKDAYALYVDSFSAADGKDQNGKIASIKSYDSETAQIVKDKVYRINGNMLAKNAGVIDLWMGEQSAFTGKANIENKGIINLNIRGASSAWNMDGDSTINNLSLIGSSLIYTNNTNFNPMTLTVKNDFNSSNGTIQLNPVLGDDNSLTDKLIVEGNTAGSAKVRIRNAGGSGAQTVNGIKIIDVAGTSNADFSLSGDYVIQGRQAVVGGAYAYTLHKNGINSPNDGDWYLRSQLIEKKELPLYQAGVPSYEAYPQALLELNTLATMEQRLGNRVWTDASGMSAGNNDAVRTGTWGRMEGSRHSIKPAISDSQTNYDSNVYKMQAGIDGLLHEDATGGQLIGGLFAQYINGRTATSSPFGAGKINTNAYGVGATLSWFGTNGVYVDNQVQFNVYDSDLTSRLTGTSLIHGNNGSGYALSSEIGLAIKQESGWTLTPQAQLIYSRIKFDSFQDVFGAQVTLGKGASLLGRLGLSLAHEQKSLDHNGKANYQRNYAIVNLYNEFMDGTRVDVAGLGFANRNERLWGGIGAGTSYSWADGKYMVYGEGMLNTSLKNFGDSYTFTATLGIRMAF

SEQ ID NO: 1767 - protein, 386 aa, Burkholderia mallei
MAVNTISEGTILKRQYLALSIATAACAAPQAHAQSSVQLYGLIDLSVPTYLSHANAKGDHVIGMGLGGEPWFSGSRWGLKGAEDIGGGTKVIFRLESEYTVADGNMEDPGQIFDRDAWVGVENDTFGKLTAGFQNTIARDAAAIYGDPYGSAKLTTEEGGWTNANNFKQMIFYAAGATGTRYNNGLAWKKLFGNGIFASAGYAFSNSTSFGQNSTYQVALGYNGGPFNVSGFFSHVNHAGYANKSFSVGGNYTFDIFRVNAGYFRYLGDQGALGQRQDNAWTVSFKVAPKGALDYELGYQQMRVHNAAYNSDGNVPNANIGDFSLTSGVGNGFKETLYGSVFYHLSKRTELYLAGDYMRLHGGYTVASTHGATNQLELTTGIRTRF

SEQ ID NO: 1768 - protein, 366 aa, Burkholderia mallei
MKKFAVAAAGLAVATGAHASDGSVTLFGLIDAGVSYVSNEGGKRNVYFDDGIAVPNLWGLRGTEDLGGGAKAIFELTSQYALGNGAALPTPGSIFSRTALVGLWSERLGSMTLGQQYDFMTDSLTFGSFDGAFRYGGLYNFRQGPFSKLGIPDNPTGSFDFDRLAGSSRVPNSVKYTSANLNGLVFGLMYGFGNQAGGGLAANSTVSAGLKYETGSFALGAAYVEVKYPQMNNGHDGLRNWGLGARYALSAFDLNLLYTNTRNTLTGAAIDVIQAGVRYVGAPWTIGANYEYMKGNAQLDRNYAHQVTAAAQYALSKRTSAYVETVYQYAGGSAGAHAWINGVMGPDAQSSSRSQFLARIGMLTRF

SEQ ID NO: 1769 - protein, 781 aa, Desulfovibrio vulgaris
MYRFFSIFFVSLLCSISALAQSSLSGKVCDDDSNPLVGATVQILSTKLGAVTDSDGWFQLKTVPKGNISVKASSLGYAPQTQNITIGDSKVTLNFSLEIDAVRHKEILVREDSPIQKMRKAPESIVVIDAEEIRGRATAIEAILTKATGIKIRKTGGLGSASRINIHGLEGKGITILIDGNPLNSPEGNFTIDEIPIDLIERIEVYKGVVPARFGGDGTGGVVNIIFREFEYDYLDVSYQRGSYNTNRATWTFKKVFPELGMEVSTGGFFNKADNDYTFESPYQDGVMITRDHDEFLSYAYGAGLVFNKLWFEEIELGVDVYRNRKEIQGIRTNIQFAESRASAVIPNLNLEKEDFFLENLDFENTLQVVIMGYNFIDTSHVHYNLDGSINTDDTYQGEIGSYANDSDDKQLEIRNKLNLLYTLSDVHSLNLNHNFRRANYEPEDELASEYAGYNISGYPSNYTSNIIGLTHQMRLLDERFISMTGVSLFQMSTTITSNDYIDDNNLREPSISENDFAKMGYSEALRYRPLHWLNLKASYQHAMRLPYSNELFGDGVYILASPNLAPEESDNMNLGFFIDTYSFAGLHRVQFEANAFYTDLTNKIQLSSDGVNYAYENLGHVVIKGFDAELKLDISKAFYLHGNFTYQLAKDAKEFRDDGTSNPTYDMKVPNIPWLFGNFGIEYHRENVLGAGTFLKLFLESSYTHEYFYNWEISKRNPRRIPTNFSHDVGIEMAFDNNRYILSFEVQNVTDEDLITDFQLPLMGRAAYFKVRYSFLNAVH

SEQ ID NO: 1770 - protein, 875 aa, Desulfovibrio vulgaris
MRHMATLALCALLAMPEGAVAAPTTMPATPAQAESAGKAAKTPSANTTKPGAANATLPAPATAPASGPATGPATGPATGTSSTSASEVYRLDPLRVSGETQQMGKTVIDGEKLNSLPSPGRTINDALRTRSDVQFDEGAYSSTQGGEIRPPRVSIAGSRPYENSYVIGGISTSNRIDASGEDRSTADGVAPTGEAQSFYIDTDLLDGVTLFNNNIPAEYGGFTGGMVKADIRDPRMDGVHGFLKYRHTRDNWAHITAPDMPSGTTQVDKQDRFQRHDGSVAAEGPLTERLGVILNYSVKHSVIPMETAWGSPKDQYRTNENFISKLAFMDDGPFKGSFTLGYAPYQREMYISSRLDSDFSVDGGGFFTALDGTYDFGPVAWKNTLGFSRSELSRYGTGDVASTWLRYKTIGGSRFDSAYATWGKGTSAMEGSMGDYEQSQDDVSWKSILDFDPVHTGVLSHVFQTGIEVQHTDASTDSTGYTAYYNPSIPNSQADRDKIPAGPGNVAGEQFAQNKTVEDAYSRSASMNSYAWFGQDTIEIGRLTLRPGLRVSHDDLTGNIDPAWRFMADLDVFDDDVVHLIGGANRYYGSQMLAYALRKDSGLARYKRSFTGGNLGDWVYDKTTGGKNYDLDELDTPYSDELMAGVTLKAFDTRFGMRAESRKHRDQLRTTLDTNGATTLNNSGKTDYWGVTWTVERDFNTEHMGDHTVELGITRSNTKSDGTDFDSSFLNGDTGSVIEWEKVYFEGSLVPRSNLPASNYNRPWVGTLTHTARFMDDDALRWFNVLRYKGPGTDLVRTGTFTDTDGLRYDAYEARTFSDSVTVDTAVEWDALRHEDHVLTLTMEVSNLFDQKSNVDSSTGYVMGRQYYAGFKYTF

SEQ ID NO: 1771 - protein, 912 aa, Desulfovibrio vulgaris
MRKVLLLVSFICCFSFAQAQNTNSQKISGTFLGMSFERFAEKIESETPFKLYYKNSDVEEIQVNLQANDSDIGALLREILSNTGLTYSIDNSKRIWISKGSKIYVDFPADYFMVQERQEVQSNANDTLGAFDKNKRFIIGKANENPESPTAVLSGVVTSVESGNPMNGAVVLEKVNYTQVVTNKEGKYRLTLPKGRHTIWIQNIGGFQEQRQIDLKGDGVLNMSIEENVLSLDEVVVSSGALSHINKLDMGVQSISVADVKRLPAVMGEVDVLRGILTMPGVNTVGEATTGFNVRGGAADQNLILYGNSTVFNPTHAFGFFSAFNADIISGVELYKGSVPVNYGGRLSSVLKVDPKFGSKEKFGGSGGIGILTSRLGFEGPIGEKTTFAIGGRSTYSDWALKLLDDEADLNGSAISFYDINANIQHEINDNNTIELTSYFSRDKFRFDPDTSYSYQNLNLSLAWQHYFNDALEGKLTVGQDSYEFGIIGQDNPLNSFDFGFDVNQLFIRADFEYRKSENHILKFGVHGIQYSLNPGTNRPYGPESIVIDQELQEENAQEISIFIGDEFTVNENLSFSYGGRYMFYRLLGPLNVKEYVPGEPITESNVTGERSYGKGESVQTYHGPEFRVSGRYTLNNQSSLKFGFNTMRQNIHLLSNSSSIAPTDSWKLSDTYIKPQTGGQASLGYYRNMAKNQLEFSTEVYYKYMNNLLDYRSGAQIVLNENIEQDVLNSVGKAYGVELLLKKNTGALKGSIAYTYSRSFMKTSDEPSIEKINDGEFYSSNFDQPHHLVVVANYELSKRVNTSFNLNYSTGRPITLPISKFDYAGSERVYFSDRNAYRIPDYFRMDFSVNLEGSHKVDKPAHASWSFGVYNILGRSNPYSVYYVPEDGKLRGYQLSIFAKPIPFITYNFRF

SEQ ID NO: 1772 - protein, 427 aa, Desulfovibrio vulgaris
MKRLCTLLLAAGLLLAAFTGSASAEGFALYEWGARGNALGGSMVGRADDPSAVAFNPAGITQLEGTHVMGGFSAIIPSSTVEINHGARSYEGEGAFNIWVPPHGYMTTQLSDNMWLGMGIYTRFGLGSEYDDSSWGGRYNIYNVGIQTVSFNPNLAFKLTDDLSAAIGVEVMGLKLDMKKKINPTGKANNAPGNNPAGDIDSDLEADSYGVGLTAGLHYRLNDQWAAGVSYKSQVKHKARGTNDFSNVPAGPLQGVYADCDVNGVVILPDMISFGVVYYPTPEWSIEAGATLTRWSLYDNLPIYHSAPFYNGAGAMVNSEKEWNDAWRYNVGVEYKATDWMDLRVGYVYDVSPVDDDHVDYLIPTQDRQLYSTGVGFHWDSYTVDLSYTYIVASEVEYSQRTSEGIFEGNSKGGRTHVLGLSVGYTF

SEQ ID NO: 1773 - protein, 649 aa, Desulfovibrio vulgaris
MGKRLMAALALAAMVCAGTAHAEDAPPASGGATLLEEEVVVSAPIIEGNEVTRYAGQYTEVTQEQITDLNAQDMSSALRRTPGVNISRYNPVGSFGGAEGGGVFIRGMGSSRPGSEIMTMYDGVPRYNPVFSHPLLDMLPMDPAQSIRVYKGVQPTEFGNAFSAIDVIPKRMTEDGYRTRLFTSYGSYNTFTQGVEHGGKQGGVDYYAGQSVRLSDGHREHSDGQIENYFGRLGYDLYENWNVSWFGNVTRNVARDPGSSLSTGNDGRFYTDDVLNVITLANDYGDADGHIKVYWNNGYANWAGQKGNADTTISDWDLYGLRAREAFRAWEGGEVTAGFDYDVMSGKALFENDNGTSSEFEREDFVLFSPYAAVSHEFGSRDDFYAIPSAGMRFYTHNEFGDQVAPHTGLVFGYRDTELHAGYARGVNYPGLNVAVFSENVIPPIMGGPFRDDWKNLDPELVDHFEAGVSQKLWGKVKADLTAFWDEGTDRYAVVQGTPKRFRNIESFTIQGLEGTLTYTPFADLSVYAGATWLDTFPSDLPYAPEWTFSAGLNWRFLQHFRLSLDAQYVTGEQVLSQGRTENAVNASEVDPYHVVNGRIAYVFDYAPWEIKEAEVYLALENITDSDYEYRPGYRMPGSSATVGLSVTF

SEQ ID NO: 1774 - protein, 828 aa, Desulfovibrio vulgaris
MFIKPVLNHTFSPNDFRPVLQSAYLRHAIRAALFGTAMGLAAVAQLSVAAETAQVSHHYAIPAGQLADVLNQFARQAGITLSSTPQLTDRLQSNGLQGQYAIDHALRQLLNGSGLEAVSQDGRNYVLQAQHQDAALALPDTDVRSFSLGNALGSMEGYNATHSQVATKTSMPLVETSQSVSVVTRQQMDDQGSQTVAQAMRYTPGVLTNPYGATHRYDYVAMRGFNDGSVDNIYVDGLKSMGDNGTYSTMQVDPYFLERIDILKGPSSVLYGRSSPGGLVALTTKKPLFTPYHQVQATVGTQGQRGMGFDFSGPVDDDKRIAYRLTGLADASDTQFDHNKEERYTIAPAISVDFTEDTSLTLQAYLQHDPNGGYHGGNPADGMLHKRNGLRLSDHFFEGEPGIDNYERTQQSFSYQFEHRFNDVFTARQNFRYQDSDVSMDQVYSAGWADADSNILNRAYTGGDERLHSYIIDNMLQAEFFTGAAKHTLLLGADYQRRKADVAWRYGTVDPLDAGNPQYGNGNLQVLGENRYQRRLQQTGVYLQDLVEVDQWRLSLGLRQDWVKVSEENRDSDTKVSDQRSRFTTRAGVLYLFENGIAPYVSYSESFNPNTVSDQQGRPLAPTEGTQWEAGIKYQPPGSDNLFTASVFRIEQENLASKQPDENFYRPVGEVRSQGLELEAHVQLSDSLKLLGGYTFTDIEYAKSMPSLVSASLDNEGNAPTQAPKQMFSLWADYNFHQGALDGLRLGGGVRYVGYSWVDAENSMKVPSYTLFDASIGYDLGKVGLTGVDVRLNANNLTNESYITSCASLNYCYMGEERNVSATVSYQF

SEQ ID NO: 1775 - protein, 248 aa, Polaromonas naphthalenivorans
MKKQLATALAALVMAPAMSATSVDLGYKAYTSDTKSDNGGAYDQPFVKLTHFNKADWGTLLAYVKLENPGEVKDAQHGKDGKLTVKSLLIVDKQIGDTSYNFWGQNFLVSNRTVMEDNLYLGVTTNRKYGALFINAGVGLNYSAAHFDPTGASFDGISGYAAVINARYPFSAMGLKHSLSVNYEGQIDRDEDHMSTLGYDSYGHQIITTLKTSMTESFYTKLHMTHFDSWGAAPNDGIEYGVAVGFTF

SEQ ID NO: 1776 - protein, 282 aa, Polaromonas naphthalenivorans
MKKLSVIFLSVSMLSSIAFGDEDKVVATYKGGEVKESQIMQEFKPQLNLQSGETIKNFDDFPLQDQEKLIKIYVNNLLLKEEVAKSSITSSKEFQEKLENAKNQLAQQELLANYIKSNITDKMFDDEYNKYVDNLKGKEQIKVAHILVKSQKEANTVKTKLSKGGNFTKLAEEFSLDKATASNGGIIGYIILNQPGQLVPEFEQKAFALKVNEVSTPVKTSFGWHIIKVLEKKPVPIPTKEEAKVTIDNILAAEILKQYISDLEAKADLKIMLPKANSKTGS

SEQ ID NO: 1777 - protein, 698 aa, Polaromonas naphthalenivorans
MKKSFFWLPVAFPSLFLAFPALGSDTEITQTVDNSDIPYLSEIELPTTNAELLTQSTPGELNSDSEPKEQPEIEETSSDDADITIEAIAEPETLPVSTPTYVIDQEEIQKQGATSVADVLKRMPGFAINDVGHGADIHTGTYYRGASINQSVFLINGRPINNDVNTYHGATDLNSIPVESIERVELSSGVTSALYGSSAFGGVVNIITKKGFAQPKLTSSLEFGSLNLNNQQFSYSGSVGAANYNFSFERYFVDNRYRVPVGAANRDSQGFLSNADTSTSTYFGNIGLDLDQRNSLSLDITKLSSRRGLVYFGFPLQRDRLDHDGLNIGLSWKTRLGNGDNSNLTTTFGYNQNYFSTYGPTVFAGREFYRTGVLDTQQFTGRIDHDWKISPNNKLRWGLDLKNTDLSGDVLSSSPNRTAFNESENRNVLNTALFAVNTWNLSNSFQLDLGLRQSFDGQFGNYLNPSVGLRYDITPLIAMRGSWAGGQRNPGLDQLYVYDTVHGWEPNPDLEPETGSSWTAGVDVKLADNLTGQFTYFGSSLNNRLGIVAGRWANIGLVDTNGLEAALQLKVANNWSTFLNYTYTDAQIKTGSERGLQLGMIPYSVLQTGVGYQNSGWQANLYVTYNSGARRAFFNRPGETTTDFVSSFVNLDLSGRIPLTRTLGLTVYLENLLGEQYERVNRIYSPGFTFRLGLSSSI

SEQ ID NO: 1778 - protein, 391 aa, Polaromonas naphthalenivorans
MKKTLIAATLFSLLASNQAMASDETTELRQIIEQQQKVLKDLEKRLEQTEKRVETTADVVEATASSKSATTIGGYGELHYNNISNNQTGTDKKEFDFHRFVLFVGHEFNSTTRFFSELEVEHSIAGESKKGEVELEQAYIEHDFNEMLTAKAGLFLMPVGIINETHEPTVFYGVERNPVEKDIIPATWWEGGLNLNIKAAPGLAFDTAVTSGLYLDESSGYKIRNGRQKVSEAKGEDLAYTGRVKYTAVPGLELAATVQYQSDLTQGTAGVDSASATLLTAHAIYSIENFTVKALFAQWDIDGKEAEALGRDKQNGFYIEPSYRINEQFGVFARYNEWDNNAGDSADTKKKQTNVGVNYWLHENVVFKADYENIGGAADSDGFNLGVGYQF

SEQ ID NO: 1779 - protein, 199 aa, Polaromonas naphthalenivorans
MKISTIALSLFTAFGISSQALASETENSPRDHGHFYAGVDIGFYNETELEYRGSAIEDSSDLSDFSYNLVGGYEFNTHDVVKLGLEAEHRKIGKVSYSDLMDIEGQAFFVNIKPKFIVQGDVLDLYVSLLAGVGSMDMEAKAFGVSGSKSEAAYQVGAELGAIVTDNIDIHIGYRYANVEIESIDVSPQTAYLGARYHF

SEQ ID NO: 1780 - protein, 252 aa, Polaromonas naphthalenivorans
MKLSKSVLAILLGIGGISSVSAEVHFQQNNVILGYEYLLDAEDKNPNLYDQAYFVLGHTTVADWGSATGWLRFENPLDSSENQKGEDAGATTKAWLKLDYNLGDSPFNIWGQSFTCANKPWMEQNFYLGGSYDVAVGKLKGTVGIGAQYAYGSFSPTGKSFNGASGGAVTMMLGYPLTSNWFAKAYYEAQFNRSDEHREVFGFDSYGHQAIIGIDYRFNSQLFVSTLYKHRQSWGGALNGGGELLFEAGYNF

SEQ ID NO: 1781 - protein, 577 aa, Polaromonas naphthalenivorans
MKSTLVWKTLQLSSALLGLSLFVANNADAEIPNPTASTRESTAELNRQLSETPVKINPLQIASDVSPGLSPTNTNSNRELLEQIQRYSSENGVESLDQVTSVGQLRDVSPGDWAYEALRSLVERYGCIAGYPDGTYRGNRALTRYEFAAGLNACLNQIERLIGTGGFDETELETLRRLIQEFEAELATLGARVDNLEGRVAFLEDNQFSTTTKLKGEVIFNLASAFGDEKADSDEDVDDNLTFSNRTRLNFDTSFMGEDRLRVRLQAGNTPEFDEATGTEMSRQGFESFTGEDGNDVEINDLYYRFPLGDKIRLLVGANGFDFNDIAEIHNPILESSGTGALNRFNRRNPFVFRNNAEQGVGANIQFSDSLSLDLGYLTGESNSPLDKDGVFDGDFTAISQLNLALGEKLDLGFAFGYSYYPGEDVNLSGSTGSPLAKEPFGEIATSALRFGIQGSWRVAPKINIAGWGGYINAEAEAGDREGDNAELWTWMGNVSFLDLGKEGAAFSVAAGIPPKLTDVDGGLDDDDTSFLIEAQYQYPLTDNILITPGAYVILNPNHDDGNDDIWVGTIRTTFSF

SEQ ID NO: 1782 - protein, 972 aa, Polaromonas naphthalenivorans
METVMSRHVIARARAVHRQIFAGADLRTVLLAGSAVLAASSAHAQTVQAPAAAEVDEVVVTGQRLSTANAIEAQRRSGVVSSVISSDDLGKLPDANVADALARAPGINVVVNQETGEGEYVSVRGLAGTFNAYSINGVRVALTDPDSRKMSMTVLPPNGLKSITVSKTLTPDMDGDAIGGSVNFQTPTAFDFTKPVARAFLSYGVNDRAQEQGEEDGSGQIQMDFASRLSSDSRFGAFVSFNYGKSNSLNEETENDGEWEPYRWRKDSEEAIDERSMYLPGIDLDYRRIEQERFGGNFSLDYQGQANDFYLRGQYSRLERTGTNDYTDFRSRKTKRLQQRNLDDTSLIQPENAIVGYDEEKGRVYSYTTDQIVDKLTIKKIIDGKEVMVGDGIITDEDRISGSSYWSLFGRSGVWKPETFQFARTFQTLDQVSTLGTINLGGQSRLNRLTLDYDLSYSAGEKGGPDSFSIGYNCDACSAPFNQTGLLWSSYDPRFPMPQLPAFAQNAQNDPNLLPYDGGGRSRDKQTDARTAFKFDAVYEMEGVVRHLKAGVKVLRSEREYDATPIWGGSFDNTPLEGKSLGQSGLIDREVGSVLNGRYYYGAILNRDRVTAAIEAAQKANPVTYSYADLSSSDKSGEETIYAGYGLASFQFNDLDVVAGVRVEHTEVSNTNWIEDEAQTGFGDTDSNYTNVLPSVTAVYRPSDNFVYRGAIWTSFSRPEFSNISRGVSVGRAPPRPGQTLGDIVSISRGNPDLKPAEALNLDVSAEYYPDRSSLVSIGVFHKKIDHFIFTNGSAVDADTQEGVITISQPKNGETAKITGVELNLIKSFEGMGAPFDGFGVEANLTRQVSEAETGLDYRKGRSISFIQAPDLIYNASLTYQKYGFEARLSYQYQGAYIEDLRDNAVDKWVQPNKSLDFHSRYNFRPGLTMDFDVQNILDGHRYYTTKGESPSYQKDYMEPGRNFLVRLAYSY

SEQ ID NO: 1783 - protein, 180 aa, Polaromonas naphthalenivorans
MKTRFLPLLFLISSSVYAANHQIGVGIGYGGTEGSNDWTDSGFASKIDYSYQFHPNFSTEIGYAGIDGMTSNVISTAFDQSKQHVKYSTGYLGLKASLYPVSFFNIYALGGANYSNVEKTFTPTGQAERTVSHKGLNPYYGLGAEVVAFSTIGFNAEYRKFILANDFESDVFFAGLNLKF

SEQ ID NO: 1784 - protein, 397 aa, Polaromonas naphthalenivorans
MKTAVCTAAVACALAAPLTVHAQSSVTLYGIIDTGIAWTNTVASSIKAQGASRWSMATGWGSGDRLGFLGREDLGGGLSAVFQLEAGFSGLNGTSSQGGRLFGRQAYVGLSSKQYGKLTLGRQYDYTFDYVAPLMAWLQFGSIYGAHIGDVDDSFQTFRLNNSVKYEVSPLAGLKLGALYAFSNQAGGGAGQGFANNRAYGFGLDYLRGPLHVVASYLQLNNPSAGIASSGNNPNGAIGDEYSGSTSLFYNAGFVERQRISALGAGYSFGAAAVNLVVTDTRLAYRGGHSLRVDNYEINGRYNFTPVLIAGVGYIFTDGHGYTGSGATSFATGDRPRWHQVDAGITYLLSKRTDLHMSMVYQRRAGDAGTVAINFFGPAGAGRSSQIAVLAGLRHRF

SEQ ID NO: 1785 - protein, 401 aa, Polaromonas naphthalenivorans
MIKITKTVRISTVAAGLLLVAGTAFAGPRMTFGPNDEGALQIDYKGQLQMTVRDTGSGENNDDTTTNFNFRRNRLAFMGKYGEMLSLYVQTEFTEDQNVTTLGVASTNQGTEFQLLDAVMRFKLNDSFHVNAGKFKYNLSRENLEACEMPLTLDRSLFIRTAYTTTRDTGVAVWGNLFNDIFQYRVDAMEGRKAVSGDTAPSSNFRYSFRGHVTLLDPENDYGYKGTYLGKKKVLTIGGAYQFEPEIAYGDTVARTDKKDYQAWTVDGFFEYPLEGIGTVTASAAYEDVDLDDAYKGANPDAGTIGLNGQKNGWYVKGGYMLPNLPLQFFGRYEKWRFASLNNIFDQKVDWYGGGANYYFRGQNLKLTFEAAHTAFDKEGTVNGVRSKDFTTFVTQLQLIF

SEQ ID NO: 1786 - protein, 715 aa, Polaromonas naphthalenivorans
MKSLNAITLAVLAALPASALAQAQQQSKEDSRSNKVDETLVIQASPLNKTPLESAQPVNIISGDELKLKQAHSLGETLALEPGINNTHFATVAGSPIIRGLGGPRVKVTQNGLDTGDVSRGSPDHAVTTETSTAEQIEVLRGPATLLYGSGAIGGVVNVVDERIPSAPVYGLEGSVNVNYDSVNNGRGGSYDMTVGNGDWALYVDAHRRLSDNYDTPDFINDEGEVLDHVENSFVDSKGGTVGASYQFDNGYFGISYQGLYQEYGIPGHEHHHHDEAGQEEEPAHAEAAGPFADLEQKRWQIAGELRDPFSGFEVIEMRAALTDYQHSEIEGDTVGTQFKNQQKEVRLTARHAPIAGWSGAIGFQWDSADKTARGEEAFTPDAKRRSQGVFWVVEREIDNHHVDLGIRQERTDLSSTELALNTFNATSLSAGYMYHIDDASSFSVNLSHSERAPSATEVFSNGEHFATRTYELGTLYELHDEGNGEYHLHQENTDIKLETSNNIDVGYHFETDRVHVQANVFYNRVDDFIYERFTGINSTAIHTDEHHDEHAGEADHDHAHDGDGLMVVQFSQADVNLYGYELEADYRLTDAWSVHGFSDYTRAELRDGGDLPRIPAQRVGTEVRYQATHWDGAIGYTRYLTQDKIAANETETDGFGLLNAHASFYPNWLAQYGATVYLKGENLTNQLGRVHSSFLKDDAPMAGRNFKIGVSVTF

SEQ ID NO: 1787 - protein, 697 aa, Polaromonas naphthalenivorans
MAHNNTLSLVALAVAAGLASPVFAADKKADEVMVVSGSRMEQKLEDVSGSITVITAKQIEEQAVSNVADLFRYEPGVTAIGGAGDAQTFVIRGMGENRVKMVRDGVRQNDAYKNGGVGQSYFDTDMIKQIEVVKGPASAAYGSDALGGVIAITTKDASDFLRGRDSYLDVTSGYASSSHQNMAGFTGALRSGEFENLLRYTWRDGGVTQNYDGDKKEFDIVSQAVLFKSQWNLSDDQFLKLTVDYFNEGQDPDAVDLTKAGSVFNQPITDKDTDNLSLMLDHGIALNAPWVDRIDSKVYYARTKQTLDQYASSKYPVRPGNPYVTKNSLDSNGFEQESLGAQVKFSKALASQRLAWGLEYEHTDNERTRFKAPTTPGDFVGYSELSFPSTTTEHGALWAFDELKFGERWVLTPGVRYDYYRMNPDLDPAYTGENLKKFSEGEFSPKLGLVFKAHEAANLFAQYSHGYKTPMYDNAFSTLNHQAYGYRIEPNANLKPESSDGIDLGVRGDAGGFSYEVATFYNKFDDFIELTQVGTEDRTALYQYQNLDKATTKGVEAKADYWLNDLVNVWGNLAYIEGKDGDGNYINSLSPLNGSVGVRLEQANWNINTALRFADDMDKVGKDARGNDNIKSAGWGVVDLYAQFKPIQDLQLNVGVFNLFDKEYVSYENITGQSATANTSNKTEPGRNLSARVKYVF

SEQ ID NO: 1788 - protein, 367 aa, Polaromonas naphthalenivorans
MKKSLIALAVSGLAVASVAQAAPQANTFYVGAKAGWATFHNDINQLNSKYKNDARYATSANGYVINRNSVTYGVFGGYQIIDNLAVELGYDYFGRVRGNKQEFRAFKHSAHGTHLSLKPSYEVLNGLDVYGKVGAALVRNDYKRYSQTAGVQTQKAHNLKTSLVLGAGVEYAILPELAFRVEYQWLSNVGNFTKAEAKENRRATYNYSPDSHSVTAGISYRFGQGAAPVAAAPEVVTKNFAFSSDVLFDFGKANLKPAAAQTLDAVHTEIVNLGLANPAVQVNGYTDRIGKDAANLTLSQKRAETVANYIVSKGVNPANVTAVGYGEANPVTGNTCDAVKGRKALITCLAPDRRVEIQVQGSKEVSM

SEQ ID NO: 1789 - protein, 804 aa, Polaromonas naphthalenivorans
MFNFALRRLPFCACRGARGVSLQPLPRPLLSGYLPAIVPAFVPAFVPAFVPAFVPAFIASSAHAQSASADAALPAISVSANAAAAPRAVDPKLPASVETVTREQFDNWNVVNTEDVLKYMPNLAVRKRFIGDLNSIIAVRGTSNTQSARGLVYADGLLLSNLLGNSYSFPPRWSMVFPDEIQQVDVIYGPFSALYPGNSLGATVLISTRMPKQFEASADVKAFTQHFSLFGVNQNFNGSEASATLGNRIGKFSFLLGVNHLENTSQPLQFATLAKSRTPAKAGDTPVTGAYFYNNQTNTPTAVPGVNGEGIEHTVQDQFKLKMQYDFTPTLQAGFTLGYWHQTYNSQTSSFLRDANGNPVYSGKVAIDGYEYTIPAAALAPSLGHSENWLYGVSLKTRNTTGWNGEAIASYYDVSNSVARTANSGAPGNGPGTVLFGDGAGWKTLDLRSTYTPATNQAGLANHALSFGYHYDNYFVDNESYNTLNWRDGAATSFANAFAGKTQTQALYAQDAWRFLPRWKLVYGVRYEDWQAYGGSQSLGGTTLPYSDVSQQHFSPKASLSFDVTDDLILRASIGRAYRFPTVGELFQGQINGSAIVNNNPNLKPEDDLSKELSAEWAHWNGVFRFSLFQDDVKNTIFSQTDTTVIPNVTNFQNIGKVRSRGVETSYSGQDVLVRGLDLLASVAYTQSKIIANAQNPASVGKYFYRIPLWRANLAATYHFDERAALTLAARYSGRQYNTLTNTDTNPDVFGGTSSYTVADAKFSYKPTRLSEIGVGVDNLFDARYFVYHPYPGRTFYVEAKLRM

SEQ ID NO: 1790 - protein, 401 aa, Polaromonas naphthalenivorans
MKRNLILLLTLCHSTLLIYSQNTTNSPTSMFGLGELSTGEGGQYSGLGGAGIALQSYNFLNTANPASLTAIEGQRFLIDAGVMGAYKVYTQTGTSNHSLVGNLNNLSIGCRITPRWYGAVFMAPVSSVGYAITLDQDIMGTGSSTVSSLFEGEGGLSKMGISTAYRLFKGFSVGANLSYVTGTIKQTETQGSISVEESSYKHAFYADFGLQYKFSLSRNKYLVAGAVYGYSQDLAQDNTLSVSSTSGNESIDESQSHVRQCLPQFVGAGLAYNNPRWTLTVEYKYTDWSRMKSSQSNVRFENQHRLSAGTAYTAGNIYRNPVKLSLGAGVSNSYIVIQKKKATNYYVSAGSNFTLYNGNVLSLGVKYSDQLHLPNGMQRERGVTLFFNFTFSERTYRAKIQ

SEQ ID NO: 1791 - protein, 211 aa, Polaromonas naphthalenivorans
MLALAENYQPLYAALGLHPGMLEKHSDVSLEQLQQALERRPAKVVAVGEIGLDLFGDDPQFERQQWLLDEQLKLAKRYDLPVILHSRRTHDKLAMHLKRHDLPRTGVVHGFSGSLQQAERFVQLGYKIGVGGTITYPRASKTRDVIAKLPLASLLLETDAPDMPLNGFQGQPNRPEQAARVFAVLCELRREPADEIAQALLNNTYTLFNVP

SEQ ID NO: 1792 - protein, 1010 aa, Polaromonas naphthalenivorans
MKTHRTVSTLPARSLLCCALAASLFATTPAMAQSSNATLRGQVASAQSGSEVVVTNVATGSVRRAPVNANGNYTIVGLQPGTYKVESNGISRTVTLSVASSATVDLGNETAAAPAGDATTLDTVTVSAPMIRDVKTSEVGNTVSLRQIQQLPQATRNFLEFADTVPGMVFTIDQDGNTKLRGGASNASSSNLYIDGVSQKSYVSGGGIAGQDETQGNPFPQLAIGEYKVITSNYKAEYGQISGAAITAATKSGTNEFHGEAFYRFTNQDLRERRPDEEDAKVDSQTKEYGFAIGGPLIQDRMHFFFAYEGKDNVAPKSVQPSAEASPFIGLLPSNLRDQYGASNMPFTEDLYFGKIDFEPTDNDRIELATQYRDETQVSNVGGQNAPDRAVDKINKDKRTSLRWQHSADSWFNEAILTTEDSRNVPTPRGVGNGSIYTYIDRTQADPRQWVFLNTGAASGEDFKLRSQKGWSFQNDLTFNALEWHGEHTIKTGVTYRDIKLTSRESSSLNPQFSYEVGQNGVAPVPFQVRYIRAFDNPGQVPVVESPSKQYGIYLQDDWAVNDKLMLNIGVRYDYEDTPAYTDFVTAQPFINALYSDDPDNPGQPWANRLLPSGINVADYISTGNNRKNFKDAWAPRFGFSYDFFGDESAVLHGGAGRSYDRNLFEQLALESVKAALSPVVVYFSDAASGQGCFRDDRACTAWNPAYFTGIDQLNTIDGTSDSSELFMFKNKLKTPYSDQYSIGISNQVGDWLTDVTFQRVLAYDGLVMSLVNRYPNGAYFDATGSVPWGEPVPGYRNTILGYNGLEQRSSQVLLSAEKPYTKESGWGLNLSYTHTSARQNRTIDEPFAFDKATIRDYPFVKSDAVSAHRFVASGSIDGPWGVTFGAKLVLATPEPINTIACYGFTDPDGGTCQAVGVTPPGNGKFLLGGKIWGYRTVDLQANKEFTVVGDFKLNARINVLNAFNFKNFTQYQYNSFGSDGRLQPDITVVDNGEISYVPRSVVLEVGAKF

SEQ ID NO: 1793 - protein, 710 aa, Polaromonas naphthalenivorans
MKIIASALLLGTALSAGSVQAQATAGADGSDAYGDILVTANKTGATRLQDTPLAITAFSAPALEATGIKDVRDLASLTPNLQVTQNASFSQVYIRGIGSNNVFGGSDPSSTIHLDGVYLARPASYLSNFLDVERIEVLRGPQGTLYGRNSVGGTINVISRKPTDEFAAKAQLTYGNYNFARAEGYVSGPLVKGKVDGSISLIGSRRDGYLKNVVPGIGDADNERTFGARGQLRFTPSEPLEIILRGDYLHSNDALAGYVKLLQTTADPLANSVLGDYRKVALNIRPKANRKQSGAAAEINYDFGDAAKLKSLTAYRANRLVQAGDTDGTALNIRRTDQYEKQHQFSEELNLTGKFGGLTYILGAYYFDEHIDVDSTVTTFPTVRANFSPTINTKAWAGFAQGNYALTDQLSLTAGIRYTRERKRFDQVATNFDFATGLPLATYPRTYSTAGTYKAWTPKFGIEFRPTDGVLLFASATRGFKSGGFNFASANPAQGFAPETLWSYEAGAKLDLFDRKLRLNGTYFHYDYKGLQVQSFLTPGVIDITNASDATVDGVEIEAEAHPTDWLQLGANLAYLDAVYKNYTSALKPGNIVFDASGNRLNLSPRWSYTLYAQADVPVGDGAFFARGEYSHRTRQYFTAINGGLDQQAGYGLINASIGYTLPGDHIQFLLFGRNLADKEYVTSTASFASGIVGRVGEPRTYGIRAVFKY

SEQ ID NO: 1794 - protein, 807 aa, Polaromonas naphthalenivorans
MPKSTYTRALLAGACALAFALPAHAQDAAQATEAEDTNPNVIIVTAQNRAQNLNDVPIKIDVVSGEELQKAGFASMNDVGQIAPVVQVNQDQGTVKVSVRGVGTTSNDEAQDTSVVINIDGEYINRPNVMGMALFDIDRVEVLRGPQGTLYGRNSTGGAINFITRKPGKEFGVNGSISYGNYNAIRADAGIDLPLGEIAGLRVAGFYDERDGYSKHPAGGGFFVFPAYAAGRSDDNKSYGGRASLRLEPTDRLSINLAAEYSHRSFTPGIFAAGDLNGAGNGPTGGACNNGFTQVAPEYAQVLCVPSNTNLLSKVDRSNYAAPLFGIGHVSDHTWAARGRIEYELSDAATITYIGGYRKYSGDPGRLTLPTIYQSFGYQDEAKTQSHELRINGTVGGVVYQVGGFYFKEDLARESGFMLPSFVFADPLNDPSLFGKPGTFLSYFGRYVKSDSKSVFGQVEVPLGDKLTAIGGLRYTDNKRNATYLNVDPFRFSLETFSLVPDPYIVGAGPGRKDFSKVMYLTTIPLKSSDSKVTWLAGLNFKPNSDTLIFVKASTGFKAGGFDSVGTYKPETNTAFEGGWKQTFGDHGQHQFNLGAFYYDYKDLQVSVLLDTAIGGQIFNAGKAKIWGIEASADIALDDRTNFHASANYLNAEYKELLAQFNVFDTTGEINGVGDLDPNTDGIQQPNFAGNRPPFSPEWVLTASLDHTFPLGDMGGLTARVNTTFKSKYFTDFYNYRDGTQSALSQTDASLEYKPENEKFSITAFVKNIEGTRPLTYGSFVSAGPDDIFNWQFGTPRTYGVRLAVDF

SEQ ID NO: 1795 - protein, 611 aa, Campylobacter jejuni [sequence omitted]

SEQ ID NO: 1796 - protein, 319 aa, Campylobacter jejuni
MKKILLCLGLASVLFGADNNVKFEITPTLNYNYFEGNLDMGNRYAPGIRLGYHFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRPAPQAKCPVEPRGGALLDENGCEKTISLEGHFDFDKTTINLTFQEKIKEIAKVLDENERYDTILEGHTDNIGSRAYNQKLSERRAKSVANELEKYGVEKSRIKTVGYGQDNPRSSNNTKEGRADNRRVDAKFILR

SEQ ID NO: 1797 - protein, 706 aa, Campylobacter jejuni
MHPNKKAFKLSLFALLLITNLNAQESNKAINLQKVVVSTTGFEQDADSNLRNVISIEGKDLQNKGYVSLEQALERISGISFVNFGLGRNIDMRGQGDKSNIAVKVMIDGRAINVLDNSHGVTPLDSINLDNVERIEIIPGGGSVLYGSGTRGGVINIITKKQKSDAFAINLKSSAYDHGGLGGNLGINGAKQINENLAFSFDIQSFNLDGYQEGYNEKGYFINTKTYININDNSDLTLGYNYFKSKNTSSGYLTKAQAQSDPTQKGNSDNITQINRPEISLDYHYYFDDIWEFNLEAFWQNQKINYLKDVSTMSYGSMSLPVYQNGSGFEDTLTGISLKNKLNYANNSYFIFGYEFANHDAKRTSIIHYDVNAGRFQMSHTMTTLMDMDKQSHSIFALDSHEFNDIFSISGGARYEYSLYDTNRNYTSNMIIPGRPNIKTELFSTDDTSHNFAFEITPNFKYSDTGKLYIKYERGFVSPSPAQFVNKDKNLQKYYSANLNPEIFDTFELGIDDFWWDFYGFNLTLFYTLSKDEISYLGNPHSTSGSWWKYYNIDQTRRLGVELSLSQNFLDDDLIFRESLTYLDAKISKGVNDGMRIPYVSKIKATAGFEYAWNKNFSNFIDLTYFSRAKDGGTIDENTGKMSKNSWIRDYFLTDIGMKYNYKKLQILAGIRNLFDKRYYTYQDSINDQYLVGNGRNYYVEFKYAF

SEQ ID NO: 1798 - protein, 261 aa, Acidovorax sp.
ARRIRCSCGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKAKIPATINHRGGGKNKTQ

SEQ ID NO: 1799 - protein, 829 aa, Acidovorax sp.
MSQSIAPRGVLAAGVSALALAALAQPALAQDAAPPAAQGALLEELVITAEKREQSLQDVPVAVSAFTSEKRDVAGITGIQDFVNFTPGMNYSGTDRVSLRGAGRNTFYIGNDPGVASYSDGFYSASSSELFKTPLFIERTEILRGPQGTLYGRNAIGGAINQVSKRPSQDFGGEIRAGYGNYDRYRIEGVVSLPVADNLRFKIGASHEDQSKGFIKNIGPANDGATIKRSYYEAQMEYEPTDRLEIYVRYNRSVWDDTTGVGDRLANLTTPYDTTRVFGPIGQLQVNPQFGYATPNPGVADPYVMNTNTDGYGQLRGNHVATTTITYDLGFADLKYIGGFQKYNYQTGGDYDNTSRTAPITGILAVPYFPTQTTDFDEHKWYYSNEVNLTSNGDGPFRWILGAYQYHEKYRQRVQLANPNQAQLAQPFTLAGTLAAPNPNRNFVDSQAALKSKAWAVFGQGTYEINDQFAVTAGLRYTKDKKSGNEFQRLVIQSPTILGGAVAVDVSSDMDPTTPGVQNYRTLSDSWDAVTGVLNLDWTPDADTLGYAKYSRGYKSGGFLLGTLAPDPEADQEQVDAFEVGLKKTFAGRLQVNAAAFYNDYKDLQLNLSQLNAAGTSASNNFVNVDAEAYGLELEAIWRPIENLDLSASYGYLHTEITSGCCFYDPADPGALDPRATPAGGTANSNGAPLVFQTLEGSRIYQSPKHKFAGNANYTFDFDAGSLIVSATYTWTDKTYYQPFKSEANRVKAYDVTDLRVLWNDIDDRYTVIGFVKNVFDNTGFTSNGSTTPTAIYDSPPNPQAGLLTQTRTAITRGLIQPRTYGVELQYRF

SEQ ID NO: 1800 - protein, 705 aa, Acidovorax sp.
MPSSFHTLPPIAGMPRSCLCLALAAIPVMAFSQAADAPSTQLETVQIQAEKQQNNEDNFVARKTTGVLRSDAPLFETAQSISVVTQRQIEEKQVRSVAEALESVAGVASGSYGRRGWDDFIIRGQISSAQTYVDGLRAQTSTNVLRSEDIFGIGSIEVVKGPTSVGFGLALPGGLVNLTTKRPQAESFSRAGISVGSYGLKEANFDLNYSPDGSRKGAFRIVGRASDQNDPTDYVYFKNQYLAGSYNFDLDGSNELSVIASYQHRNYIRNQGIPQNYEKYGRNVFIGEPDRSYEVDSYRLGANYAHYFDNEWVFRQNFALTKGSSLSNSVFAAANARFPLVARQINYQDKQDVNIALDNYLQRNFRFDRVNYELTAGIDMMRERSDYYQRVDNINPFNADNPVYGVTSIKEGKPSHNLTYSQYVGLYLRNTIKIDEKWIVGLNGRHDWTRVEIQDRLAGGSVSNSNTAFTGSASLMYQASEFLAPYVSYSTSFMPVTDAGINGTLLNPEEGKQTELGVKFQALDRRVQGYLAVYDLRRKNVTENDAMLGYAVQTGEQTTKGFEAEVAASLTRQWNVSAAYSYIPSARTSQSLTASEIGKRINHVPKNAGSVFTQYYFNPDRLGWNMGAGLRMQGARTAQRGTAFVNLARYTLLDLNVGYEAKSWGLSLAIKNLLDKDYVQGTTPNAQLLSFGSPRTLMVSARFKY

SEQ ID NO: 1801 - protein, 978 aa, Acidovorax sp.
MSRRRISGVVAALVTPLCWGATALAQGDPGAAAPQPDGAAPQAGGPAAEDVSGLDEPSPSRPPPAGRGVVWGVVTDTATREPLLDAQVSVVGTKLKAIADLDGRYRLELPPGIHQLRVWYEAHKPQRVQDVRVTAGQVVQVDVGLDPDQQTEEVIEVEFEPERASVAAQLLIRKNAAHVGDAVGAKEIAKTPDRNAAEAAKRIVGATVVDNRYVYVRGLGERYTNALLNGAPLPSPEPDRQAVPLDLFPSLVLSDITVVKTFTPDLPGDFVGGSVQVNTRELPTQFLFQASLSLGLNSQATFRDRLSYAGSGTDWLGIDGGARALPGEIPDYKVVRLGSKPGGGTITRDEMTTYGRAINSSMVTTRSFTPPNGSGSVVVGDTLKLGGEQRLGYIATLSYGRKFTPRAEEHTRAFLPAPQGGEPIPNVDTSTENIRDQVSWGTFASVTYNPDQNHKVTITGLHSRSSEDLASEINGNPLDGGSVFRDTLQRFISRALTLGQLQGEHRIGALDGGTLDWKASVSHASSDEPDTRETVYIRDDTSGAYSWDEGTLSGAHFFSNMTDVNYGGQLAYTQPLVRGDTPTRVKLGGLFNLREREFNARRFRFKQRPGSDPTILRQEPGQLFSDENIGTALELEEITRETDSYTANSDLYAGYVMTDAAITRWLRAVIGARIEASTLSLRAFDRYSPANPEIKAESDNVDLLPAANVIFKASSSSNVRLGVSRTLARPQLRELSSTLYQEGYSGMEAQGNPDLGRTSVVNADLRFEIFPTAGEVAAVSVFYKHFQDPIEEIIFPNGGRGRLSYVNAEAGHVAGVELELRKSLGFVTPLLKEVTALGNLTFVQSEVTIDPDDNEGGVTIESTPTHPLQGQSPFVVNLGLDYASESTGTSARLLYNVFGARLKRVGRKGLADEYEQPRHQIDLTLAQRLGEHIELKLAGENLIDAPIRVTKGSDGDEDKIASQYSVGTTVTLSAAFTY

SEQ ID NO: 1802 - protein, 356 aa, Acidovorax sp.
MKKSLIALAVLAASGAAMAQSSVTLFGIVDAGVSYVDNADGNSSNYGMHNSGNATSRLGLRGTEDLGGGLKAGFWLEGAVLNDVGGGFDFRRESTVRLSGNFGEVRLGRETTPTFRAGLKYDLFGATGIGKNQGFSDWAGAGINDADTIRADNMLSYSSPNFSGFTANVSYAFDEKKQAVAGSNKIGRYVGGNVGYENGPLSVTAAYGSQKSVVAGFTGDRDEMSIGASYNFGMAKVVGLAQQIKYKADASGVPSQKYNNYLLGVSAPVGGVGEVKAQYALYDQKANDAKAHQFSLGYVHNLSKRTALYGTVAYLKNKEGSFMALDAKGVSNTVGLKDSGAARNQTGVQVGIRHAF

SEQ ID NO: 1803 - protein, 580 aa, Acidovorax sp.
MRLFPQIKKAFVPAVLACAAVLAAGHSRTAQAAFFENIAVHAKAISLANSCTAYPPGIMAIHYNPAGLSSMHDGQQVSMGLVTAEFALESRFDQDPEFQDWLGGSFDNADDPVSGHTGTTQGVHMYVPMVGDQDTDAIGLETPLGFTLAAAPFPLGVSYRKPGSRWTFAFGAYAPSLGGYSRSNDDPARYLGRAVSMQHIVYAAPSVSYRITDTLSLGLTIGMGQSATYIDMDMRMPNDLMALTKILGEVTEGLDIPIISALTLPPPWFGGGIGPYEDIANLQLSARDDYCPNYNLGLLWEPKNWFSFGLCYQSEVKMEQDGTYRFTYNENFQRMSAWFGSSPLLLPFSIILDLPYEALPYQTGHMVLEGVDAPQRVQAGIMLRPFKRLRLMCDAHWIDYSKTKAYTLHFDQKIQPFQIAKFVGHTDGAYALKMTRNMEDEIHMSYGAELQVLEWLSLRCGYEERKTSVNPLYFDVMAPVPDLDFYGAGIGIQLKDGMAIDLAFGYLKSDTWHVPNNTSKSMNSTAFTDAVYNPYAGLDVSGKMDATVIAANFSMPFKYVYKLGNMLQAAYEQTKEKMSF

SEQ ID NO: 1804 - protein, 192 aa, Acidovorax sp.
MIFPLLVAGVCSAPSLAQAAESPYVSLSGGLGLLNNSTVNGNNDAIKYKTGYLINGAVGLKNQDVRVEAEIGYHRNSVDSSDYADPRGAHVSMWTFMANGYYDIPMKDSVVSPYVMGGLGVADASISGGNMSGSPSSTEFAWQLGAGVGIKAAKNTTFDLGYRYLSPSDAKFDGAKVSLASSNILAGIRYSF

SEQ ID NO: 1805 - protein, 1091 aa, Acidovorax sp.
MKPPCSPGQFVALSALLSGLALLSALPLQAQSTTTATATPGADGEDQPIVLSPFEVNAANDRGYKAFNTLSGSRVNTRLEDIAASLSVVTKQQLLDTAATDINDVFLYEANTEGIYQWTSFTLDRGNVSDDIQADPHNATRMRGLTAPNVSTGLYRTSLPLDTYNIDSIEISRGPNSSLFGLGSSGGGINVISAKANPTKSSYGVSARTDAYGSFRTNFDFNQPVVKDKLAVRVLGVYDDRRYRQEPAQDLTRRLQAAVTARPFQTTTIRGSFESYRNFANRPNSTTPRDMWRDWISSGKPTWDPITQTVHLADGTSIGPVTTAQEAARFPVGLNVTDTGVTGRPSWYIDNGQVELYMINRMPAATPVNTAIGPANIAGTGRLLQNTTNYLRNSGSYPLFTTPGVSDRSFYDWTSINLAAPNRDTTRAETSNIELEQIILHTPRQTLALQGGWLYERINTNARSFLGKTDGGKMQVYIDVNEKLLDGTANPYFLRPYIGGSEPAFRKSRNNSDNYRGMLAYQLDLTRENGWLKWFGRQNFLGYGEYREVYGGSFGYKDTMSSTEAWMTPTAATFSRNGASFRAYPRIYVGDANGQNVDYAPVGYGYPGSYTLRYYNGVTNQWIDEPVDFTEYYYANRLNRRLLSTYGGIWQASLWKDRIVPLAGFRRDFNRTREGNPAIAPSAATNGFYDTSDMNNFGTYDWVERKGDTSNYGVVVRPFTWLGLAYSQSDSFNPTSQAYDIYGQPLSDPQADTKDYGFDLNLFPDAGGSPRLSIRARQYETVDHGRGTSSVNTIVQRAIRLDADGNQTGGDPDLEAFYQTELGKLHPDWTITQIDAVIPELMGVDPAFIDSHRNKTHNDNSDAYSRGKEVEIIANPTSYWTIRSTITQAQAFNAVMSPALQEYVAARTPVWMAAKSPFDGSSFWDGTYRVGSSTPKIWYTTNLLAPMKLAVATQGKPIMQNREWKFNLVTNYQLRGITDQRWLKNMDVGGGIRWEDRAIIGYAGAAPDPDGVIREYDASHPFYDKDRAYFDVMAGYNLKLRDKYSVRFQLNVRNIFEDGRLQAAAVNPDGSTYVYRIIDPRQIIFTVSFRL

SEQ ID NO: 1806 - protein, 172 aa, Acidovorax sp.
MTNTKWNILRWENTPKALIQGFEGSLGLDFGDIRWTNNFTYMMDSKDKQTGNPLSLVPNYTINSIFDYDITDQLDVNFVFTQYGRQKSRQFAENRLESGIGSGGANSALKPSTVKSYSTAGINVGYKFSDQISTRVGVSNLFDKQILRDSNSISQTYNEPGRAYYASLKYSF

SEQ ID NO: 1807 - protein, 421 aa, Acidovorax sp.
MTQTLSLRAVLCATTLVSPFLAQAATESEVEALKKELLELRQRYEAQQNALMVLEQRVRQVEAQPQAPQPQRLVKSIQPPAQARNDANAVAGTYGASLKDDGAPAPSVENIYQDASGFFGGGTFSLETGLTYSHYDTRQLFLNGFLALDSIFLGNIGVDQIDADIWTLDLTGRYNWNQRWQVDINAPVVYRESTYQSAGAGGSTSQITEKSVTGDPRLGDVSFGVAYKFLDESESTPDAVVSLRVKAPTGKDPYGIKLKQVPGNNNLNVPDDLPTGNGVWSITPGISLVKTVDPAVLFGSLSYTYNFEESFDDINPQQGVKTGGKVKLGNWFQLGVGVAFALNEKMSMSFSFSELISQKSKVKQDGQSWQTVSGSDANAGYFGLGMTYAVSNRFSIVPSLSIGITPDAPDFTFGVKFPYYF

SEQ ID NO: 1808 - protein, 818 aa, Acidovorax sp.
MKVTMIKKPLACAILATFSMPMLAEANLKDKPTVILDGVSITSLADQNTEFGVNHSKTVSGITVSKEQLQQRATTLGDALAGELGVHSNHFGGGASAPIIRGQEGKRLKILQNGSEVVDMSGLSPDHAIAVDTTLAKQVEIVRGSGALLYASGNSAGVVNVVDDKIPSKLPSKLQGDVTVRLSSANREKLITASAEAPLGEHVAVRVAGLSKQAADYKTPRFDRHVFNKKHEDDNTQPEFIYKDTLKHLPDSHAKSNAGTLGVSWVGNQGFLGASVSLRRDKYGLPNHSHEYEECSVHGISQSALQYKPYLRLYPFLMENDDLEFDNAGLECHTHDDHDHEHDHAHDHEHDHEHDHGKPWIDLKMKRYDVQGQINAPFAGIDKIRASMGKVDYHHDEIDGGEKTSFFDNQANVWRLEASHTPIHTPMGKFSGVFGVGYLTSKNSGLVPPRYEDGNKQDTQNILHNNKTKTGSVFWFEEYKPNDKLTVDAAARIEKQTITMDYDKDAIYQSLNLGLATAHEPDIRFKRLLDSGTLNPKKQTARSYAVGTHLQLTPKHKLSLNLSHQERLPNAQELYAHGMHLATNSFEIGNRFLNKEKSNNIDLGLTFQGDKWDYRLGGYHYDFDNYVFLQTLSQYKQGLRGMRHDKDLKTARYEQAAAKFYGFDVNIGYQINDVYHVALFGDYIRGKLTNLPDKKGRTDAYGNRPLIKQPDSHTPRLPPKRLGMKLTANVNANWSGFLEYRHTFKQDKLANFERPTPAHNLVNLGLNYQHKPSHQAGSVQVFFNANNLLNDKVFAHETFFPDMPQMGRNFMLGANFKF

SEQ ID NO: 1809 - protein, 434 aa, Acidovorax sp.
MNAFSLLRLGVAGLLCVSGAQAGSLIDDGKTTLKYSQYYWKENDGGAVGPNRDEWVQALQLGFSSGWFRDVLGFDYTHALADGLRIGDDASSVTNLSAGRSPRDAHSINKPLEAYLRLQWRDDARTWSGGYGKKSRRYLIYTDDATRILPAATMGWDLGYATDAAELRYSRVHAFSPRNDAGWGERLENFRGQQIDNLQIYSASYRLPLGTRLAGEYAEAQDYLRSAFIQAEQRVDLGASQSLVASLTHGRQQDAGELFEYTGVPRLYQAENSHDARYLDMTLRYNIDGHSVALSWNQVRGDDFDRLFFAQDHGTWNSSGKLYFFFGLRDEDMYKASSSLDLGKFGLPGLKMSSYYAFSNRAYGYDGFSRKEFQNVFQYSFDGPLRGLSLAWLHDRFRTTGTPDGIHRQVASRGPAGIITEHSERFYLTWQRAW

SEQ ID NO: 1810 - protein, 351 aa, Acidovorax sp.
MKKNLLAILLPTLLLSSSAFAAQIYQAEDGSNIDLYSRLGFNITNKNNTDGDAKGEFDGRIGLSGSQTINEHASVIGMAQYQVGAAEYASQVNDKPSLTARYVWAGLDLQDYGRITGGRVSSGLIMFTDIGDVFASSDVSMARQANKVDKTATQVFRQDGTLQYQNTLGNWDISAAYLLGNNTSALDYGYNAALRYTLDMGEWGTLAPVIAAQKTQGDARSNDTEYQFWGAGTRYYIGSWMLGALYSEDSLEGFYAQKSTDKVVELTAVYNLSNDWVLRAGYRSLENQGGDGLELQDTTLEAQYKLTRRSSIYTSYVDRNGTRGSYNGGETSFGGAHADESYYHLGLRYEL

SEQ ID NO: 1811 - protein, 1068 aa, Acidovorax sp.
MQKPICVKFGRSLLPVPGLRIREKIGSATDLQAAVSLIALSTGLFMGTSAFAADFTASTQAELITAINNANSTGQSSTITLRADITLSNTVPLPAVNIPITIITGEFTLRGMPGTGVSGNGGSINIPGGPITIVGTLKGGNADITDSNGTGGAGIQKNNGSLENRGVIKGGTGGGTSRSGTAGNAGRGGVGAALTNTTVVNGVDGVISGGDGGNFDAQNMPGGAVGGRTGDGGVGLTLTGGSLDNRGLIEGGSGGMFGHLPATGADNYFGGAGGTGAILNGGDHRNSGIIRGGRGGEGVNTGATGHGAPGMGAQLTNGTLYNTGIISGADGRNGGGTLGAGNHGATGINLVNSRLENFGTINGGNAGPLMGPQALGGIAVIGTGGTTVVNGGVINAGRNGNDSFGTALQFTGGGNTLELHSGYEIYGRVSGSNSLTSPDIFVLGGVGNGTFDVSKFNPGGQIQGFGIYEKRGPSTWTLTGTTTALTPWTIYDGVLEVSEDGNLGATAGVLTFSGGTLRNTDDFTSARNFVVNPAGGTIQTNADLTLTGVISGTGPLVKNGNAALVLTGNSSGFAGSTLVDAGTLVVNGSLCGPMTVGKTARLQGTGTVCDTTNMGVVAPGNGIGTFTIDGNYVGNGGMLEIETVLGGDGSVADLLVITGDTSGETDVRVINLGGVGALTTEGIKVIDVGGASNGLFSLIGSYTLQGSEVIVAGAYAYGLYKGGMSTPDDGDWYLRSLYQAGVPIYETYASTLQSFNKLGTMQQRLGNRFWATLPEPVEKGMPSQYGLIEGNGLWGRLEASDSRFLPKISTSGVEYDVTNWRAEAGADLLLAEESFGSLIGSLIGHYGTVSSDVYSIHGEGSIESAGGGVGGALTWYGTNDFYVDGQGHATWYKSDLYSSTAGMDLAKDRDAFGYNLGLEVGQRFWFGRRWSATPQAQFAYSRINFENFVDPFGAAVTFEKSESLLGRLGITVDRQTEWMNGSGTTNRSHLYGIANLHYDFAGSWHVDVASTVLEHQNQPLWGGLGIGGTLNVADDKYSVYGEAQARTSFENFGDSRLLSGTLGLRVAW

SEQ ID NO: 1812 - protein, 803 aa, Acidovorax sp.
MNPHHHRSTLFPVCKSCVLITRLVFFILGTALILSAIPAQAQSEAGRQTYAIPAGTLKSVLVSFGQANGVMISYTESEIAGKRSSGIHGSFTVLEALNVLLTGTGLEASKRVEGGFRLRPQTPVITGQTLPLMTVSASADTLKQGTVEEGYRVSDISSIGPWGKRSLRDTPYSMSVVPSDLIENVNAQNMGQIFKMNPLTQEPAIQNITGLPLVRIRGFETINPVFDGIPLAFRTGSAVSVVEIDRVEILSGTSGFLYGGGRVGGAVNYVTKNSTDTPLRRLTFGNYGGTQFYGHADIGGKFDDQGRFGYRANLLYQGGDTAIGEPVNQKVANIVLDGHLTDTLYADIKYTYNDYRKEATQPIFNNIVERIFIDTSKRYSPKWASNDLESHKAYTSLRWDPSKYLTIRSAFSYQYANLRADQISLNEQVDRTFIPRTVNYPREKHENYGGYIYLDTRFSTFSVDHKLTLGYSSTFYDYFRTVAGEESQTGTTSFSLSALKHIPEPSWRSSGDTSMISVYVARYDNVLIGDNIIFNDQWSAMVGFNYATAINKSSYPGNNVIKYDKSKLTPTVSLLYKPIEEVTTYASYMEALEAGLIVGNTYANRGTVLPSLVSKQYEVGLKYDINPNLLLSAALFRIEKANQYSDNATPIPTYVQDGLQVHNGVELVLTGKVTDNLTIIGGGTLMDINVEKSNNPALEGKKPVNAASRMGKIYAEYALPWIPGFSLTGGIYYTGEQYGNTTNTDKIPSYTLYDVGARYATRVLNKSLVVRLNVINLTGKNYWQNANYLGVPRTVAFSVSMMF

SEQ ID NO: 1813 - protein, 713 aa, Acidovorax sp.
MGLACLGLGLCTGSGVVWPAGNDGEGRSDAGLDHVVVTSALDAVRREQAPAGYSEVSREDIARRPVTTLDEILRDTPGVDTTAVRGGRERPQIRGLEPRHTLMLINGRRLNNLDELFPHNDFRTGALPPTAAIERVEVVRNPASAVHGADALGGVINIITRPPTDEWQGTATARFGSLDSGYDGEEQHYSLFAGGPLSERWSAMAGLDFVDTEPALLPDYHDDSEDQYYQEGREALSGYTSLFYDLAPGQELEFFLSAGEEERTGRDQPRDEELPPWQQMYGAIWDLDELGDAPTRVEWTRYAFGAAYELERTDWDGQVQLYRSRVEAEEPEREQIRAFVDWPPASPGESPSSDQEAVPVFEMAPREMQHTEDIAQARGGLWWSELQRLSAVVDYRRETFEREVADEPEVPRKRAHHYGVGLENRSHLLGDRLLVTLGARLDGHSEYGGEVSPRVSGVYAINDEVRIKADYAEGFAAPNLLQLSEDYEMDHSHMPDPEAQFHLYGNPDLDPERSRSYSLALERISDHRRAAITLFRTEVEDQIVEQRTGEARPDGAHVRRYDNIDEARTKGVELDAGWRWPDGSQVRANYTYLAAHDRETGDRLESRPRQRASLLAETPPWFRAMAHTRVEHVGDQAGIGEPYTLLHLGLRQQLPAGVTLGIGVENATDERPYGTDPAQVGLSRESDEASHLYGLMPDPVRGRFYYVSAELDW

SEQ ID NO: 1814 - protein, 78 aa, Verminephrobacter eiseniae
MHQNSVTLDSAGAITRYFAKANLHTQQETLGEIVTEILKDGRNLSRKSLCAKLLCRLEHATGEEEQKHYNALIGLLFE

SEQ ID NO: 1815 - protein, 410 aa, Verminephrobacter eiseniae
MKKSYLWAGQIIVLAAAHAHAQSSVTLYGVIDTGINYTNSAQTGRNPDGSLNSGSQINMTDGATRSYGSRWGLRGSENLGGGLSAIFTLENGYNIANGALGQGGAMFGRQAYVGLNSDMLGVVTIGRQYDTQADFVSNYSVFSVAALSGTTPGDVDGLGHTRRVNNAIKYVSPTYRGFTFGGMYSPGGKAGDFTGNQIWALGASYEFRGFSAGAGYINARDPNLSSFGDNPNSGGAGTNNMGSVGSLTSAQSNPIYAGYASARTFEIYSAGASYKFGKAALAASFSHTSFGNLGDLDAGPNPFDYSGTAIFNTATATVSCFATPTLQLGGGYTYTHGGGAGGNGSASYHQGIFSVQYFLSKRTEVYFYGVYQLASGTDSLGQPAVANIDLMTPSSTNHQFVGRVGIVQRF

SEQ ID NO: 1816 - protein, 111 aa, Verminephrobacter eiseniae
MKKSLLTLALGSLFAGGAYAQTSVTLYGIADASIHYTTNADANNHGQLAMDNGAITQSRWGLKGAEALGNNLKAIFQLENGFNVPNGTMSSSGQIFNLTLPLFHESHNRGN

SEQ ID NO: 1817 - protein, 168 aa, Verminephrobacter eiseniae
MKAPAANCIDYKQNDDGYGTDDYAYQWGFYGQLRLEVIRHLSLILGGRVSRFYEKLQYVSPGPKSEWTTTSDIRGQLTPYLGTVYQITPNISWYASYSSIFTPSVGRQTYRGGGLKPQEGNQVETGFKAEYFHGRLNISSALFRMESVNQPVQDLNCPGFCGDVFYLN

SEQ ID NO: 1818 - protein, 101 aa, Verminephrobacter eiseniae
MSGALIAIIALILAAAWLVKRLGFAPKRTGVNGLKISASASLGARERVVVVDVEDARLVLGVTAGQINLLHKLPPSAPTEEIPQTDFQSVMKNLLKRSGRS

SEQ ID NO: 1819 - protein, 724 aa, Verminephrobacter eiseniae
MPSKSALRLPLIRLALAGTSALALVATAQAQEAEQETVSNGDSTALETLVVNGSGGVITAEGYVGTSSATGAKIDTPFLETPQSISTVTEQQLKDRNPQTLLETLAYTPGTRVGAYGFDPRFDAFFVRGFDVTYSGVFRDNLRQPAAVDSIFKNEPYGLEGVSILRGPSSALYGATGAGGLYNLITKRPTEDTLREVQVQYGSHDRYQGQFDFSGPVNENDPVYYRLTGLLRDADTEQVGLADDRAYIAPAFTWKPDEDTKLTVLGEYSRTNSGGTATYYNDPLTGEATDIFAGNPDFNDSVQKQGRVGYEFEHRLNDTFVFRQNARVSTLNIDADWAFAYAPNAADPTLLDSSAGTYDERLTAFVIDNQLEAKFDTGALEHTLLAGVDYTKLRFRALDGRGVSPPLDTKNPTQGRPVDAIDFNTRTVQDQWQLGTYLQDQIRYDAWTLTVGGRYDWVSTDTDTMDLATDSLTTVSQKDKEFSGRIGLTYQTDFGLAPYISYSTAFAPNAGINKETNQPFKPTESEQQEIGVKYLLPNSNTLITAALFNIDQKNGLYLEASGDTAIQVQRGKLRSRGFEIEANTSLDNGISLIASYAYTDVKIIQGPSGTIGNYVSSAPQHMASIWAHYTLPEDGPFYGFSLGGGARFVGSSYGNDQNTFKNSSRVLFDASVGYDFAAIDQKYEGLHLQVNATNLFDRREAVCTAGYCHRDQGRTVIGSLRYNW

SEQ ID NO: 1820 - protein, 266 aa, Verminephrobacter eiseniae
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 1821 - protein, 315 aa, Verminephrobacter eiseniae
MVPVAPLVLPADPEEDAEEVIAVPTVAAPLAPAPVVINMEDVGVVPPPVEEAPHTGAEIMIVQRIERIVPLEGNIEGFDDKDDDFNIEEDYENDNYNIIQERTKVEVSSSTNKSESKDSEVSLENSKQEEARQEEEAKVVTSIKEAAEASIAEAVRVEAAEVVEMQNAVKQDEEMIGAIYNLIHDITQMSCNIISHRMFSSAVVAAGDEDEKVLDKSLWIAGTYGTNTQKGFAGYKGHVAGGTIGFDIGSDNYKDLVGIAYTKLDSKFKSNGSRSNTNIDSHIVTLYGQKELPKNFMIQAMFAYNHNIVKSKSTV

SEQ ID NO: 1822 - protein, 369 aa, Verminephrobacter eiseniae
MKRSLTTVAVLGTISAAAHAQSSVTLYGIVDVGIRYNTHQNAAGNSKIGMGNGGPLSGSRWGLMGNEDLGGGNKAFFQLESGFTPGTGATQQSMPSGTARLFGRTAMVGLSSQTYGEIALGRQYTLVHEMAYTHDIYALSNYVGTLGFQGAGLTGGGRLDNTVRYTTPTFGGFSFKGAYTFGEVAGNTKQYASPAVAASYDNGPLSVGAAFQIINNIGGLTPATTAYGSTYFGITIPDSTQKVATVGATYKLPGGTKLYASYIYSNVYPAGYRNDSFSVAVSYPLTPALELKLPLYFDRLKHAGQSGTRVTGGPLLDYSLSKRTDVYAGVDYTQLNGAWRTLAGTPGFTMAVSGRSSVFEATVGLRHKF

SEQ ID NO: 1823 - protein, 753 aa, Verminephrobacter eiseniae
MSRINERPAATPRVLASALGVMTAFSSIGGLRAEEVSQKKPTEKDAEKQGVVSMEADSIVDEREGEYKVESASKKFTAPLRETPKSVTIISKQVIEDTGSLSLVDALRTTSGITFGAGEGGNPAGDRPIIRGFNAESDTFIDGLRDVASQTREIFNIEQIEVSKGPGSAYTGAGSTGGSVNMITKTAKRNDFLDISQTFGSDQTRRSTLDFNRMLSDQIGFRLNLMKHDANVAGRDGVDVSRWGVAPTITFGFDTPTRATFSYYHVEADDMPDYGIPLSPSGTGSVRRPVGHKDAFYGLSSRDFRESSTDSGTFRIEHDLAENVTISNSFRQVRTTLDYIATNPNDSAAGNIEQGLVWRSPKSRNSTSEGWVNQTDIRAKFKTGFIEHTMVGGIEITDQDVHNRPYAFTQGAAGRVCSSALLASGDCTTLNNPTYKDSWSGYYTDGLAYTDTDTQTKSGYLFDTLKFNDQWSLNLGLRYDDFETKSSGYSTGGRGTSAGNFKYENNNNFWSHQLGVVYNPLPNGSIYVAWSTSRNPVGETSGEGSDSIATATQDLEPERNRNIELGTKWEFFDGRLALDSAIFKTKKSNARVTDQDGRTQNMGEVEIKGFELGVSGRLSREWQIFANYTYLDSEIVNGGVVNGVDGANDGNENPSTPENSFSFWSTYQLFPFLTVGGGANYVDSRYGDAANTALVSSYWRYDAMANLKVSKNLDLQLNVQNLTDKRYFDQIYPTHMAHVAPGRTVLLATNLHF

SEQ ID NO: 1824 - protein, 362 aa, Verminephrobacter eiseniae
MNIRSLLLGSAAALVAASGAQAADAIVAPEPEAVEYVRVCDAYGAGYFYIPGTETCLRVHGYVRYDVKGGDDVYSGTDRNGWDKSARFALRVSTGSETELGTLKTFTELRFNYAANNSGVDGKYGNETSSGTVMEFAYIQLGGLRVGIDESEFHTFTGYLGDVINDDVISAGSYRTGKISYTFTGGNGFSAVIALEQGGDNDGGYTGTTNYHIDGYMPDVVGGLKYAGGWGSIAGVVAYDSVIEEWAAKVRGDVNITDRFSVWLQGAYSSAATPDQNYGQWGGDWAVWGGLKYQATQKAAFNLQAAHDDWGKTAVTANVAYELVPGFTVTPEVSYTKFGGEWKNTVAEDNAWGGIVRFQRSF

SEQ ID NO: 1825 - protein, 1171 aa, Verminephrobacter eiseniae
MKRWVTIPLVLVLGLLFWPSATFGQGATTATIRGQVTDADGQSLPGANVLAVHVPSGTQYGASANANGRYALSNMRPGGPYRITVSFVGYQSKREEGVTLDLGQTLSLDFALQESTAEMDEVEVVANTTGILSSERDGLVTNVSSAELEEQPTMSRSIADVARLTPQSYVVNSNDDGPAISIAGQWNRFNSIYVDGAVTNDVYGLSAQGTPGGQSGASPISLSAVEAMSVEVSPYEVTKSGFVGGAINFTTKSGTNQFDGSFEYYRRGANLTQGELNVEGETLVDGIPSSTSSDRYVFSLGGPIIKDRLFFFVNTDIRRENEGKPLQQGYEGNTPLRGGNPDNNTLDSVFEIRDFMERNTGYDPGTPGSKSDILDADKFLGRLDFNLNSNHKLTARYWYNDNFNKDRFQSTRSGINFQNNSEVFPSTQHNAMLRWNGTFGGNVATKTTATFQNVEDDRGVDGEPFPSISITDGGGDISLGSEPFSYPNFLEQNVFTFTNETDIFIGDHTLTVGTHNELYDIDNRFAIFGPGSYDFANVSDFAETVCHYAEQKQGQFGIQEPGPICQAQYPDPSTQTDFYLHQYSLVDNDPDTPFNYIANDNTALRAEFQSVKLGFFVQDKWEPIEGLNLTFGLRADLPKILDDPGAHPSANAELLPAVSDAGYDLNGATAGEMPDWQVFWSPRFGFNYSFTEERNTQVRGGTGVFTSRLPQLWPGNAFTNNGQSAAVAAGGSFAGPVPLRRPQNGLTQFDDAGIFGGGAFGATPPSSVDELTPTGNLTLFRNDFTYPRVLRTTLGIDHELPFGFTGTLEGQYSSKLNDVIVKNVNLKQPNANLDAGQTNDDRPIYTQPRDPNTDIGVDPRYGDVYLLDNTDKGYSYTVTGRLRKAPTPVWEGGTVRGQVSYTYGDSRGLNQFGDTVGSNWGDNPHASTTNNLTLGRSPFSLGHRIQLSLGYRQELTENVSTNLSLFYNGQSGRPFSYTIGGGAAETMIGDEGGPPLFYIPEDASNLQFAPIKDGNGDVIRTPQQQAQDLDRFIENVDYLSENRGEYATRNGDRTPFEGVVDLQFALNFSGELVGRKQQLTLTANVFNFSSMLGDIFGTEWGYRYQQAGLVSPVNFVRFTDEDGDGNPTPVYQSALGTENPETNLEESFDVQSGTQTYSTLYQVRLGVKYTF

SEQ ID NO: 1826 - protein, 254 aa, Halorhodospira halophila
MGKYKKSYRPPVGELVELLPTTNFSGQQKDVAGLGTDIKLKVTPVTKGIGPFKIFCYIPYIRRIKKYEKSVLKYFSLTATSLSLLSSPSVFADVKMGAKMLLDYNYYDGVHHQEGRTGSGNEIRLVRLYFIGKFDQHWENKLQIQISENDGSTKTVWKEAFLKYNGLGPFDITIGKRKEPFGLQMLVNAERVLFLERTMMSSSFAPERSIGLTLSSYPNNSSFEMGVYHQGDNGNPSYAKGNPEADNPEKILML

SEQ ID NO: 1827 - protein, 409 aa, Halorhodospira halophila
MHPNPRLAAALLAGSGLGWPLFAQADLVEDSHASLELRNFYFNRDFRQSGARNNADEWAQGFLLRLESGFSEGRVGFGVDAIGLLGLKLDSGGGSGGTGLLPADGSAGGSQDDYAKLDLTAKARVSNSLLKVGALHFKSPLVSANDTRLLPELFRGALLDVQEIDGLTLRGAHLDRNKLNSSSDYQALSANRIGGRSDAFDFAGGDYRLTPALTASLHHGRLKDIYRQTFAGLVHTLDLGGQRSLKSDLRFARASEDGDFRELDNRAFGALFSLRLGAHVVAAGYQRISGDDPYPYIAGSDPYLVNFIQIGDFGNVDERSWQLRYDYDFGALGLPGLSFMSRYVSGDNVARGAANDGKEWERNTDIGYVVQSGPLKNLGVKWRNATVRSNFANDLDENRLILSYSLALW

SEQ ID NO: 1828 - protein, 683 aa, Halorhodospira halophila
MHPRQIRTIRPLFTYSSLVALVTLSAAVKADDPPAELPEVLVEPPEETEGSGTERSARQQSHRLHDLFRGDSETHVSGPRQAQRLYLRGIEGSQTQITIDGARQGRDLHNHRGGLSGIDPAFLRRADAEPGPPAADDGHGATGGSVRFETIDAGDLVDPETGYGGFARGVRGSAADSLTTSAAGAIQPTDRVGLLVGGSYTSLDDYRVGGGDIKEYTGYDDRNLLLRLNADDGHNQRVRLGYEENENRGELPMNAGDRVRGADGHIREDDIADQRMVRETTSLNYEYHPETRWVGLEFDLYRNKSEWENRDDDTGFLSDGVGGRLANTATLARGSLGPLGHSENRLTVGGDLYQDTGEADHGDILTYDAQGLFVQNRLESERLDLSFGLRGDWMETDYEQPGESVDFSELSTNARIGYWATPSTEIFAGYGESAQGRSETVALHLDRNIDTETRIDYDEPQTSTTAEAGIQSEQPLAGGYLELSGTLFRTDIDDLILYEYERPTNLGRQTPQSVYNLDEQITTEGYTLKAAWRGEDLYSALSFTHDKVRGLDSGNALGTSRPDARQQLVRTVGPQGDRLVWDNVYQLHPAFQVGYTLKMVADLERVIPGDGERDGYNIHDVQMRWQPPGETDVTVYFVVHNLFDEEYAGHTAIPQYEAGETVADSDYLREPGRDMRLGAKVQF

SEQ ID NO: 1829 - protein, 984 aa, Halorhodospira halophila
MNQTQNNNQVGFKKTLLATAVASYAVLGFAAPAMAQQQEVVEEVIVTGIKASLQRSMDVKRDAKGVVDAISAEDIGKFPDTNLAESLQRISGVSIDRQNNEGSKITVRGFGPDFNLVTLNGRQMPTNGSSRSFEFSDLASESVSGVEVYKTFGATRASGGIGALVNIKTARPLDNPGFKASLGAKAVMDSTNEVGDDVTPEISGIFSNTFADDTIGIAISGSYQERDNRAVNADIANWRNNIDFETAVADAGASVNVTDNRSDPNGNVYYPRNFGYGIEDFHRERTNAQAVLQYTPTETIKATLDYTYAKVDLTAQNTGVGIWYNDSGSDAREVVIDENGTITKLTACCDDYASNIRLNTSETESKSVGFNLEWQANDNLTLAFDAHNSVNENGGVGRGHNAFLILAAPFIETKTYDATAGKDIPFMHITFNPSGTGIVDGMPTAASYDSLFGEANLNLNKSEVTQFQLSGSFETDADSGITSVNFGLGNADIVNRWRTFSTGQIAAGWYGGNQDLFPDEIFTEHKLNGLMPSFSGGGSNVPVYHAWDFEKAVAIAEAEWAIPGGSTRPWGWGTGVMRPDLNGNPISDHKVTEETTNAYLEFNSRGDLAGMPLNITTGMRYETTDIEANSFQQDPAELVWINQTEWSLNLAQESSYTSVGGSYDVWLPSLDLSLEVTEDVVARLSYSKSITRPTLNKMIGTTSVTSRPKPGERTGTAGNPDLKPFMADNFDLSAEWYYDDASYVSAGFFLKQVDDFIVDVISKRTVGNLRDPSKGPRAQQAIADLEALGINPTDANVIAQIKANEGLSTSDNIVQNDDDPLAEFDMTQPANQEQAKFYGWEFAVQHMLGETGFGVQANATFVTSDIDVDNSSTDFQFALPGLSDSANLVVFYDKDGLQARVAYNWRDTFLNGFGEGNTPYYTEEYGQVDISLSYDLPWVDGMTVFVEGININDASQRVYARYENQFKSAYQYGARYNLGVRYNF

SEQ ID NO: 1830 - protein, 376 aa, Halorhodospira halophila
MKHRVMMAAVAAMFAGTAHAQSSVTLYGVIDDGITYISNAGGHSNVRMDSGVVSSDRWGLTGKEDLGGGLKAIFTLENGFDLNSGAASQGGALFGRRAFVGLSSDRFGTLLAGNDYDFIYDYVTFYTNAGQIGGMYSFHLGDDIDRLAGEQVHNAVRYETPNLGGFAAGAMYGFSNVAGAFGGTPTVPRTLSIGLKYSPTGSFNAPYSFGAAFTKVDGGNEAPGVGTIAQVALNAQSIYTAAFGGLVKFGDFSVNAVYTYTNASKSAYGTVTVNAYEGGLSWHASPALTMGAGLAYVDERKLGKFDIATFGIDYRLSKRTGVFAVGTYQHAFGGASNAGNFFAVTPYSISPSMPNGVGSSSTSSQTVAQIGIRHLF

SEQ ID NO: 1831 - protein, 715 aa, Halorhodospira halophila
MGLSIFIFCASAYGEVINLGEKNIYSETGFEKNLRNSTTSPYIITSKDIETKGYTSVSEILDSVPGVNVQEGLRPAVDVRGQGFQKAKATVQLLVDGVPANMLDTSHMNVPIDVVNINEIERIEVIPGGGAVLYGSGTSGGVINIITKKYKGNNNVRGGVGYQLASFRNNKFDVSAGTSVGDFDFDINYSKNRKYGYRDYDFTNSDYFSGRINYNINKTSNIAFKYSGYRDKYTYPNFLDQKELDENRRQSGIDKEAKENNRIKKDEFTLTYNTKIGDKNDLNILGFYQKTDIPSESIEDYTSEYKGMLAGQTAKLRKALRDPRLSARARVAMQNRLNALLAELGSTNNVDLKKFSQFKDTKKAIKIKDKFTYDSVGSNVIVGLGYTNNDMLRVSKTDLVGKRTMADTKLDLSKKTFEVFALNTFKVNRFEFIQGLRFENSKYDGTRKNNDVALDIKKSKDDWAGSLAVNYLYSDTGNAYVKYERAFTSPAPGQLVDKIEIAPRVYTYKVNNLKSESTNLFEVGWNDYLFGSLLSADVFYSETKDEIATIFDVGGHGFGFKNTNIGKTKRYGFDLSAEQKFEKFTFKEAYSFIETKILKDNSNSFEGKHIADVPKHKLVFSVDYDITSKFTVGADYEYRAAAFIDNANKYGKDKAKSVFNLRANYKITNSLNVYAGINNIFGAKYYNSVRGNSPWRKILCPTSKINYYAGFKYKF

SEQ ID NO: 1832 - protein, 732 aa, Halorhodospira halophila
MDRRNEPSPLPTKRPLAPLMLLMAACSSPALAEDAARKDDPLELGADTVTGEQASSRVERSASAKYAVPLLDTPQTVTVVPQKVIQEQNALSLRQVLSNVSGITFNAGEGGGGSGDTINFRGFSANANMQVDGLRDHAQTSRSDLFNLEAVEVIKGPNSVFGGAGTSGGTINMVSKQPKAEAFGHLGAGLGTDRYRRLTLDTNQPLEGLGESTAFRLNLMAHHNDVAGREQIDKQRWGIAPSLTFGLHSPTRLTLSYFHQRDDNLPDYGVPALNGRKLDGVSRHDYFGWRNLDEERIDNDVATLKLEHDFSDDFQLQNLIRYSHLHRDTVISASHVNQKGLPPGRYLPAGPQAYGRDSKTRMWINQTNLTGRFDTFGLAHTLIGGFELSRETYDRTTYSYNLGKFYPANGFDLHNPPGYWNGPTDKRDSARNRTELEVKALYAFDTIALDERWDLSLGLRYDWIDGTSRSTPSGKPTVRADSSDGKLSTRAGLVFKPLENGRVYFSYGTSFNPSAEHLVTTGSGVTEATGGLAPEKNSTYELGTKWEFLGRRLELDAALFQVKKEDARERLADGSYVLAGEQRVRGLELSASGKLNEHWDLFGTYTYLDSETLKSSNPQREGQALGNTPPRSLSLWSTYELPEGVTLGYGARYVSQRNVTSVDNGKLDAYWVHNMMLGYQATRDLKLQLNLDNLFDKAYVERVRQVYGNQSRSSAIEYGDGRTAILSAIYAF

SEQ ID NO: 1833 - protein, 579 aa, Halorhodospira halophila
MRLTQGLFRFPLAGLLCLSTAAFAESQLSVRVTPANAALKANIEAYVGSLGERDEAALQRFRRNAEAQAEKAAQALGYFQAQIDSEVKDGKPPKLTLKVVPGEPVRLRQVNIQVLGEAASLESFRLPSGKQLKPGAKLNQGVYEDAKRLIQNQASRYGFFQGRFSTQRLSIDPRAGIADIDLVYDSGQRYTFGKVSFDGDSIIEEELLRRMVPFKAGQPYDSELIAELNQNLQSSGYFEGVRVDAAPTQAQADGARQAIPVAVRLEARKPRTMGVGLGFSTDVGARARFNWTRHWVNAEGHSLGFESEISAPRQNVGAWYEIPLDPPLTDKLRFTSGYQFEDLVDTESKLLTLGGEWHSKRPDGWQRVVSLNWMREEYKLGDDSGLSSFLMPGIGYSLLETDNKVDPSHGYRLQFNVKGAKEGLLADADVLHVDAMAKGLTSFAGGHRLLGRLQVGGIATNDYKSIPPSLRFFAGGDQSVRGYDYRTLSPENSDGDKIGGRYMIAGSVEYQYPLAERWRLATFVDQGNAFNSLDFPSIKTGVGFGVRWVSPVGPLRLDLAHALDDDGGFRLHFSMGPEL

SEQ ID NO: 1834 - protein, 1027 aa, Halorhodospira halophila
MLSIMKNKKLLCSVCFLFTFMSVLWGQNITVKGNVTSKTDGQPIIGASVVQNDSKSTGTITDLDGNFTLSVPTNALLAISYIGYKEVIIAAKPSLKIVMEEDAKMIDEVVVTGYMAEKKASLTGSVAVVKMKEVADIPTGNVMSGLQGRVAGMNVTTDGKPGGGNTDTKLRGITTINNSSPLYVIDGVQTHDNVASIISSNDVESIQVLKDAASAAIYGAQAANGVIIITTKRAKEGDVKVSFDMSLTAQTFTGGIDMLDAYQWGDVYWQAYKNTFGTNPNSVVYGNGEKAQLQEYYFDQNGVKIKSGNTDWAKEIFGTALMQNYNLSLSKGFKDGNVALTLNYMNQDGLCRNTDYERFNSRLASNFRFVDGKVRVGESISVNHWLEHLNPAGIEELVIAQHPAIPVYDENGGYAGGYVDILGDKPNAIRLTDNEANNRHKSWRIFGNVYLEVEPIKNLVLKSQFGLNYTTGFNSTFVPKWSEADRKVDVNELTVRQDNSVQWVWSNTANYSIDFGKNNISAVIGTEAKKENGEHLQGYGRGLVIEDLDYRYLDTVTEGKSVSNNASTYAMVSYFGKVNYAFDDKYLISGTVRRDASSRFGKGNNSAIFPSVSAGWRVSREKFMECTQNWLSDLKLRASWGINGNDQIDNNATYNLYYTNMSNGSYNFNGDGTTVLPGVQKDRSGNNDLKWEETKQLNFGIDAAFFDNRLGLTLDYFQKKTTGMLIQKPYIGVIGEGGYKWYNAASMDNSGVEATFTWRDEIKDFKYDISFNLSYYKNEITELPDVIKYTWGGGNGVDKTIVGQPYGSWMSYKADGVFKTKQEVYEYLSKYDVQIGAPGVGRIRYKDLNGDNIINTADMDWQGSDQPRFIGGLNIGASYKGFDLSVFFNGMIRDAWNNSKFYTDLFQGWTGNHSVRLMDAMHAWNAYEQTGVYNCDIPALTVVDNNVETRSSTFFIEDGSYVKLKTLTVGYTFPDKWIKKAHLSNLRLYLQAQNVFTLTNYTGADPEGLGYPYPQPRTYTFGLSLGF

SEQ ID NO: 1835 - protein, 591 aa, Halorhodospira halophila
MSRKWWNLIKTTPLLVGASVLTAQGAVANPEVPETQVNSFSLPSNEQLLAQAVPGTPGSPAPEATEILQMMQRSREGKRINTQVYDKPMSQVNNVNQLRDVEPTAWAYEALRSLVERYGCIVGYPDRTFRGDRALTRWEFAAGLNACLNVLERLIQEGVAVVREDLETLKRLADEFAAELAALGARIDNLESRVAFLEDHQFSTTTKLNGEVIFALANAWTDDFSIPDSAPRSQASQVAFESRPVGRQTVLTDRVRLNFDASFTGTDRLRVRLESGTTPNFNAAVGSNMARLGFDIQTDNDMDVSDLYYRFRPFNNFTAWVGTRAMDLDDVFNVGNPYLEASGTGALSRFVRRNPLVFRGPEGNGVGARYKFSDFISVTALYLADQDDATSPLPGQGVFNGNFSTGVQAVITPFDRFNINLTYLHAYFGEGSVNLSGSTGSRITQDPSTAFLARGTEASAWTRDSVGAQVDWQALDWLHFTLWGGYAYAETKNPDYDSSGDIWTWNAIVNFVDLFKEGAVLSVSGGMPPRITGVDNGPDDIDTSIILEAQYQYPLSDNILLTPGFYVVLDPNHYDRNDDIWVGVLRTTFKF

SEQ ID NO: 1836 - protein, 1107 aa, Halorhodospira halophila
MNTGRIAPKGRLFALSTASGLAISMAAAMPAYAQDNDADEDEQVASETADTENVIIVSGFRASLENAQNIKRDSDTFVDAVTAEDIGALPDRSVAETLQRIPGVNIGRFEKTSDPDRFSVEGTGVIIRGLPFVRSELNGRDIFSATGGRVLSFNDVSPELLGRVEVFKNVTADMVDGGIAGTVNLVTRKPLDNRGTRLAGTIEANVGDLAEEVSPGFSFLGSTTYESDAGSVGLQFGYARSELISRTDASQVTDPCFRADTLDGPCFRTTAVSSDGVGDPTGFDASNFPPANTVVVPKGAGVRTTELERDREAFNAVVQYESPNRDFLVTVEWLRAETSFFTDENALLALVNDDALFPVEAPGSTWQFDSNGVFQSGVLSQRVGDAYANPFGRGGIPLESLRFQRETQASTQDFSIDVDWEVTDRFRVNIEAQRIESDLRQDSIIGVMNSWANIGLDLTGETPQVSFLAPPGAPSDYFTSGANTYYWFLLDSLAQNEGDLESVRFDAEYDISDDGFFKSARFGARWAERERITRDTNFSTWGNLSAPWAGRAGCAPWGAGPGCGASGPGPFGNGFIPGRFFTGLPGQEFAIAGGAYVDDFPAFSNYRTPFGDGFQRGNAPTPIEGGGAFFFGGDDFLGEYLSGDSARQAREINTFSQTPNPFFGVQGRSFTDIAGNVTACDPFCPPEVSDVAEVTRAAYGRIDFGSDFDNGWNLEGNFGLRYVETEVRTGGLIGFPSPFGFDDPSVTNGQGNGDGIVQVAEIDASCGRTPPGQTLPGFCGLSDARKAEFAAAFTGDLIVDDRDITFDHWLPSFNARLDVGGGLLFRAAVSKGISRPDLQLFRSGGTIADNTGDLQAEGTLGTGPLFQLFTGNRNVRPVESWNYDLSVEWYFDDVGSLTLSGFVKDIEGIVNSGIDTVDFIAPSGNLTVPVEVNGPVNAEGGTLKGFEVGYQQVYDFLPGILSGLGLAGTYTYIDGGSFSNADIAGNTGPFSSSQPLAGISEHTVNATIFYEKDWLSMRAAYNWRSDFLITPRDDIFPFSPVFQEDTGQLDASIFVSVTDYLKLGVQGVNLLDEVTVTSQVIDFDGTRITRSAFRNDRRFTFLARFDF

SEQ ID NO: 1837 - protein, 801 aa, Halorhodospira halophila
MPSNLLYINHQINQKMEQLIFSFLLFTSALSLAFTDPVGKISGSIIDQELNEPIPYATIIINDMEGNLVTGITSGDDGTFLIENIKAGDYIFKVQFIGYKTFSKEIHINRNNTNIEIGQINLEPNVAMLDETVVIAERTTIEQRVDRKVINIGKDLMTTGASASEIMVNIPSVNVDQDGNISLRGNSNVRILVDGKPTNMDPAQLLKQIPSTSIKSIELITNPSAKYNPEGMSGIINIVLHKNANQGFNGNLNTGVTFGENTRFNGTLDMNYRKGKFNIYTNLGTNFGPRENGGTLGLPEQNIEQVFKVANERTSYLYKVGVDFYLNEKNTLSFYTNQGRFDGGPDGFISVTDADDSSMNLTQLLDINMDNRNSAYNFLYDHDFEKEGHDIQFELDYNDFEEEENTKIDFRDTELDFTPYTDFVLQDRQNFTGNIDYINPLSDISKLEMGAEVRLLDTNNDYETTNPEFSDSDYQYNRDIYSFYTTFGQTFEKWSYQLGARLEKFNVDAIYNNDLVYEDDYFTLYPSGFVSYTPGEKNSYQLSYSRRVDRPGFGQVNPIREVASPRLTVAGNPELRPQFTNSIELNYTRKLGKKGSLTSGVFYRRTQDEINQIFTTEEDDPGSIFLTYANYDSNDSYGAEFSANYKFTDWWSTNTGLELYGQTLKGVVGNEFIEIDNKAFTFRTNHNLKATESLTFSVFGFYRSKSQDLQLDIKSMYFLNLGARYSFLEDNKATLSLNFNDVFDTQEFRVEDGRPFEQRGRFKGETQTVYLGFSYRFGGGKNKALKRKSRDNDESGGGGVF

SEQ ID NO: 1838 - protein, 920 aa, Halorhodospira halophila
MATFQDRFKLKIISAAIIAASSFGAQAQTNTGSLEEVVVTGIRASLTGAMDVKREASGVVDAISAEDIGKFPDTNLAESLQRITGVAIDRSNNEGNQVTVRGFGPSFNLVTLNGRQMPNSSALASTPISRSFNFREIAAESVSAVEVHKTGKAHMFTGGLGATINLKTSKPFELDEFTAHASVKGVFEPSVENGDNITPELSGMISKTFADNKFGVLASFSHADRNFHVDRIGTQNGWSQGYPGQASPDTSAINTDKNPTLATWRVPTVDLDNADYERTRQNGQLVLQFAPNDELTATVDYTMSRLEENGDLNRMSFWFDNVETGRADENGTIINPARSNDELNFWAWEYGFTTENDSFGLNIDWAVNDELVLTLDTHSSTSHSNPGGQPAERIANLKNPFGDAAPVHIAADFSNKLPTVSYDDSALPGGAYALDNIEGDLYQERGNEVKNNIQQTQLHGVWQNQEDGALTAINFGLAWTQNKVDAISIYSANFSLGNGAIDLTGLDLSFTPGDIGFEYAPVFSANQFIDLVEQQDLKNPTALDKNGVKEDVNALYVSLDFETEFNNMPIRANVGLRYEDTEVSSYTIGNPVIGFNWVSPLELSKIYASEEAADTLTGEYNHLLPNFDFSVDVIEDLVARVSYSKTIARSNIDAMYPGTDMHTHLSGGPFKANQGNPDLLPFESENFDFSVEWYYSEGSYLSGGFFRKKVDNFIALGETQRAINSPQGVLTDPSANPRAGCPAGSVADPVPACTSQPSDPAITWQIAEPQNLNDSLVDGWEFNIQHMFAETGFGVIANYTMVNSDDRYDVYSLENDLALQGLSDTANLIGFYENDDFQIRVTYNWRDKFLLASGVEPTFTAAYSQVDLNASYNINESVSVFVEGINLTDEATHRYGRWENQLVDYQQFGQRYNLGIRTKF

SEQ ID NO: 1839 - protein, 728 aa, Halorhodospira halophila
MRRTSMAAAAALLPSLSAAVTVLHAFPAGAAPVEEIVITARQREENPQRVPVSVTVLDATLIERARVDSIAGIAVRAPGLVVSDPFGRFNPAPAIRGLTQPGTGEEPSVGFFLDGVYVSGRSSINLFLNDLERVEVLKGPQNALFGRNTFGGAVNLVTRRPGDTLEGFAEAGFGSKQQRQAAAAVGGPLIPGKLAARASVSLRDYGGFYDNALAGGPEIGSEKSVAGALTLRATPTERLEALLRVSYAEDDDGQPKGYYLATNCEPRAATGVFSQYCGAIPESSGPFAANPEHFGFRRDAWRTALTVDYALDAATLTAITAFNAETNEFNRDNDYTAALVSGAGQLTDRWDAGQELRLVSADRGQALTWIVGASVYHFDNETERRNIEYALGQTVSPRLPRTDEETDSTALYGSLGWRLLDGLTATADLRWQRDEKDFRTTSRDAAGNPIALSDRWTMWTPRFALSWQATDTAMLYASVAKGAKSGGFNTMANLFDTERSFGPETNWTYEVGTKTAWFDGLLTANAALFWIDWRDQQVVAASAAGRSNNFYTNNAARSRSRGLELELAATPAAGLDLSLAYTLVDAEFRDYQDPDYRDIPAFGPTGDISGNALPRQSRHQVAATAQYDGDLPWAADLGWFTGGEWLWQSRQYTENSNLSWVPSAGRVDVWTGLESGPWRLTLRVENLFDDRTPPVAVRFSDPARGSARAWLVTPGDGRVWSLTGRVTF

SEQ ID NO: 1840 - protein, 631 aa, Halorhodospira halophila
MRQSPLALALGVVFSSFAYAEALPEFVGETIVVTPTRTACTTDETLAATTVITRSDIERSQASDLMTLLGQQAGINVARTGGEGKNTAVYVRGTAAKHVLVLVDGVRAASATTGTYDWNALAPEQIERIEIVRGPFSSLYGSDAVGGVIQIFTRRAAGPGVKLTAGSRGTRALGFSLGGGDAWRYSVEAGRESTDGLPTFSDSSTAYGFNRNHLSMGVDGRLTPDLALVARLAQSWGRNELDIATGDNDYKNRTASLKFDHQAGAQWRQSLTLGNALDSYTSYSPYVPARIETRRNSLSWQHDLSFEPGQLSLGLDYWKDHASKDNSGQIDERLENTGLFAQYRFAALGGEAQAGARRDKHEAFGSQDTWNLRWGRELAPGLRITAGHGTAFKAPTVNDLYWPASSNGPYTYTVDGVTYSDTYNSGGNPDLRPETSRTTELGLSYLQAGWGAEVHLYETRVDDLIEWKPTVVPGGTGPGGEILTTYDWQPENVSSARMRGLELGGHARWLEWAWRADLARVLAVNLDTGRQLDRRPENSLTLSAARTFGRHGLRIEGSAYSRRLDVNGAKQLAGYGLVNVAYEYTLNKDTRLGVRIDNLLDKDYALARTNTRFYETPGRSVFVSLRYQPGK

SEQ ID NO: 1841 - protein, 248 aa, Halorhodospira halophila
MKKQLITALSIFFVAPAMSATSVDIGYKAYTSETKDDNGGAYDQPFVRLTHFNKADWGTLLTYIKLENPGEVKDAQNDTDGKLTVKSLVIVDKKIGDSNYNYWAQNFLSSNRTVMEDNLYLGVTTNRKYGDLFINTGIGLNYSAASFSPTGAHFDGISGYAAVINASYPFSVLGLKNSLSVNYEGQFDRDEEHMSTLGYDSYGHQIITTLKTSITNSFYTKLHLTHFDSWGAAPNDGIEYGVAVGFSF

SEQ ID NO: 1842 - protein, 1032 aa, Chlamydia trachomatis
MIKRTSLSFACLSFFYLSTISILQANETDTLQFRRFTFSDREIQFVLDPVSLITAQNVTFSNINSWGRGVCTIADNTQTQIFSNSINTTSAAGGVFDMVTISFTASNNANLLFCNNYCTHNKGGGAIRSKGPIRFSNNQDVLFYNNTTAGAQYTGTGNKSEKNRGGALYAKNITLTGNRTLAFINNMSGDCGGAIAANTQISITDTAKGVLFENNHTLNHIPDTRAENMARGGAICSRKSSCSISNNLGPIIFNYNQGGKGGAISATQCVISNNEERIVFSNNSSIGWNKSTHASNGGAIQTAQGFTLQNNKGPIYFDSNTAAHAGGAIDCGYIDIRNNGPIYFLNNSAAWGAAFNLSKLRPATNYIHTGTGDIVFNNNVVFKFDANLLGMRKLFHINNNTQTPYTLSLGAKEDTRIYFYDLFQWERVREPNNAQVSPSSRNVITINPIEEFSGAVVFSYKQMSSDIKTLMGTEHNYIREAPTTLKFGTLAIEDGAELEFFDIPFTQNPTSLLALGSGATLTVGKHGKLNITNLGVILPIILKEGKSPPCIRVNPQDMTQNTDTGQTPSSTSSISTPMIIFNGRLSIVDENYESVYDSMDLSRGKAEQPILSIETTNDGQLGPNWQNSLNTSLLSPPHYGYQGLWTPNWITTTYTITLNNNSSAPTSANSIAEQKKTSETFTPNSTTTAGIPSIKASAGSGSGSSTTTDVQVTRHTLTVNWTPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRLSSRYYLSALCFEHPMFDRIALIGAAACNYGTHNMRSFYGTKRSSKGKFHSTTLGASLRCELRDSMPLRSIMLTPFAQALFSRTKPGAIRESGDLARLFTLEQAHTAIVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 1843 - protein, 1033 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFCNNYCTHNKGGGAIRSGGAIRFLNNQDVLFYNNTSAGAKYVGIGDPYEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGWRQSSPASNGGAIQTTQGFTLRNNKGSIYFDNNTATHAGGAIDCGYIDIRDNGPVYFLNNSAAWGAAFNLSKQRSATNYIHTGTGDIVFNNNVVFTLNGNLLGIRKLFHINNNEITPYTLSLGAKKDTRIYFYDLFQWERVKENTSNNPPSPTSRNTITVNPETEFSGAVVFSYNQMSSDIRTLMGKEHNYIKEAPTTLKFGTLAIEDDAELEIFNIPFTQNPTSLLALGSGATLTVGKHGKLNITNLGVILPIILKEGKSPPCIRVHPQDMTQNTGTGQTPSSTSSISTPMIIFNGRLSIVDENYESVYDSMDLSRGKAEHLILSIETTNDGQLDSNGQSSLNTSLLSPPHYGYQGLWTPNWITTTYTITLNNNSSAPTSANSIAEQKKTSETFTPNNTTTASIHSIQASSGSSRAAPNTTEVSVTRHTLTVNWAPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHNMRSFYGTKKSSKGKFHSTTLGASLRCELRDSMPLRSIMLTPFAQALFSRTEPASIRESGDLARLFTLEQAHTAVVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 1844 - protein, 257 aa, Chlamydia trachomatis [sequence omitted]

SEQ ID NO: 1845 - protein, 1034 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFYNNYCTHNKGGGAIRSGGPIRFLNNQDVLFYNNTSAGAKYVGTGDHDEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGSRQSSPKSDGGAIQTTQGFTLRNNKGSIYFDNNTATHAGGAIDCGYIDIRDNGPVYFLNNSAAWGAALNLSKSSATANYIHTGTGDIIFNNNVIFTFDANLLGVRKLFHINNNIVTPYTLSLGAKKDTRIYFYDLFQWERVKENGNNNPPSPNSRNTITINPEKEFSGAVVFSYNQMSSDVRTLMGKERNYIKEAPTTLKFGTLAIEDGAELEIWNIPFTQESTSLLALGSDATLTVGKNGKLTITNLGVILPAILKENYIPPCIRVNPQDMTQNTNANQPPPSTKDVSTQMIFFDGDLALVDENYESVYDSMDLSRGKAEQPILSIETTNDGQLGSNWQTSLNTSLLSPPHYGYQGLWTPTWLTTTYTVTLSNNSSNPTSATSIAEQKKTSETFTPSNTTTASIPNIKASAGSGSGSASNSGEVTITKHTLVVNWAPVGYIVDPIRRGDLIANSLVHSGRNMTMSLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHKMRSFYGTKKSSKGKFHSTTLGASLRCELRDSMPLRSIMLTPFAQALFSRTEPASIRESGDLARLFTLEQAHTAVVSPIGIKGTYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 1846 - protein, 1033 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFCNNYCTHNKGGGAIRSGGAIRFLNNQDVLFYNNTSAGAKYVGIGDPYEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGWRQSSPASNGGAIQTTQGFTLRNNKGSIYFDNNTATHAGGAIDCGYIDIRDNGPVYFLNNSAAWGAAFNLSKQRSATNYIHTGTGDIVFNNNVVFTLNGNLLGIRKLFHINNNEITPYTLSLGAKKDTRIYFYDLFQWERVKENTSNNPPSPTSRNTITVNPETEFSGAVVFSYNQMSSDIRTLMGKEHNYIKEAPTTLKFGTLAIEDDAELEIFNIPFTQNPTSLLALGSGATLTVGKHGKLNITNLGVILPIILKEGKSPPCIRVNPQDMTQNTGTGQTPSSTSSISTPMIIFNGRLSIVDENYESVYDSMDLSRGKAEQLILSIETTNDGQLDSNWQSSLNTSLLSPPHYGYQGLWTPNWITTTYTITLNNNSSAPTSANSIAEQKKTSETFTPNNTTTASIHSIQASSGSSRAAPNTTEVSVTRHTLTVNWAPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHNMRSFYGTKKSSKGKFHSTTLGASLRCELRDSMPLRSIMLTPFAQALFSRTEPASIRESGDLARLFTLEQAHTAVVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 1847 - protein, 305 aa, Janthinobacterium lividum
MSCLARLALALSLTVASLAPAHAADKTALSQTDLLGREIGFGIGQTALDTAAAGVWIGASTGRTTADPSGGQQTDADRRNVVLGYGFGDTGFAAFAGYGQGASELADDIHKARIRSYFLGLTYGRSVGRFAFDGAAYVGRSHNVIDSPDSATGSADRDGRLLGLTLRGSGMLLDDGAGHGIDFVVQGDALRHTTKSYPVSGLPGATVDERDSTASALRLEVGAPMTSSGASLRPFLGLTAFGGQQDEIAISGMAPFDAVDVLSKTQMSLGMSFKAEALNGLGGRVELTSDDKGHTGFNAGFSLNF

SEQ ID NO: 1848 - protein, 232 aa, Ehrlichia sp. P-Mtn
PAQEDSSTRANVYISAKYMPTASHFGKMSIKEDSKDTKAVYGIKKDWDGVKSTASTSLFTEKDYSFKYENNPFLGFAGAIGYSMNGPRIEFEVSYETFDVKNPGGKYKNDAHMYCALDTATGSSAAANTSVMVKNENLTDISLMLNACYDIVLDGMPVSPYVCAGIGTDLVSVINATNPKLSYQGKLGISYSINPEASIFIGGHFHRVIGNEFHDITTHKIFHNSTPTSNPG

SEQ ID NO: 1849 - protein, 144 aa, Ehrlichia sp. P-Mtn
PGNEIQFGQLGLSAEWNYAQIWAHRAPQKLKFKLEGAAGLASTPHCRAIISANMLAVYPLEPLTCCGLRPFIEAGIGLIYTDYQIEDQGLRINFNPLLGIGGEFSSLNGQRWFVSARLHHVSNGELHRDNHGINSVMFQVGRYF

SEQ ID NO: 1850 - protein, 1008 aa, Synechococcus sp.
MRQPVSAARAKGEVYVRLAGSLLSSTSLSALLIAGLVAGAMTPIMSGAAAAEDFVHGSGNWGTAANWTPATVPNGVDAVANFNHDAADQGLGYGVDLSGGPYTVGTLNLNATSTSGGYRFTNGGLNFAASGQAAINVQTNNFIPDLDASASFNLASDTVFTVDGGAHFTADGVISGAGLTKSGDGLLTLNGANTYTGGTNLYGGTLSLGNNSALGTGPLSAFGGTVIDIQSGISIANDLLVNAGPTIHVGSGTATYTGLISDYDEGSAIVKTGAGTLVLTNNSNSFGLGARIEQGTIQVTADHALGLGPITLDGGTLQAGANLTLANVSILFGAAGGTIDTNGFDVTTSASMGDDSTPSGTFTKTGAGTLTVDGFAGNNTYATATDVAQGTLKAGLSASIFSANSAYTIESGATLDFNNFDQAIGSLAGAGAVNAGAGRLTTGGNNGSTVFSGVITGGNGLIKDGTGTFELSGSSPLSGGVEVKAGTLLVSGSLGNAGVTVDSGATLRGGGTVGVLDASGTVAPGKNAIGTLTVNNTAKFEAGSTYAVELNSAGLSDLIHVSGAATIVSGAGLTVTNIGPSDLVAGTRYTVLEAASVGGTFTLVGDPQVSAFVKLSTTSDATHAYVDVTQTKTFSSAGVTPNQIATGNGLGSAASSALVSAMLALPSDAAAQAAFDQLSGEIHASAKGMLLQDSHLLQDAVTARLRGAFGDSGKTASLPVMAYGEDGVQPVVADTDSFAIWSQGFGSWGGADSDGNAAAFDRSTGGLLVGADGLAGDWRIGVVGGYSRTSFDADDRHSSGDSDNYHLGLYGGTNWGAIAFRTGTAYTWHRISTSRSVAFQGFADSLLADYDAATAQAFGELVYKTDAEPFAFEPFANLAYVNLHTDGFAESGGAAALTSSSSTSDATFTTLGVRASTDIILGGVAATARGTFGWRHAFGDLTPLSTVAFAGGDGFTIAGVPIARDAMLVEAGFDVQLARNATLGLSYAGQFGRNAFDNGFKANLGIKF

SEQ ID NO: 1851 - protein, 182 aa, Escherichia coli
MILSVLSGSRLADNHTLSAGYAQSKVQDFKNIKGVNLQYRYEWDSPVSVVGSFSYMKGDWADSHRDEVDDFYRHQADIKYYSFLAGPAYRLNDYISFYGLVGISHTKAKGDYEWRNSVGADESDGYLSESVSKKSTDFAYAAGVIINPWGNMSVNVGYEGTKADIYGKHSVNGFTVGVGYRF

SEQ ID NO: 1852 - protein, 283 aa, Anaplasma ovis
MNYRELFTGGLSAATVCACSLLVSGAVVASPMSHEVASEGSGVMGGSFYVSAAYSPAFPSVTSFDMRESSRETSYVRGYDKSVATIDVSAPANFSKSGYTFAFSKNLLTSFDGAVGYSLGGARVELEASYRRFATLADGQYAKSGAESLAAITRDAVITENNYFVVKIDEITNTSVMLNGCYEVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLFS

SEQ ID NO: 1853 - protein, 198 aa, Wolbachia endosymbiont of Culex pipiens
GPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAF

SEQ ID NO: 1854 - protein, 73 aa, Vibrio vulnificus
FATLNSGPMYIDTDTERLKKGFAFSDILTFGYNYKLKNVSFDTKCVFRHVSNADLQKPNFGLNSVGFEFGTYF

SEQ ID NO: 1855 - protein, 125 aa, Vibrio vulnificus
QDDSISEEIYVTYDLARRYGVFQPVIGASATSDGSLWVGAGAKWTTQKVIDGPFFVEASFMPGLYAQGDGPDLGLPLEFRSALGVGYSFDNGATLSVLADHRSNGDLKDLNPGLETLGLRFAMVL

SEQ ID NO: 1856 - protein, 304 aa, Vibrio vulnificus
QDGTSLDMGGRAEARLSMKDGKVADNSRIRLNFLGKVDIQDGLYGVGFYEGEFTTADEGENKTNNNLHNRYTYAGLGGKFGEVTYGKNDGALGVITDFTDIMAYHGNSAADKIAVADRVDNMIAYKGQFDALSVKASYRFADRSEGTGADAGKYVDNGQDGYSLSAIYAIGQTGLTLGGGYADQHEQNEYMLAASYTMGDLHFAGIYTDGGKAKKDGDYAGYELAPKYTMGQTVFTTTYNTAETNSQTSADNFAVDATYYFKPNFRGYVSYNFNLIDSGDKLGQVGGNTTASLIDAKDELAVGL

SEQ ID NO: 1857 - protein, 304 aa, Vibrio vulnificus
QDGTSLDMGGRAEARLSMKDGKVADNSRIRLNFLGKVEIQDGLYGVGFYEGEFTTADEGENKTNNNLDNRYTYAGLGGKFGEVTYGKNDGALGVITDFTDIMAYHGNSAADKIAVADRVDNMIAYKGQFDALSVKASYRFADRSEGTGADAGKYVDNGQDGYSLSAIYAIGQTGLTLGGGYADQDEQNEYMLAASYTMGDLYFAGIYTDGEKAKKDGDYTGYELAAKYTMGQTVFTTTYNNAETNSQTSADNFAVDATYYFKPNFRGYVSYNFNLIDSGDKLGQVGGNTTASQIDAYDQLALGL

SEQ ID NO: 1858 - protein, 650 aa, Moraxella catarrhalis
MIDHLSFKTTKAKSLHTQNIAQRTLKAVAHTYRPLSMAIALMGLSSIATAQEFSQTVFFGDSLTDTGRLVQIGKNSLASSVFNQAQPSFTTNTDPVWSSILAKSYGHTADANDGTTLTGTNYAVGGARTKEDVVKNAPVPFFTIPLFTIPSAQTQINRYLTLNNHQADPKALYTVWTGANDLFEAAKAPTQLQAAEIITTAANDQANLVGQLGQAGAKHILVPSLPDVGVTPEYAQDPTKSATASLSAHIYNQTLYQSLNNQTTNVIAANTFALLKEAVSNPAGFGFSNVTEPACQNLDANLSSLACKPSDWQQTAANANETYAFADKIHPSGRTHRILAQYYRSIIDSPNQMGQLPQHLIKHGQQSQQQLVRRLDSLNNHQQSLWIDGSISNQSLDTRNKIDRPTIKLGLDIARPNQHTGAYLTYQQQDYHLSDSITADVKQTGIGLYHRHDFDHLRISANLGVDHLSTQSLRQIMWDGENRNHQAHATGQRRYASVQGSYGFTQNNVTYRPYVGIHAQDIKQNRFFENQPNLSTALSFKLPDHQSLQADIGVNIDYAMNDKLNLLAGLGYQHEFKDNNKTVETAVLSNRDYHRSFVTTVPFDKKHTTHAHLGATLALGNNTHLNAGIQANHQDHDTKVGGFVGAQMAF

SEQ ID NO: 1859 - protein, 650 aa, Moraxella catarrhalis
MIDHLSFKTTKAKSLHTQNIAQRTLKAVAHTYRPLSMAIALMGLSSIATAQEFSQTVFFGDSLTDTGRLVQIGKNSLASSVFNQAQPSFTTNTDPVWSSILAKSYGHTADANDGTTLTGTNYAVGGARTKEDVVKNAPVPFFTIPLFTIPSAQTQINRYLTLNNHQADPKALYTVWTGANDLFEAAKAPTQLQAAEIITTAANDQANLVGQLGQAGAKHILVPSLPDVGVTPEYAQDPTKSATASLSAHIYNQTLYQSLNNQTTNVIAANTFALLKEAVSNPAGFGFSNVTEPACQNLDANLSSLACKPSDWQQTAANANETYAFADKIHPSGRTHRILAQYYRSIIDSPNQMGQLPQHLIKHGQQSQQQLVRRLDSLNNHQQSLWIDGSISNQSLDTRNKIDRPTIKLGLDIARPNQHTGAYLTYQQQDYHLSDSITADVKQTGIGLYHRHDFDHLRISANLGVDHLSTQSLRQIMWDGENRNHQAHATGKRRYASVQGSYGFTQNNVTYRPYVGIHAQDIKQNRFFENQPNLSTALSFKLPDHQSLQADIGVNIDYAMNDKLNLLAGLGYQHEFKDNNKTVETTVLSNRDYHRSFVTTVPFDKKHTTHAHLGATLALGNNTHLNAGIQANHQDHDTKVGGFVGAQMAF

SEQ ID NO: 1860 - protein, 650 aa, Moraxella catarrhalis
MIDHLSFKTTKAKSLHTQNIAQRTLKAVAHTYRPLSMAIALMGLSSIATAQEFSQTVFFGDSLTDTGRLVQIGKNSLASSVFNQAQPSFTTNTDPVWSSILAKSYGHTADANDGTTLTGTNYAVGGARTKEDVVKNAPVPFFTIPLFTIPSAQTQINRYLTLNNHQADPKALYTVWTGANDLFEAAKAPTQLQAAEIITTAANDQANLVGQLGQAGAKHILVPSLPDVGVTPEYAQDPTKSATASLSAHIYNQTLYQSLNNQTTNVIAANTFALLKEAVSNPAGFGFSNVTEPACQNLDANLSSLACKPSDWQQTAANANETYAFADKIHPSGRTHRILAQYYRSIIDSPNQMGQLPQHLIKSGQQNHQQLVRRLDGLNNHQQSLWIDGSISNQSLDTRNKIDRPTIKLGLDIARPNQHTGAYLTYQQQDYHLSDSITADVKQTGIGLYHRHDFDHLRISANLGVDHLSTQSLRQIMWDGENRNHQAHATGKRRYASVQGSYGFTQNNVSYRPYVGIHAQDIKQNRFFENQPNLSTALSFKLPDHQSLQADIGVNIDYAMNDKLNLLAGLGYQHEFKDNNKTVETAVLSNRDYHRSFVTTVPFDKKHTTHAHLGATLALGNNTHLNAGIQANHQDHDTKVGGFVGAQMAF

SEQ ID NO: 1861 - protein, 650 aa, Moraxella catarrhalis
MIDHLSFKTTKAKSLHTQNIAQRTLKAVAHTYRPLSMAIALMGLSSIATAQEFSQTVFFGDSLTDTGRLVQIGKNSLASSVFNQAQPSFTTNTDPVWSSILAKSYGHTADANDGTTLTGTNYAVGGARTKEDVVKNAPVPFFTIPLFTIPSAQTQINRYLTLNNHQADPKALYTVWTGANDLFEAAKAPTQLQAAEIITTAANDQANLVGQLGQAGAKHILVPSLPDVGVTPEYAQDPTKSATASLSAHIYNQTLYQSLNNQTTNVIAANTFALLKEAVSNPAGFGFSNVTEPACQNLDANLSSLACKPSDWQQTAANANETYAFADKIHPSGRTHRILAQYYRSIIDSPNQMGQLPQHLIKHGQQSQQQLVRRLDSLNNHQQSLWIDGSISNQSLDTRNKIDRPTIKLGLDIARPNQHTGAYLTYQQQDYHLSDSITADVKQTGIGLYHRHDFDHLRISANLGVDHLSTQSLRQIMWDGENRNHQAHATGKRRYASVQGSYGFTQNNVTYRPYVGIHAQDIKQNRFFENQPNLSTALSFKLPDHQSLQADIGVNIDYAMNDKLNLLAGLGYQHEFKDNNKTVETAVLSNRDYHRSFVTTVPFDKKHTTHAHLGATLALGNNTHLNAGIQANHQDHDTKVGGFVGAQMAF

SEQ ID NO: 1862 - protein, 722 aa, Moraxella catarrhalis
MIDGVYRPRNGVGFGDLGEMERIEVLKGPQGTLFGKNTSAGVINVVTKEPEFGFGASAEVTLGNYDAKGVAASVTGPLMGDKLAGRLYVAARERDGFNDVIVGAGPSARKQDADQNFYTVRGQLLFIPDDQATFRFIADYSRRDENCCGAVQIRTGPTAGILNLLSGGTALAPTANPYDRVAYSNRGAPAKIEDKGVSLQGDIDLPIGTLTSISAIRQWRTDNGQDSDFTTADITYRNKDGTNYSEFTTYSQELRLAGKSDKFDWMIGAFLADERLENRANFLFGNQYEQYLGRLLSRSAANPAGIPNFIALLLNRAPNTSFTPGQGLYDRYDQRAKTVALFTNETWHVTDAFEITAGLRYTVEKKDLATFQTNSDGGVGCGTALTPAGQARMAGIVGAAAVGTIVGNLCLPWANPLFNGRGTSQERTDKEWSGTIKASYRFSPEVFTYASFARGYKGGGFNLDRTQSSNGLPSGGSGVTPIYDTSFPAEFVDSYELGMKNTLFNRSVLFNVSLFQQKFTDFQLNTFLGTSFVVRSIPEVTSKGVDADFMWFTPVRGLVIQSGFTYADTKYGKQPIPNDPGNALALLPGSNLSLAPKYSGSASVTYEASVGDNLKARFNIGAKYSSEYNTGSDLFPPKLQKAFTVVNGRVGLGSDDERWAVELWAQNLLNEKYMQVAFNGPLQGGSGLSATQNTYNPALDTITYNAFLGAPRTYGVTLRSKF

SEQ ID NO: 1863 - protein, 763 aa, Escherichia coli
MGINTMNQSLSISTEPKRSAPRLLCVMIGVALGSLSASSWSAAVANSTKTASAVAETNSAESSNKADTITVVGTPDTFRAGGNDLIPTYLDGQVANGGRIGFLGQQDARNVPFNIIGYTSKMIEDQQAATIADVVKNDASVQNVRGYGNPSQNYRIRGFNLDGDDISFGGLFGVLPRQIVSTSMVERVEVFKGANAFINGISPSGSGVGGMINLEPKRAGDTPLTRVTVDYGSAAQVGGGLDVGRRYGDNDQYGVRVNVLHREGETAIKDEKNRLTAVSTGLDYRSDRARTSLDVGYQKQTIHHMRTTVGVGAVTVIPEPPSTTLNYGQPWVYTDLETTFGMLRSEYDVSQNWTVYGSIGASHNEETGQYGSPILTDNSGNATISRLYVPYISESIAGLGGIRGHFDTGFITHKVNLGYATNYRTTKSAFNMSESINTNIYNPGVIPFPPTSTNPNFYSPNQDPTLTSQVRASGFSLSDTLSMMDDKVQLMLGVRRQDVTIRNFNNGVPNSAGSLDAMKVTPIYGVLVRPWEKVSLYANHIEALGPGKSAPNEFNGKPVVNKGQIPGIVHSKQNEVGVKFDNQRYGGTLALFEITRPTGTVDPATNTYGFYGEQRNRGVELNVFGEPVLGTRLLGSAVWLDPKLTKTQNGTNNGNYAVGVARYQLVFGGEYDIPSVEGLTATGTLTRSGSQYANDANTLKIKPWTRLDLGVRYTMPMKETNLIWRANLENVTNERYWESIEDSGVYLYQGDPRTLKLSVSMDF

SEQ ID NO: 1864 - protein, 255 aa, Escherichia coli
MGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYAANGISTDDIVALGLVYQF

SEQ ID NO: 1865 - protein, 372 aa, Escherichia coli
MKSKVLALLIPALLAAGAAHAAEVYNKDGNKLDLYGKVDGLHYFSDNTNSDGDQTYVRFGFKGETQITDQLVGYGQWEYNVQANGSEGDKGDSWTRLAFAGLKFGDLGSFDYGRNYGVMYDIEGWTDMLPEFGGDSYTKADNYMTGRANGVATYRNTDFFGLVDGLNFALQYQGANENQVTHEQEGTANGGDRNIKNANGDGFGISTTYDLGMGMSFGAAYTSSDRTNQQAEFSTAKGDKADAWTAGAKYDANNIYLATMYSETRNMTPYGDSTNTIANKTQNFEVTAQYQFDFGLRPAVSFLMSKGKDLVGTDGDKDLVKYADVGATYYFNKNMSTYVDYKINLLDEDDSFYAANGISTDDIVALGLVYQF

SEQ ID NO: 1866 - protein, 146 aa, Aggregatibacter actinomycetemcomitans
YQNINRPNAKVTGFEIVSQISLNDLAKILNGFNLSYKYTYQKGRMDGDIPMNAIQPRTAVYGIGYVHSDDKFGLDLYITHAGAKQAKDTYNMYHKEEGKKDSSIKWCSNSYTTIDLLGYIKPIKNLTLRAGVYNLTNRKYITWDSA

SEQ ID NO: 1867 - protein, 146 aa, Aggregatibacter actinomycetemcomitans
YQNINRPNAKVTGFEIVSQISLNDLAKILNGFNLSYKYTYQKGRMDGDIPMNAIQPRTAVYGIGYVHSDDKFGLDLYITHAGAKQAKDTYNMYHKEEGKKDSSIKWRSNSYTTIDLLGYIKPIKNLTLRAGVYNLTNRKYITWDSA

SEQ ID NO: 1868 - protein, 185 aa, Aggregatibacter actinomycetemcomitans
YPVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAQT

SEQ ID NO: 1869 - protein, 204 aa, Pasteurella multocida
MKKTVLALGVMAALVAGSAVAHQAGSVIVRGGPILVVPNASTNHDGFKFDVNSNAQLGLTATYMATDNLGVELLAATPFSHEITLGNTLVGKTKHLPPSLYAQYYFLDKDAKARPYVGAGVNYTTFFSEKAVLNGVTDLKLKDSWGPAFNAGVDIQVADNLFLNTAIWYAKIKSKATFKVGDVEHKVNVKLDPTVFFVGLGYRF

SEQ ID NO: 1870 - protein, 320 aa, Yersinia pestis
SQLAVASSQDESKGFVDDSTLNVKMRNLYFSRDRRNDDRDPETGDRQSRQAEWGQGFIGTFESGFTQGTVGVGVDAIGLLGIKLDGGRGTTNTGLFPVDSEGRPEDSYSKGYGAVKARISNTVLKFGGQFTALPVFATDDSRLLPEAAEGFLLTSKEIEGLELNAGHFTRLDAQAQSYKDSIRGRNDAGIKNGGLTEANIFGGTYAITDGLSTSLYYSKVEDYWRKYYANVNWAVPLSDKQGLVFDFNIYDTKSSGAANVKAFDGDKLDNRAFSLSAAYNVGAHTFTLAYQKVTGDGDYAYGIDGGGTVFLANSIARSDF

SEQ ID NO: 1871 - protein, 214 aa, Microscilla marina ATCC 23134
MEYNNDKKLFLTCFVYCSLSTAWAEESPWTYRIGMSNIAFDTSAKVYLDGHRVPGGSADASNNNALTFDFGYAINDQWNARLIVGIPPTTKVKGAGTLPGIQLGKITYAPTILTLNYNLPAFGPVRPHIGAGVNYTRILESKDANLKSFDADHAWSPALHVGADIDVSRNWFVSIDIRKLYLKTDASGYLGPQEAKAKVTLDPLITSIAIGRQF

SEQ ID NO: 1872 - protein, 381 aa, Microscilla marina ATCC 23134
MAHKIKALAVSIGATLVFASFASHAEITLLKQDPQAGDPLSRLNFTVGGSIRPQFNMMTGDGDKGSYKRNGFDGGTRFRFAADYYLFDDISWISYYELGVNIPALFDWDNHYAEGANNTTRRMLYTGLKSDTWGTLTYGQQNSIYYDVVGVKTDIWDYDMIGQAPGNGINGDYDGSYRSRNMLKYKKTVGDVDLYGSYLFEDSEYLPGNGLRYKRKGGGSVGADYHIMKDLTWGTAWNYTRAEMRDPSSADSKTYDQNIVGTALSWTPDNWTFSFGGGWYQNFLTTKKTDVHNYFAGDAWGIEYFAGYKFPINQYAVKSIQPYFMGDRLQYVNGRNYQRIDNGLGISFQLDYGFRVDYEHVFTSSTDNLGDMNLVRLRYDF

SEQ ID NO: 1873 - protein, 387 aa, Microscilla marina ATCC 23134
MKQAKLSLMGSAILLALASSANAASLKDTDVEFGGYIKADIMFSDYGNGAPDSGDLSRQFYVPGTIYGKEGNGNQVVDFQARETRFNFKATTDVDGHKLSGFIELDFMTHTDGNERTSNSYSPRIRHAFVSYDNWTVGQTWTTFQNAAALPENLDFVGAADGTPFARQTLLRYTQGNFQFAIENPETTVTPNQGGARITSGSGVIPDVIARYNLKTDGGAAFSFAGIARQLNLETKIGATQIDSSALGYGASVAGIIPVGKDDLRFTATYGEGLGRYMALNYINAGVLDANGDIESIRTLGGFVSYRHWWNEQWRSSVTLSGMQADNDVTLTGSGVNKDAYSGYINLLYSPSKPLTFGVEYMYAKNSKENGDDGDLSRIMFSAKYVL

SEQ ID NO: 1874 - protein, 1071 aa, Microscilla marina ATCC 23134
MKRKLLFLIVNLVLGVLTAAAQNITVQGVVLDAETKGPIPSVSITVKGSTQGIATDVNGKYTLTNVKPASILIFTYIGYKQQEVTLGGRTTLNVNLQTDNGNLDEIVVVGFGTKKKINVAGAIDQISGEQLASRPVSNALQGLQGLSPGLNISYGGGAPGSVPNINIRGVGSINGSSPLIVIDGVPATSTDDLLRLTPSDITSYTVLRDAASAAIYGARAAFGVILITTKQGAAGHNTISYNANTAFGRPTVLPEAVTDPYIYSRVLETATDNTPWDYVNYSDEHYRWAKERSENPAIADTRIDPQDPNKWAYMGSNNWNDYFFNKTSLSQNHTLTFSGGATLNNNPLTYYLSTNYTKDNGLNKLTDDYWDRYGLRGRVGFSPVSWLKIDNNINIYETKKALPNASITDLYYLQPTDVAKNPDGTWANTAAGKLAARLVDGGNNTESMFGFHNITSAVATLLKGDLLVNGDASFKRELWKYHNDQKKYLIGYGPNDIRQEGGNGFVSEDNGLLYNNAFNLYTTYRKTIGDHAFSAMVGYNSENYRYSKILVRRESLISSSLPYLGLTTGLQTTGAEYSAYATTSAFSRLNYTFKERYILEGTGRYDGSSRFPVDRRWGFFPSASLAWIASAEEFFKPLAPVLSIFKLRASYGDLGNQEVDNFGYLQTLVPGTSGYLIGGATLPIIKGAPGLLVDPQTYTWERASTLNMGADIGLFDNKFSFTGDYFIRNTKDMIAPGQDLPAVLGTNPPAQNVADLQTRGWEVSVSYRDRFNVAAKPFNFDAKIMLSDSRTKITRFTNDQMIFGANNYRVGQQLGEIWGLESDGYFQNQMEIDALDQSSIVPWGALDVVPGWPKYKDLDGNGKIERGLSASDPKDLKIIGNTADRYTVGINLNMDWNGFDLGVFMQGVLKRDFYPHHYLFWGPYQQPYANIYPWNLDFYRGAADSPEQRAKHSASYIAAGLADANTNSAYPVLQSWLADANDGRGLDIPQTKYLLNGAYLRIKNVTLGYTLPSSLTKRLHISRLRIFASGENLYEFSSIKKYVDPESINQSTSAWAYPYQRRFSAGLNLDF

SEQ ID NO: 1875 - protein, 417 aa, Microscilla marina ATCC 23134
MIYKSRALPLLLSALPLCVQAAESGFIEDSTATLQLRNYYFSRDFSDIVGPNQQSKAEEWAQGFILNFKSGYTQGPLGFGIDAIGTPRHQARQQPRPQQHRPAAGAGGRRARRRLQPPGVAGKMRYSKTELKVGELQPNVPVLVFSDNRLLPPSYQGVSVTSGEIAALTLQGGHLNTTSLRNESGRSDIQAIVGYQPQRQAPATPSTYAGGDYAFNANRTTLSAWYGQLEDIYDQRHLGLKHAEPVGDWVLGANLGFYDSNEDGKALIGSIDNQAFYLLLSAKRGGNTFFVGYQAMFGDQGFPRVFANISPLGNEVPTYEFASADQRSWQVRHDYDFAALGIPGLTTTVRYITGDNVDTGKGFEGKDWERDLDIGYVIQSGSLKGLGIRVRNVTARSNYRTDIDENRLILNYTLALF

SEQ ID NO: 1876 - protein, 1028 aa, Microscilla marina ATCC 23134
MKIERATQLLFLLLISQGGNAAYANLPRGASASPVQVSAQANKITVSGTVVDVNGEPLVGVSVLEKGTGNGTITDMDGNFTLSAGEGAALEISYVGYQNLTVSAKETLGVLVMKEDTEQLDEVVVTALGIKRSQKALSYNVQEVKNDVLTKVKDANFVNSLNGKVAGVSIQRSASGVGGGTRVVMRGNKSIKGDNNVLYVIDGVPMGNQADRTGDGTGFGAGRTSSEGIASFNPEDIESLSVLTGPSAAALYGANAANGVILITTKKGAAGKVSVNVSSSAEFSNPFVLPRFQNTYGNVSGEAASWGEKLPVPSSYNPADFFNTGTTFTNSFNLSVGNDKNQTYVSGSAVNAKGIVPNNKYHRYNAMVRNTTKFFNDKLTMDLSASYVREYYNNMLSYGTYFNPLLGAYLYPRGENFEKEKYFERYDAELGYNVQSWTPGDFGMAVQNPYWVAYRNLRPEVKDRYMLYASLKYEITDYLNVSARGRLDNTYTEKEDKRYASTHGTFAKPLGRYAYSNETFRQKYADIMANLSKPFAGDFYANVNVGASFEEYDTKGRGYGGQLLLVPNLFAYDNIDPSTGVPSQTGGDNRKMNLGVFGSAEISWKSAVYLTLTGRADKPSQLVNSKSPWIFYPSVGLSAIVTDLLPETMRQSISPVLGFLKVRASYTEVGSPIPYTGLTPGTITHSIEGGVIKPFKYYPLPELKPERTRSYEVGIDSKWLNNTVSLGVTLYKSNTYDQLLEAKLSETSGYDYMFVQAGNVENRGIELTLGYDQTFGNFSYSTSLTATANRNKIIALASNVKNPVTGEALDLSDIKVGRFRLREGEEVGTIYAEERLKRDQDGYIVYNEGQTITTESTEPYKLGSVNAKWNLGWRNGFTYKGFNLNFLVTARLGGIVISKTQAVLDQFGVSQASADARDAGKVMVGNVAVQPKDYYESVVNLDAYNVYSATNVRLQEASLGYTFPNSWFKGTPFHSVNLSVYGTNLWMIYNKAPFDPELTASTGTFGQGYDYFMLPSQRTYGVSLKFGF

SEQ ID NO: 1877 - protein, 260 aa, Microscilla marina ATCC 23134
MKKQLLCAAALVSLAGTANADDGFLGYQNGFADINVNYLDWSHRTETKSEYTSRKKDFAYIELEGGANFNWGELYGFFDVENPFHKRRTEPGRNQRYTIKTTGRFYLGDSGFNVYGHVYGTWSLPGAKYGGNFHEVNTLYGLGYNTAFGDLWFKPFIAMHYVDQSFYSGNNGYVVGWVAGYGFKMFEENFMITNWHEMEFARHKRYGSGNGGRDGVNGALAFWWNATPNLAAGVQYRYADNKLGEDFYQDAIIYTLKYTF

SEQ ID NO: 1878 - protein, 741 aa, Microscilla marina ATCC 23134
MKSKLIVFIFLANCLQLIGQELKGRVLDVFNAPIENAYVFNAVSNAHTHTNFNGTFKVNNSKVGDTIQIGILGFKKQKIVLEKKSFKDLVIVLNTKIFQLKELVLRKEMNALQTIAKLDLQVNPVNSSQELLRKIPGLIIGQHAGGGKAEQIFLRGFDIDHGTDIALSVDGMPINMVSHAHGQGYSDLHFIIPETIQKINFGKGPYDANQGDFNTAGFVNFSTKKSLQKNRVSLEVGQFNSLRTLGMFNLLENKKNEDAYMAIEYISNDGPFDSPQNFSRLNVFGKYTAFLNGKDRVTLTASHFTSRWDASGQIPERAVKNGNIDRFGAIDDTEGGTTSRTNFNVQMQKVLSEESVLKTNIFYSNYNFELFSNFTFFLEDPINGDQIRQFENRDIFGANAKVISDIQFGDIPAKFTKGAGLRYDLINDVALSHTKNRKEIIDRIQLGDVKQTNMYAFFNAEFNLGKFKISPAVRLDYFKFIYNDALQINYETLTKNKAIVTPKFNILFSQNENLQWFLKSGIGFHSNDTRVILQQNLDKILPKAYGMDFGNIWKPVPKMVLNTAVWYLLSEEEFVYVGDAGIVEPSGRSERFGFDFGVTYQFTDWLFLNTDLTYTKARSLENLSGEDFIPLAPDFTMVGGLSVANLGNFSGGLQYRYIDDRPANENNSIVAQGYFIADFNVNYKMNDITLGVAVENIFDIAWNETQFATTSRLQNEINPVEEIHFIPGTPFFAKASIRYTF

SEQ ID NO: 1879 - protein, 220 aa, Microscilla marina ATCC 23134
MGLTMKKLTALVLAAATLAPAASFAHEAGDFLFRAGTATVRPNAGGDDVKINGLGNLGHFDANNNTQLGLTFGYMITDNIGVELLAATPFEHKVGTGPTGNIASVKHLPPTLMAQYYFGSKEDKLRPYLGAGINYTFFFDEKFNNTGKAAGLSDLDLSSSWGFAAQAGMDYMLDENWMLNASVWWMNIETDVKFKAGGEQYKVDTRLDPFVFMLGVGYRF

SEQ ID NO: 1880 - protein, 788 aa, Microscilla marina ATCC 23134
MLLTLAARPTRGRLALACAAAFALPGAYAASSDSAPTDPVRDPANRSARAVVPAASAASAASAEPAGDTLSAVSVTAQRQPLDPDTPAVVESMTRERIDTHTNVTAEDTLKYAPNLMVRKRYIGDRNSVFAGRDFNELQSARGLVYADGLLLSNLLGSSYAYPPRWSLIAPDDIARVDVLYGPFSALYPGNAIGSTVLLTTRRPDKLEASLSTQFFTQRYRDGYGFADSFGGNHQTARIANRIGRFWFSLSLDRLENDGQPMQYASPNASYNAKLGRAVPVTGAATDIGPNGKARTIVGAQSLERTEQINETVRMGYAFTDRVDATLTLGHWENHYRQHGDTFLRDAAGQPVYGGNVAIGGQNLTIAPGAFAPQRGDQENWLYAFGLNGRLASGWRLSGIVSAYDVSRDVLRAASTAQGGAGTLFQGDGTGWRTLDLKAEAPEVHGHAFTFGYHYDNYFLRNVTYNTADWLNGPVTSLASVYRGDTRTQALYAQDAWRFAPGWLATLGLRYERWDAYGGALGNASGTFGYADRSANALSPKVALQWDATDVWRFRLSFATGTRFPTVGELFQGTISNNAIVNNNPNLRPEKAIDWDFTAERDVGVGVVRASVFQSDLRDSIYSQTTVAGASTVTNISNVDRVRVRGVELAFSGENVGLKGLAIDANVSASNAQILADAANPAYVGSRFPRIPRMRANLLASYRFDEHWLASVGVRYSGRQFNTLDNSDVNPDVYGGTSAFTVVDVKARYRFDRHWTASVGIDNLTDRRYYVFHPYPGRTFYGELKWSL

SEQ ID NO: 1881 - protein, 434 aa, Microscilla marina ATCC 23134
MNKFVVKMLTTSALALCAGAVHAAAFQLQEVTTAGLGRAYAGEAAIAGNAGVVATNPALMSQFKRPEISMGGIWVNPGVNIEGDIGVPAMGYRIDAGYSDAIVSKLLPNAYWIYPIDDKFSVGGGVNVNYGLATEYNADYNAGLMGGTTDLTTINLNLSGAYRLNDHWSFGVGVDVVYAEAKLSRRVGGLAPLLNARLAMAGMPATVSSTDFVTDLKGDDWGIGYNAGVTYQINPNHRFGLAYHSKVKIKFDGTIENDLPAGMGGLTERDGTVNLNLPDYWEFSGYHKIASNWAVHYSYKLTKWRRVQTLQAYTDSGVQVFDKTEHFGDTSRVALGTTYDINDKLTLRAGIAHDEGAAGRKSSISIPDTHRMWYSVGATYQFTPELSVDVAYAYVRGKTRTFTEVENIRGISVEGNYKVRSQVNLYGLNLNYRF

SEQ ID NO: 1882 - protein, 499 aa, Microscilla marina ATCC 23134
MIKRFNLTICGLGLILVTSHFFPAGAQELILYVDTATKQVYTEPGKNRIKLGTFQQVKESPVQSQSKPDTESSQPVSNTTTGLAQGEAKFQENSGQSGAESDIRRKSEEIAAHSNEPSAEKPKEEKKWYDRIGIRGYTQFRYSSTVSGDKDAVSYWPDKSVGEDGSFLIRRARLVIFGDINDHLSLYIQPDFASTPSGSSTGHFAQLRDAYADIHFDKNKEFRVRVGQSKIPYSFENLQSSQNRLALDRNDAMNSCCRDERDIGAFFYWAPTHIRDRFKEVMAKNLKGSGDYGMFAFGIYNGQGANRLEGNNGVHMVTRFTYPHQFSNGQILEAGIQALRGRFVPSTGPAGGFTPVMDAPEKGFKDERVGVHAVLYPQPFGLQAEWNWGRGPQLNDGQTMLTESSLNGGYVLATYKIDGLRWGTLFPFVKWQHFKGGQKFERNAPRNHVNDLEFGLEWQVMKEIELTAVYHMMNRTNVASAPYERYKADVLRFQLQWNY

SEQ ID NO: 1883 - protein, 1101 aa, Microscilla marina ATCC 23134
MSKKTLAIVSAISGALMMVLVLGGTLHAQAVSIASVTGHVADEQGAVVAGGQIRMSAVDTGAVYTAVTNTDGIYTFPSLPIGAYKLESTLSGFQTYVQNGILLRVNDHVQIDIAMKVGSVSERVEVTANASLLQTQQNTISQVVDQQRIVELPLNGRDPTELITISGASINHADGTNTGSKSFFSSQSIAIAGSAGNETNYVLDGGDNNDSFTNVNMPFPFPDALAEFSVETSTLPARNGLHPGGVVNAVTKSGTNSWHGDLFEFIRNGDVNAINYFATRQDSLKRNQFGGTFGGRIIRDKLFFFGGYQGSYIRQDPSSSTSYVPTAAALAGDFSALDGAGCQANKLARPIKDPVTGQALPDFKIDPSRFDPASVALAKYLPQTNDPCGKVTWGIPVQSNETQVVYRVDWLVNSKHTLYLRHLIDDYTLKAFFDPHNIMVTTVSGNVERAQTVVLGDTYTITPTTINSFHSTLGRRSDDRGTSPDGINMTKLGVTNLYQGTPNFLQVAVSNGGFSAGCGTCALGRFPITSLQLADDVDILRGKHQIAFGVDYIRTRQVQENHYNDNGVFNFSGQYSNDPLLDFLMGKMNNFNQSGQQLDDLRQNLYGLYAQDTYHASRRLVLNLGLRWEPFLPEYDHYDRGSTFSMAAFTAGQTSKIYPNAPLGTLFAGDPGVNHAFTDRRLNRFSPRVGFVYDPTGSGKTVIRAGAALMYDNIAAFIPYRMVAQNPPYGPQVTLTSGPYQFSNPWGNVPGGNPFPLPPLSKDVTFPTANAEVFLPPHLKTPQVKQWNFSVQRRLSDNWVVTASYLGNETSHLWIGNEINPAVYIPGTCGSAACSSTGNTQSRRVLSLLNPKVGAYYSTMITADDGISSNYSGLLTSVEHRFAQNFTLLGNYTWSKCLGIAPVASFSGDVMQDPNNVRGDYGPCTYDVPHLFNLSVVYISRFRHGGALSHILSDWSISPLIRYTSGLPVNPATGKDNSLTGGGNDRPNVVAGVDAYTNAPHGLKYQYINPAAYVANPIGTFGNAGHLSLRAPGSFNGMDAAVARQFKVREHVALHFRAEAFNAFNHVRFNGPNTSLSSATFGQITSAAAPRILQGSMKLVF

SEQ ID NO: 1884 - protein, 1054 aa, Microscilla marina ATCC 23134
MKKNYFLIILFLIGFASTAQVTTSTMSGLVKDDTGLTLPGANIVATHVPTGSVYGAMTNLDGRFRINNMRIGGPYTVAISYVGFETRILENINLDLGETFNIEATLLISSNALDEVTITVSENPTFSSQRTGAATQVTSRDLKGLPTISRSAQDFTRLEPTASGNSFGGRNDQFNNFTLDGAVFNNPFGLDSPTPGGQTGAQPVSLDAIEQIKVTTAPYDVTLSGFTGASVNAVTKSGDNTFKGTVYSFFRNENLTGGKIEGQDVPKADLEQLQYGVSIGGPIVENKLFFFANFEKDDRTDLGSPFSPNRGTGAINESRVLASDMIAVSQALSDLGYDTGRFENFNFNSESTKGIIKLDWNINQNHKAAFIYNFLKASKDTPANRTALGFRGPSPSVIQFENSAYEINNNLDSFQFELNSTFGNVSNKFQAGYTYFDDFRSPFSTPAPPITIQDGNGSNYIIAGHEPFSINNELQQKVFQVTNNVNIFVGDHSITIGGSFERFEFDNSFNLGGYDNFGNPNGYYGTFLGGEYPSVNAFLTDASAGAQSAIAQNLAFAQSTFDSRNANGVGNDGGWRLSETNVGQLSFYAQDEWSMTDNFKLTFGLRLDKPLYFDTDEKIQEYIDIDNGASVDPTTVYFDPETNAETTLNSTQLPTDQFLISPRMGFNWDVRNDKTLQIRGGTGVFTGRLPFVWIGNQVSGADQGFFQIVDPDFKFPQVWRTNIGLDYKFENGLIASTDISYTEDINAAHVQNWGLKEPTGTLEGVDSRAIYRAADKGENDAYVFTNSNKGRIFNAVGTLKKYFDNGLYVSTSYSYLNAKDVNSIEAEITGDAFTFNPTVGNANNDALGFSKYGDTHRFIAVISKNWQYGKSNQWETTVSSFIEYAQGGRYNFTYGGDINNDGSDRNDLLYIPTVQELDQMTFSGLGQAEAFNTLIENNDYMSDNRGSYFGRYGAKAPWRSTVDIKILQDYNFKVNDTKFNTIQISLDILNFGNLLNSDWGVVQEPFNQQPIGVVVDPATNEPVYTYNENRVDTFAVNTSLLSRWRMQVGLRYIF

SEQ ID NO: 1885 - protein, 185 aa, Microscilla marina ATCC 23134
MKKQIAGLVLGAVGILTPQVAQAGSSTLSLGYAQSKVQNFKNMPGVNLQYRYEWDSALSVMASLSVLQNDVDSTTHWWGVTSQDHVKARYNSLLIGPAWRLNEAVSLYAAAGMSHSQMARDYVSSAGQAPIHYADTVNALAYGGGVLVNLSAHVTANLGYEGSQTRVQGQRRHVNGVNVGLGYRF

SEQ ID NO: 1886 - protein, 712 aa, Microscilla marina ATCC 23134
MLNLKSYSPISLAVIAALSSSNTFANADASKTDDDIEVLVVTSDFRGSDLEKMPSSVTVIDQQQIEDEGAQHFEDILNTVANLNWSGGSSRPKYFQIRGVGEQEEYQGAPNSSVGFVVDDIDLSGLGMVSSMYDLQQVEVLRGPQGTRYGANALAGLIYLKSNDPTDDFEHGAEVSFGDDNLQTFSGFSSGPLTDSGDLLYRVSLQQHQQDGYRDNLYLDRTDTNGRDEFTGRAKLRWYATDDLEIDLTLLHADYDNGYDAWTLDNNGFDTLTDAPGVDKQRTTGSSLKFTYTGADNFELTSLTSLAQSDTHHNYDGDWANPDYWASRDCGGSPCEYEYNWDKKGERKTLTQEFRLSSTESGRIFADSTDWLIGVYAMDLQEDNDTLDTYNQLSAEYEAQNYALFGQLDSDLGASYALSVGLRVERRDSDYRDSAGDSFGPSETMWGGHIALSKALSEKHESYIRVARGYKAGGFNMSLPDELAGKKEYDTEILYNYELGLKSTWFDGQASTNLAIFYMDRQDQQVAASQQSTVPGEEGNFILFTENAGSSNNYGAELDGNWYATDNLNLYGSLGWLETAYGDYQYEDKYGAVVDLSGRELAHSPNYTFSIGATYRSDNGWFANVNASGKSDFYYSDSNESKSDAYQVFNAKVGYEADIWSVYLWGRNLFDEKYGVRGFYFGNEPDLDWADKQYIRYGDPRQLGMTFNLKFL

SEQ ID NO: 1887 - protein, 218 aa, Microscilla marina ATCC 23134
GWQLGSAWQINENNRIGFNYRSEVELNLTGSASGAVYDLTSAAQGKKPSASYAGSMALTLPATAEIASFHQLTNKVAVHASFNWTDWSSFDKLEASIPSLYGNNPDLIKEENWEDNYRLAVGTTYQYTNKLVLRSGIAYDTSAVSDEHRTQTIPETDRLWLSMGAGYNWSQSLTLDAGFTYIFAKDASMNEVDPNLGQFKGETTGNVWLVGIQASYRF

SEQ ID NO: 1888 - protein, 1043 aa, Microscilla marina ATCC 23134
MLQKDHFYRIIVAQVFPLLKPLLRRSLMSSPVTKYFARKALAHAIAGAAVFTAASFPGTVYAQETSAMVRGSVTDMSGAAVAGADVVITSQRTGIEKRVTTDERGYYSVRGLPAGVTYDVSVDANGLQKAMTDDLQLAVGQQAVLNYALSTEEEVIVIGQRIAVAETAIGPNAVFDLKSLEDSPAINRNITDVIQQDPRIFVDQSRGDVDAIQCNGANPRFNSLTVDGIRLNDGFGLNSNGYPTQRMPFPYDAISSVAVEMAPMSVVYGGFSACNVNAVTKTGANELSGSVFFDYGSDSLRGDKLEGDSIESQDYEETRWGFELGGALIEDKLFFYGAYEKYDGADLNDRGSIGSGAVNEVLISQAELDRIAQISSDVYGYEAGRTVAEAFDFEDEKYLAKIDWYATDTQRLAFTYMYNDSFNFSPSDGDLNEFEFDKHFYKRGSELTSYTLNWYSDWSANFSTEVRYSISNVDFLQQSVSGPDFGEVQIRAGDGVTVYLGQDDSRQANDLEWDTDQMVLRGYYNLGDHTITGGFERESIEVYNLFYQHTDTEMRFNSIDDFENGLAARVYYGNALSNNELDAAVDWSYDVSSFYIEDKWQVTNSLLLTFGLRYDYYETDDVPNENPDFVADYGFSNTATLDGIDLLLPRFGFTWDASDAVTVRGGIGLFSGGNPNVWYSNVYSNTNTTAVQTQDRGPDRGGVDLFAQNYVYCEDTAPTCGPGYGVPENLAAQVAAGDGSNFEIVYLDPDFEAPTEWKYALGATWEMGNGYVLSADAQITRGEDTAIYKHGDLEFTGEFNDFGNGYPIYDSVRTSSFVLTNSSKGNESESLSVSLFKAWDFGLDMRLGYAWTDAKDVNPMTSSVAFSNYVNRTFYDPEEEVLSTSNYNIEHRFTAVLNYSTEWFGNNATRFTVFAQGNSGYPYSITLEGADGTIGAYGFTPYLDFVDHVLVEPGTRNQEEGSSWFKVDLRVSQEFPGFSDGHKGSAFIVVDNLTNLINDDWGIMEKPIFPYGVTQDQQANGQAQTRIGDASLWEIRVGMNYRF

SEQ ID NO: 1889 - protein, 488 aa, Microscilla marina ATCC 23134
MKMVKSLLLGSAAGLVAVAGAQAADLPVKAKAVEYVKVCSAYGAGYYYIPGTDTCIKIGGYARFDTYVNAVGTFNPAITSAAGTIFNGPGVGNFAYPFKDSDDNDYLTRVRGTIDFDARTQTDYGTLRSYVRFGAEWNSQTGTGAVSGSGIYFERAFIQFSGFTFGYTQSFFDTGLNYMLTTPLSGSNTWTTLAAYTAQFGNGFSATLSLEDAANRTTGVQMAGSTTQAIIGTTTVASGLGYTNYQAGQQAPDIVANLRIDQAWGSAQLSGALHQVQVTLPAYAGYYPGLTSSDSWGWAIGGTVEFKLPFLAAGDSIFFQAGYEEGAANYLGLSGTALGRSTGVGSISLNQVGSFITATGAFYTVADAVATDLFGDTSLTKGWQIQGQFRHYWTPGLRSALYAGYLKYETPDNIVAALDFNLWQVGVNTVWSPVKNLDIGAEVIYSKVDGSAPLGAYASTSASGSNTYSLVGGSTDIWSGGVRVQRNF

SEQ ID NO: 1890 - protein, 753 aa, Microscilla marina ATCC 23134
MKRIFMMLLGVLSTLYTTAETGYLYENNENDNATTRCFKGVVLDENGTPLPGASIVVIGTTIGAGTNTQGEFTLSLRDKGFPILRASFIGYTPVEYKIQNNEHNNIVIRLKPTQSSLEEVVVTGTRTEKPLKDAPILTRVIGQKEIQALNPMDIETLLQYELPGIQFNYNSMSKLPEITYQGMSGEYLLFLVDGERISGEGSDHNPDFSRFNIDDIERIEVVKGAQSTLYASNALGAVINIITKSANRPFTGNVNARYGNNSGQKYTVSGGTKQNRFSSFTTISHRRRDTYTISDDKETERTVINPDGSITIDKSANSSTIRGYQIWDASQKFGYAFTDQFSAEIKGTYYRNKRDNATANAKTNDIFSNYSVNGKLKYLFNVNHRLDLSYIFDSYRKDIDYFVAGYTKKNYDNFVQTARLNYTGNFNDQHTFTAGLEANLEYLKHYMFKDSTNYNQQSYVFYVQEDWKISEKFNLIAGIRTDYHSQYHFRMTPKLSVMYRPVELLTLRVGYAQGYRTPTLKELYEEYDMGGLGMFTIHGDENLKAENSQQFSLSAEINKDIFYASISGYYNKFKNKITLAYLDNIEDGKSMPDMKYMNSDNAESISMEAIARVKMDCGLMLQGSYAYVHEKEEYKGYNLSMTRPHSLTFNASFNRKFGKVNTSVSLNGQWSSKLHTYSYYSVDNTITEYNYSPRTICTLNTSASFPRGISVGLGIDNLFNYKDKSADYGIQLPQQGIGFIGTVSINLADLFRL

SEQ ID NO: 1891 - protein, 720 aa, Microscilla marina ATCC 23134
MKHIFLFLILIGQFSFAQNKTAKDSTKNNQQLEEVIVTANRGATKRCEIPVSVSKITPKTISETKPTSVHEVINKTSGVLMVNLGNEQHAMAIRQPISYSSYFLYLEDGLPIRPLGVFNHNALLEINQFSLNSIEVVKGPVSSIYGPEAIGGTINFITQNPTLEPTFKIGLQADQFGYKRMQVAGGATVGKFGFYLSGLTSDQKNSWLAASDYDKNNINLRLDYAISSKTKLIGTFMQGKYYSQMSGSVSEEIFKSRNYSSTTNFSYRRSDALRTSLRLNHNWNDNSESFITIFHRDNKLGQNPAYGIRWNPTASGTNNPNFAKGEINSNNFKSYGILGQHSQKFNFLHSNLIIGGLFDRSPNDYYSNQINLKANLNTGGQTVNNYQIIGETGLKLANYNAIIKNTAGYIQYSFNVIDKLKFTLGTRYDQMNLSYTNNVGTIASGNKNYSQLTSKIGANFNLTKNIAFYTNYAQGFAPPALSSIFRKKPNTGIATIPAEFYYNLEPAKFNNYEIGGFLNLFQNKLTVDYAIYYLQGKNELLSIRQIDGSTDYQSAGETSHKGIEFGVNYCPTQQWHFRVGGTTAEHKFIDFKVSDRPTDPVQRLDGFEMPQAPKWVSNSEVSYYPKWLPNLRTSIEWQYVSSYYQDQINSLKYEGYNFFNARIGYTYKGLEFYTNIMNLTDKLYAYNVSKGNNTTDKATYTVSAPRAFMFGIEYKFNLKK

SEQ ID NO: 1892 - protein, 177 aa, Microscilla marina ATCC 23134
MVLGGPMSLNRYFTGGLLCLLGCNPANAQTATIVLSATLLPACEAGSVGSGGAITFGTLDFGQYASLNNAISATSQQGAGSIRVRCVSGQTYAITLDGGLYGSVATRRMANIANTALTLTYNLYSDRPGGIVWDNTTGVAATGNGNDQWYPIYGLVPAQTTPVAGTYRDTVNVTISW

SEQ ID NO: 1893 - protein, 146 aa, Microscilla marina ATCC 23134
MSFETIVGYKSFLTPAFGMRYYINFAYSNAEQKNDLKPKIIMNYGLNADMLYNVVASESVNLGAFVGVGVGANTWAAKNNEDFKAKTGFNVALNAGLRSQFGKHHGIEVVARVPFIDTTLENDRITGAKQTGSHIYNVGARYILSF

SEQ ID NO: 1894 - protein, 795 aa, Microscilla marina ATCC 23134
MVKRQLQRISLGSLFFIIGAISIFAQPKTMVSGKVISKEKQEVVDFATVYLKGTTYGCTTNEEGIYHLHAPAGKYTLVVSAIGYKTIEKPVTLVHGERIKMNVMIAPSVTELGEVVVVSNGVSRVKRSAFNAIAVDTKEFQNSTKNLSDALAKAPGMKLRESGGVGSDMQLMLDGFSGKHVKIFIDGVPQEGVGSSFGLNNIPVNFADRIEVYKGVVPVGFGTDAIGGVINIVTNKKKRNWFLDGSYSYGSFNTHKSYVNFGQTFKNGFTYEINAFQNYSDNDYQVDAPVEDFETGRIDKDKRVRVKRFNDTYHNEAVIGKMGIVDKKWADRLMLGFTYSHMYKEIQTGVRQEIVYGEKHRKGHSLMPSLEYSKRGLFIKGLDVALTANYNKNATTNIDTASYKYNWLGDRKLMNSPGEQSNQYSRADNNNWNGTLTVNYRLAKIHMLTFNHVLNTFRRSNTSLLAKMESEDAIAKETHKNISGLSYRLMPSDNWNLSVFGKYYSLYVAGPMATTTNQDDYVRTTRNMNSIGYGAAGTYFILPGLQAKLSYEKAYRLPTIEEMFGDEDLEMGDISIKPESSDNLNFNLSYNRTFGRHSVYMEGGVIYRNTKDYIQRNIADLSGGKYAAKYINYGKVLTKGYTVSARYGFGNWVSIGGNFTKMDVRDNMKTSISSSAENLAYKERMPNLPYMFADSDVTFYWRDLGRKGNMLTVSYDNQYLHSFTYYSSRIGSNKGDYVVPDQFSHNISFSYSLQKGRYNVSLECRNFTDEKLYDNFSLQKAGRAFYGKLRVCFGN

SEQ ID NO: 1895 - protein, 703 aa, Microscilla marina ATCC 23134
MGKNQYIQILKYSVIPFLLVFALTLSAQNQVPATKAETVQVIGKVPDSSSQNFRSNPSGFQTAIKLDETSARYTSLPEVLEREAGLRVRSFGGLGSYSTLSIRGTNPNQSRIYLDGIPLNNSQGGEVNLADLPFDSLESVEVYRSGNPIGFSGSAIGGSVNLVTKKDSQKPKTRINLGGGSFNTGKASVSHTGNYKGIGTSFLALGEKSDQNFSYKNDHGTVVLNTLDDTIDRRKNASFERAALFGSLKYQIGKTELKFLNDFNHRIHGLPGPGSNQTDRVHRKYDRNTSSFATDTKGLFVDSFRLETRGFYTAAKDDLYDPLSEFSKGTPNSRAEIRQAGFQVMPTLYLTDYHQILRGFVSLEKESFDRERLTSSNLVGRVEPKKERTYSSFRLEDEIRIWNSKILLIPSVTWDHYKDRFPSEEPWYRRQDPLSGDIKKTTFTNPKLGFVWKIFEKESWDVQFQANISKQYRIPSFLEMFGEQGSIVANPNLKPEQSENGDAGFIYKTNHSFLKTKSSISYFKKDMRDMILFLPNSQFTLRPENVDSAKIRGLEFSHRGDWKYGIKFLFNYTYQEAINTSSSPYLHGKILPLRPRHEFSSTFSWKGKKLETGIELLYIGAVFRDRTNEYINYIPERQIWNYFFTWVIYSESKDSDLNGNSKEITREVLLTFEVKNFTDKRISDLIGYPLPGRSWYTTLSMRF

SEQ ID NO: 1896 - protein, 717 aa, Microscilla marina ATCC 23134
MFRMTTLALLVGSATCAWAQDDTLTLPASTVTATANQPTEATRLDLDRPIESGSRLNLSARENPASVSVADRKTMERIGARNFQDAANALPGVNASAPPGWGGYVAYRGFNGAQISQLFNGISLQYGGAARPVGAWIYDRVELLGGPSSFLNGSGAVGGSLNFITRLASRDEDTFEGRVSYARYDTMETSIAFNKALNTGDGPRHYARLDYSRTSTNGYIDRQENGAGNLAFSLLSDINDQLSHTLAIEYLEEQEDSPYWGTPVLQPLVGTLHIDKHNRFNNYNVEDGRYEQRTRWLRSITDYRVDDNTQLRNTFYHYNGQRDYRNLEVYRYNADNSAIARSGGYRQRHDQEVNGNKLELTHQGQLFGMASDWAFGMDYSTNQQTNYPLSKGAFDTVDPNSFEPGHFLDIPGMDAPMTKGRTTTTDTTSAFVENRTRLTDQLSLITALRYDHIDFDVVDHVARARLDRRWDAITGRLGLVYDLTSNVSLYTQYSTSAEPPGGTLTSASISQVGDFDLSTGRQVEVGSKFDFLDGRGSATAAAYRIVRKDISVPSSTVPNTTEQAGQQTSTGIELAASFKVTSKLLAAGNFSWVNAEYDEFNETIGGVVYSRKGKHPVNIPDRVANLWLTYDLAPGWQVGADARYVSSVYANTANTAWVPSYTVYGLSMTHDLDKHVQVSARLRNLTDEVYARFIHQTNTQYYLGEPRSLEVAVQWRY

SEQ ID NO: 1897 - protein, 845 aa, Microscilla marina ATCC 23134
MSTKTFKKGVLASSIAMILAGVTSQAMAAEEAASEINKDQVEVIQVTGIRGSLKKALNNKRFSDAVVDSISAEDIGKFPDRNIAESLQRIPGVTIARNFAGEGGNVSIRGTNPELTLVTMNGNYLASTGWFSQQPASRSFDMDLLPPELVAGVDVYKSPMASLDEGGVGGTVAVRTRKPLELDANTLYLSAEIQDNSISDDNGQGATGFYSWKNDSETFGLLGSISTLESVGRAHKAENYMDDGWAGAGIAEFKQDRKRTAYDLTLQYAPTDSLSMNLHYLTIDLDAANTNQNYLIIAGTDSAAFNANVTGATKFGPENGFALNGKYAGAAFDDTNSRNAETDTGVIAYEVDYSGDGYSINAKVGNTNATGGDGGNYNVGWASTNANQSIDFDMSGHDSMLLSPNNADASNHAEYAMTNASVNAAGYREDDETFAQVDINFDVELGPVSNIKTGAKLRDHEFTSYSNKWTFEDGFTDGLTKADFADGTFNHSGVGLSGDSPTAIARVDGNKIRTYMDSVKTGETLNKDSFGVIKEDIFAAYVQGDFSGDDYRGNIGIRYVKTDTSADYFLGNDPAEEESDYSDWLPSFNLALDLDSDLILRISAAKVMSRPNYSFLNPAASVNETTKRITKGSIKLEPYRANQYDIGLEWYFNEESLLSATLFSKDISSFIIPGANEEKIQYKGEEYILSTPGQGLGGQLEGVELQYQQQMGEFGWSANLTYTDGYGLQDNGSEIVKAPLAGMSKISYNVSAFYETDLVSTRLAYTYRDEFIAQSTGIGGNTGWDAHGFLDANVTWHATEGLDVSLEATNILEETTTQRFVSEFDAMRLAADNGRNIYLKVSYRL

SEQ ID NO: 1898 - protein, 265 aa, Microscilla marina ATCC 23134
MLLLKFNTTIISWMIIIYIRLLAGVLFMSMSKKCLFTGAVIFFSFTPFVHAVQFDVRGGYNIENHSYESRFKVSNSWSSGWWASMETDSNNGSPSLDDMTSSYNEMETNYTWHINDRFALVPGGVIHWSNSGTQLRPYIRLNYKISERFSSGIRYRLDHHNYDVVDNTGDTIHDNEHRIDLFLGYKINQDWNFMWQGTAYMHQDPDLEYNNGKRWATENAFTIKYRWNEYFSPYFEYDYLDEQSNYKGEKGKPDSRIRVGVTFNL

SEQ ID NO: 1899 - protein, 209 aa, Microscilla marina ATCC 23134
MKKYLFLLMAATSTSVFAAPYVGLEYGVTNMSHDYSTTFSDNVSLTPDDSSSAFGGFVGYRFNEFGLELGYKKFESDDSNSKRLSYVPPVETEREWNADLDATQFTLKPVYFHNFNEKLQLKIGLGLTYTQYKYDSSAYTETENDLTDQESISDYEHGTSKSESVFGAIASVGIEYMVIPNLALGASASYQVDNIANSSSFMLSSAYYF

SEQ ID NO: 1900 - protein, 256 aa, Microscilla marina ATCC 23134
MNIKKLSVLSSLILATAGVQAEQFFTDTSISALYGTSFEAYDFGNSQNVQYDTAVLTIENVSAHNWGDTFLFIDITNNQSPSTDGVDDVYGELSGRLSLSYLTNSDLSFGPIKDVLLAGAYEYGGGVSANNKLYGVGLALAVPAFQYVNVNTYYVDNQTLYSDVADLQLTVTWGLPFTIASTSWVFDGFIDWSTAESDHNADFHFNPQLKIDLGELIGAGKGNIEMGVEYSYWINKYGIAEMDDENAFSLLAKFHF

SEQ ID NO: 1901 - protein, 696 aa, Microscilla marina ATCC 23134
MATTGALAAEAAASAPDDRHALPAINVTASSAPADPLTQPLETGSRLGLASLDTPASVETVTADTIDARGDRTVLDAVTRTAGFASAIAPGTGGTALSVRGFSGQESVMTLLDGVRLMPAAGTITFPFDTWSVARIEVLRGPASVLYGEGAIGGVVNVVPKRPQRTRETTLQAGVGPDGAKRFAFDTTGALGPRLSYRFYASDARANGLAERADTHTTAIGGALTFDVSPQLTLTLDYDYGRQMPATYYGVPAPHGVLDPSLRKLNYTVGDATISYYDQWTRLSASYRPAPGVTISNQLYYLTSNRHWRNAESYVLDLATGRVTRGDYLDIGHHQRQIGDRLSARFDGMLFGRANRFVVGTEFSQITFSGTNNSPYGGETTVPAHGFDPGVFTSPDPTVPQFSTRARQAAVFAENRLEVLPRLAWVSGLRYDHIAFSREQAATGAGFDKRFANVGWRTGVVFDIAPAFTAYAQYTTGAEGVGSLVTLSASQMNVRLATGEQWEAGLKQTLLDGRAYWTVAVYDITKRNLLSTDPFNPALRQQVGRQSSRGVDLTGGARLSHGWTIDANVALLRARYDAFNQTVGGATVSRAGNVPSGVPQQTANLWLGWAFAERWHVNAGVRYVGATYGDDANRVRVPSYTVFDASLRWQPTSRTELALYLRNLANRTYAVTTSNGGEQWLLGPSRSAELVATMRF

SEQ ID NO: 1902 - protein, 787 aa, Microscilla marina ATCC 23134
MVAQNKDCNYTLSGKIIDLHDGSVLPGAVLTIAGLETTVESDINGIYTFSNLCEGVYSIQISHPNCTTQGVKVKVSSNTKRNFKLEHHLEELNTITLQASIYRSKTKTNFEQKITEKQLDRFSNASLGDVLNTLSGVSSLNTGNAVVKPIINGVHSSRIVVMNNGVRMEDQEWGAEHAPSIDVNTIGNITLIKGAGALKYSGDAVGGIIVTEASKIPVKDTIYGKTHVTAATNGRGGSITSTLTKSYVNGWYGSVQGSLKRFGDYEAPDYVLSNTGNFERSLSARIGINRFDYGVEAYYSFFKNEIGILRASHIGGASDQVRAINSGIPLIIRDFTYDINAPKQDVTHHLFKVRGFKNFKNLGKVTLQYDLQQNERLEFDVRRSSNDDDRPSLDLVLNSHTIRLDLDTDNTDLFNLKTGIMAQYQKNIADPATGVRRLIPDYERFNLGIYGVADYSISDHFLVEVGGRFDYFNIDAQKFYKSSFWEDRNYDILFPEIVVEVFNNQLLTNPKLDYSNLSATLGTRYTFNDKYKLFMNYSLASRAPNPSELFSEGLHHSASRIELGDLRFNSEVAHKVSITLQKQGTTFGFSINPYINFINDFMIIEPTEIRQTIRGNFQVWEYRQTNATLAGIDIDASVTFTDYLNFYHQFSMVKGYDNTRDISLIDMPPVNTTNGLVYQNKELKNLRVELQSEYTFRQNEFPNNNFEAFIPETNTFELVDVSTPPDAYHLLHLHSNADFKLGENSMLNVGISVTNIFNTNYRNYLNRLRYYADDLGRNLSINLKITY

SEQ ID NO: 1903 - protein, 945 aa, Microscilla marina ATCC 23134
MFKQTYLASAILLALASQATYAAEAEATQSPQTEETSRPSSGGKAQNNEEMEIIQVQGIRGSLNKAVELKRQNIQVVDAIIAEDIGKFPDNNVVEALQRVTGVQVTDRASGEANTVSIRGLTDVTTTVNGRQVFTAAGREVAIADVPAALLGSVEVFKTRSSSQVASGIAGQIDIRTHRPFDFQEEKISVAAKGIYSDQPDTIDPNFSALISDRWDTSIGEVGALVNVSYIRTNYNDQVVAPGASMPYYAETGVQIPDTYWKRGLAHGLDTSEGALINGQEYLLMRDAVFQNMNNGERERPALNLSLQWAPTDTSEYLFEAFYNGYRNDNFNSMLFSNVDSSANWSQVIQDGIEVYDGTNVVKSRTAYNVDGFSSSDHSHNKTDSYVFALGGKWDFDNLTLKSEVVYQTSTYESQFLAMRGVSANSTKTFYGVDVDYNNKSGGVPSWVYLDNPDTDINESDLTQYALWQTAQLYDSGAKDEGDSVTWTFDGDYFLDYGIFTKMKFGIRAEQRGAKHGLYDAGSLNTNVLFSDLDPNMFTVTSGFFDGRGNVPTSWAIADGNYLYANRSAIEAMYNADEQALAMYTNYDITEKSYAAYIQSDFETELWGKQVDGQIGLRYEKADADMDFWERKKYAAEDVVDDIRYYLVHDTDTNGSAELLPSLMVRFWLTDDLVARFAYTETIRRPAFGDLTTAISYTEDLTKLGFGQASSGNSKLEPTTSQNYDFSLEYYFGEGSSIFGTYFRRDIEGFVFNSSSTITREVDGETKKYILSRPENASNGKLTGFELGTVYFPENMPSYLDGLGTQVSATFLDSSQDIPEFDSESGEQIGTTTRELFGVSDTSMSAVLIYDKDDYSARLSYTWRDKFLSAYDAGSFAMPRGIYRKPEQSLDFQFSYNISDEFVLTFDATNILDDIYQEYYEDSVLYNRTNSIYTRTFALGARYSF

SEQ ID NO: 1904 - protein, 790 aa, Microscilla marina ATCC 23134
MKYHYRLPLRRTPPGGSDYALALLLALGGALPASAADAPAPAEEAPPLAGSAPAKADTALGKVTVTARRREEDSQKVPTPITVLGGETLEAQRISRVQDLQQVLPSVNVAYIHARQSSVAVRGIGNNPASDGLEGSAGIYLDNVYLGRPGMAVFDLLDIEQLELLRGPQGTLFGKNTTAGVLNISTRAPTFTTERTVEVSGGQDGYFQGRGTVSGPLGETLAGRLSAYRTRDDGYIKNIHDDNYLNGGERQGARGQLLFEPNEDFSLRWIADYNEEDSSNGSMVVYGAAERFWQRAALVGASPLRDPQRKKVNINGRQHVSVHQGGSSLEANWNLAGGYRLTSISAYRYWHFTPANDEQLNVSAINDTGVEVHDRQFSQEIRLASPTGGAFDYVVGAYAFRQNLGNKTFTSYGPLADLYLLGANLGALNDTYSKANGKIETDSFALFAQGTWHLSERLDFTAGLRGTYEEKNAKVERFAPLGGAAVGGVGAAVRNGQLGAYDSGDLSQYNFAPSALLSLSYQFSDDLLGYASLSHGEKSGGVNLAVGSAPSAGADSLLVGPERANDAELGLKSTLFDRRLLLNANLFWTGIHGYQATTLYQAPGSTQLVQVLANAGSVRSRGLEFEATALPLRGLTLNFNGSYNDVTYLSFKDAPCPAEVSTRPGAPSSCDLSGQRVVGASKWIANLNGEYQWRLDDRFQPYVSASYAYRSAAEGTLDNSDLSKIDGYALVNLAAGLRSDLGDGQLDTSVWLKNAFDKDYYLSAFASINGSYTASVGQPRTLGVSLRYDF

SEQ ID NO: 1905 - protein, 868 aa, Microscilla marina ATCC 23134
MWDDTAYVDHDWDDGDTFTLNIANSTIDDDYEYFYFTDDYNNADGKVTTEDWRTSELASLGTAVTLDVESNINITNNSRVAGITLSQGDTYDATYATGGDSAYVHTWDNTIVVDNSTVTSGAVTPLEGSGWFGNSSEPSDYSGNAVYDTTTGTWYHNPNDTALSFSDDPDSYYSMKNNVTFTNGSTLMGDVVFTSNFNNADDANADSNGDGVISASDGFSPIGYDTNNDGVEDTNGGWSHDNDNVDELNLKLDNGSKWVGDAYFSYEYIAPADMYDLEDGTNSLEPSSTVDKWGNVVDDKTFQSGIFTVALDNGSEWDTVNASNVDTLTVNNGSQVNVADSSSLIADTITLTNGSTMNLSSYGEVDTDHLTVDSYSKVDLTNETAYLYANTITVSNGGEFSIGAGEFDADSFGTDTLELTNAGVFNINNSDYVLDADLVNGHTNTTDTSNATYGYGVIAMTSDGHLTVNGNGDYYNGDNTADTTYSANGEADNSYTDNVVAATGNYKVRIDNATGAGSVADYKGNELIRVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 1906 - protein, 673 aa, Microscilla marina ATCC 23134
MYLSNTRGLKLSIIASAICTFTLSANANPQQSDYRANHSHKREKPMEVLVVTASGADKTLRDAPASVSVISGKELSQRFYKDLTDALTDAPGVIVTNGGDRQDISVRGMSSQYTLILVDGQRQTSRETRPNSDGPGVEGAWTPPLAAIERIEIIRGPMSSLYGSDAIGGVINIITKKTPQEWRSEVRVDSVVQERSDSGNSYQVNLFTSGSLIEDTLGLQVYGGYTRRLEDDIVDGYRGKKTDHATVKLAYTPTVDHEWLFEAGTNSQTIDATLGKTVAPLAAGESCGRRGCPESSTTEYDNQSYSIAHNGQWGLVGARSYLKRDEYDNNARQMYITNTDFQTVWNVPLTVEQPITLGAAYLKEELEDRTSNQISDRTQIDSSQWSLFAESTWSVAKYFELTTGLRYDDDEYFGDQWSPRVYGVYHLSRATTLKGGVSTGFRAPNLRQTTEDWGQVSRGGDIYGNPDLQAETSVNYELGLYTHFSRGVKSSVTVFYNEFDNKISRIACPATQCTGGPNQFGSMPTTYVNVDEAVTQGVEATFDARFSKAWKLSANYTFTDSEQKTGEYKGEPLTQLPKHLVQTSLNWKPSAAMNTWLRVHYRGEESQPTTGPSSGSLIAPSYTLTDLGINYFLTPDIKVGAGIYNLFDKQIGVEEYGYIEDGRRLWVSLGWTF

SEQ ID NO: 1907 - protein, 194 aa, Microscilla marina ATCC 23134
MINVLWSQMNVSKYVAIFSFVFIQLISVGKVFANADERMTTFRENIAQTWQQPEHYDLYIPAITWHARFAYDKEKTDRYNERPWGGGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 1908 - protein, 386 aa, Microscilla marina ATCC 23134
MKTPVRLVMMSGVLLTTAHAAQATEVTLYGLFDTSLTVVWNADAQGKNLVGLGNGNLLGNRFGVKGAEDLGGGLKAIFTLENGFNPNTGALGQGNRMFGRQAFVGLESARWGTLTLGRQYDALADVAWPITGDFYFGSVYATPGDVDNYDTSSRTDNAVKYTSPVVGGFQFVGMYALGGVAGKSGAGQTWSAGLSYNHGPFDAAGGYYYAANRASLANGVRTGWNGTSDGTFDGSLVNGGYLSAKSIGIARGALRYTFAPFTVGIDYSNAQYKADAMSAFRSTQKYDTARGFFNYQATASLLVGVGYSYTKARGDTSATYHQVSAGADYVLSKRTDLYAVGAWQRANGEQRTPDGGTQAAQASIGSYGYGGTRTQGILNLGLRHRF

SEQ ID NO: 1909 - protein, 809 aa, Microscilla marina ATCC 23134
MASLSVFVTAAAPAVAADQIGSVGIEDIVVTARRTEENIQTTPVAVTALSTEMIKQAQVGDVAGLQRTAPSLSIATGAPGGSGFVYISIRGMPALNPGVANDPSVATYVDGVYIPRPSQGSADLIDLQRVEVLRGPQGTLFGRNTTGGALNIVTVNPTGDFEGQFRIQGGNYDYRNIDAVLNVPLVGDELAARFVYDFVDHDGYARNVTSNSELKDRNSHYARAKLRWAPAGSNWSATLSGDYNIIKDHGQFVGLAAVNPGTSAAIGAINAATPLAAYLHNKAHWYNAYGIPFSTNPPVGSNYGFLTAGSRSAYNRLEAYGGNLTIDGEIGSVTVKSISAYRYSNAIGLNELDGTPAQILAAESAYKSDQYSQELQLSGELGDRFSYILGSYYSTESGRESSVAQTFGSFTPAAPAPNFGFSLNYGKVKNISVGLFGQGYYRLTDTIRLTGGVRWTWDKREVVLLNRTNLAANSCAPELLSNPDFIAPCSLPRSVKYDYPAWTAGIDVEITDGLFAYVKTSAASKAGGFNMRNGSAATPPFKPEKVRDVELGVKFSTSDNRLRINAAAFHSWQSEVQRNASDCITPPGALACTTTQFLRNSGNARVYGGELEISAVPWGGMLVSGNLALLEGKYVAGTFVEQQQFVPVAGANVSDCVAGTAAGSVRCSVVRSGEALPQMPKKQFGISVTQKLATSVGELSIHVNYAYIGRQNFGLFTADPRRPQAYRDAVAIANRINTISGYGLFNGRIALQIEDPNLELSVFGRNIGGKKYVTRAFADQLPTLGTAIDYIGDPFTWGIGATFRFGPKS

SEQ ID NO: 1910 - protein, 647 aa, Microscilla marina ATCC 23134
MIKFSATLLATLIAASVNAATVDLRIMETTDLHSNMMDFDYYKDTATEKFGLVRTASLINDARNEVKNSVLVDNGDLIQGSPLADYMSAKGLKAGDIHPVYKALNTLDYTVGTLGNHEFNYGLDYLKNALAGAKFPYVNANVIDARTKQPMFTPYLIKDTEVVDKDGKKQTLKIGYIGVVPPQIMGWDKANLSGKVTVNDITETVRKYVPEMREKGADVVVVLAHSGLSADPYKVMAENSVYYLSEIPGVNAIMFGHAHAVFPGKDFADIEGADIAKGTLNGVPAVMPGMWGDHLGVVDLQLSNDSGKWQVTQAKAEARPIYDIANKKSLAAEDSKLVETLKADHDATRQFVSKPIGKSADNMYSYLALVQDDPTVQVVNNAQKAYVEHYIQGDPDLAKLPVLSAAAPFKVGGRKNDPASYVEVEKGQLTFRNAADLYLYPNTLIVVKASGKEVKEWLECSAGQFNQIDPNSTKPQSLINWDGFRTYNFDVIDGVNYQIDVTQPARYDGECQMINANAERIKNLTFNGKPIDPNAMFLVATNNYRAYGGKFAGTGDSHIAFASPDENRSVLAAWIADESKRAGEIHPAADNNWRLAPIAGDKKLDIRFETSPSDKAAAFIKEKGQYPMNKVATDDIGFAIYQVDLSK

SEQ ID NO: 1911 - protein, 955 aa, Microscilla marina ATCC 23134
MIWFRPAVLLLLPLLLLPSLALANNTADEADVAFELGNEAYARGNYNEALSAYFTSYRLVPNRNVLFNIARCYEAQNRLNEAYRYYDDLSNEALSSDDAAEVRRSLERLRPRVALVRVTTIPEGAEVYIDRTDLGSRGRSPQTLALPPGRHKVMVKKEGYQPAEATVYLARGKPVSQEIELTLITGLVELTGTPEGAEVRNAPDGPVLTEVPGRLRLPPGQHLLYVRAPGHAPAQLVAEVTADATVKVPVALRTQEKPTGRLVVTANRDNASVRVDGQPVGFTPTVLTLPEGEHTLEVESLEVRPLRKQVTVVAEQEVKVHAELRYIPPPVRAASKGLLSVDEAPASTTVLSQEELRAFGWRTLAEALSGVRGFFLVDDRNYTHVGVRGFSPPGDLNTRLLILWDGHALNDVWAGQGYAAHDLSVDLEEVERIEVVRGPGSALYGTGAFFAVINVVPRESLGTRRAELTGAVGALGTTRVHATSGWDNGTGRSVLFSAAGMHARGADTTPLGTGVRVVGLDGERAGTASLRARLGHLTLMAQLHGRRKDIPTGASHTVIGAEGTQVQDVRGFAEARYERPLGARVSLSLRGSLDLSRYRGYWMYDEGVEGSPLTRDTDAGQAEWLSAEARVLLNLFAGNDLTLGLEGQHQLRIEQEVFGGEGLMPLNKRTLLSLYLLDEWRLHPRLSLSVGIRVDRYSDLDTTPFTPRLAFIGRPYAVGLTKLVVGRAFRAPNAYELFYEDRLVTQRPALQLDPETITTFELEHSHDLTDELRLTLAGYHNRISNLVTLELEQLGTPQCGAPTGTEQCLVYRNTSGETLAWGAEAGIHWQPGRYLLVDLSYSYVTLHNASDEVQSVSPAHIASGRLLLPLSGGELRLATQATYQSARKSSATGPSVGEAVLVSFGVSGDLARFRYFAGVQNLLDERYALPVSNEISTEPVPQYGRTFTLQLTGAF

SEQ ID NO: 1912 - protein, 1175 aa, Microscilla marina ATCC 23134
MLLLVFFLPLNLRGFAASAQNMNNTMISFSAKNMTLKQVLKVVEEKSNFLIGYDNVLDVKKRVTMTVESKSVYAVLKQLLRDYKGNVVQVDDSHVLIKVQKQEIAAAPVKVEEPVVNNNVQVLVSGTVTDTKNGALPGVTVVDETSGKKTGTDAEGKYSISVASGSKLSFNYIGYDKQTVTITNQKTVNIKLQESSNSLQEVVAIGYQKIRKSDVVGSISSVKASEMNLTAPTVGQALVGKVAGVQVSQTSGAPYAGTKIRVRGTSSLTAGSDPLYVVDGYPAGNNIFINPEDIETIDILKDAASSAIYGSRAAGGVVLITTKRGKDGKGKFSYDVQSGITQLGKKVKLLNGSQFAELVIDARNNAYKDFVVNGGKTWTDAMYSDDNATRIKNVGNGSSVSIPTDIYDFANQRLIAPTVDTDWQDELYRNAFFQRHNLSFSGGNDNMKYYLSGGYQDQDGIVRNTAMKALNFRANVDGNVSERLKVGANVAFTQTTNNEVGEGRFSPMMAALLYVPYLPARDANGNPIKYGMNAIANEFGIQGIENPLASVAETKSNRLGYRSTYNANATYQILDGLSFKTNLGAQLYQEKYDYYLPTSLSAGGGNPPYSNQSMLNANAIAQNKTELDKLAEFTLNYTKKFGKHDLNALAGYSAQQNTIDFTRINAKGFTSDNIGEISDRGAAADLLTIPNAFKVKTTLMSYFGRIGYNYAGKYFVTASLRTDGSSRFGPQNKWGTFPSVATGWSLSQEDWYNDFLGEGSSVKLRASWGLSGNNNIADYKAIQTVKSPGGVVFGSGTVGSGVLVGDMTDQTLGWESTSQYNFGTDITVFKNRLSFIFNYYLSRSYNLLYDQPVSSISGTANSTILTNLDDSKVQNKGFDFQVDGRIIQSNDFTLGLSGNISLNRNKVLNLSNGSTILVSGAERSYRTHITQEGQPIGMFYGFRVLGRITEDNLGKVAPSASSSNPAKVGDLYFEDVNGDGVVNDLDKTVIGTPYAKFTYGFAINAAYKSFDLRASFNGSYGNQVLDGQDYYLYNFEGSGNQYVEVADRYRSPSQPGSGLNYRASRAGTQSNNTRLSSFYLQSGSYLRMTNATIGYNFPKALSKKIKVENVRVFASVDNAFTITKYKGYNPDVDYSLGANLAPGATTNNGANMAPGVDYGNYPIARAYNLGIKLTF

SEQ ID NO: 1913 - protein, 455 aa, Microscilla marina ATCC 23134
MTKKIILLSMAASVSLFAQSELEELKALLAQQIKTTQALQKRVEDLEKKQTRVAAETTEKEQHVVQKEKKQATVKRKEPKLAKTEPSAEEEAYGETDDTVSSQQNTQTFDQKSFLPDIALILDGSAVGRNVNNSTYETQYIPGFTGYNPNEETEIPFNKNRGFNFNYAELALHSTVGPYFDADAIFHLQSDEFETEEAYITTRSMPYGLRAKMGKFRSEFGRINAIHQHAWKFTSQPLVFAALFGPEGVNDAGVQLQWVLPTDTYLMAGFEAMQGSNDVSFGDTEKNNLYIGYLKSGFDISDTSTLLAGASILHGKNDQGLDTDVYGADLTVKTTLDSYSSLTWQSELLYRNKTTVTDKEKQSGYYTQLYYQYNENWAGGIRYDSLFKNIATQPDDLDRISAVLEYKPFEFTKFRLQYAYDRSKAFGLDNDQRKNISEILLEFTVEAGAHGAHAF

SEQ ID NO: 1914 - protein, 684 aa, Microscilla marina ATCC 23134
MVGAQETFRAGGNDLIPTYLDGQVANGGRIGFLGQQDARNVPFNVIGYTSKLVEDQQARTLADVVRNDASVQNVRGYGNASQNFRIRGFNLDGDDISFGGLFGVLPRQVIDTSMVERVEVFKGPNVFVNGISPSGSGVGGMINLEPKRAGDTPLTRVSLDYTSASKVGGALDVGRRFGDDDQFGVRVNALHREGETAIHDQKERTTAVSTGLDYRGERARTSLDVGYQKQTVHGMRTDVGIGSATVIPEPPAATLNYGQQWVYTDMETTFGMLRSEYDLSQNWTVYGSIGASHNDETGQYGSPILTDNTGNAKISRLYVPYVSDSIAGLGGVRGHFDTGPITHKVNLGYASNYRKAKSAWNQSAAIDTNIYNPGVIPFPATVSGSDNQDPTLNSQVRASSISLSDTLSALDDKVQLVLGLRRQDLVIRNFNNGVPDSTNVQDAMKVTPVYGLLVKPWENVSLYANHIEALSPGRVAPWYTANAGNVTGIVHAKQNEVGVKFDNKRYGGTLALFEITRPAGAIDATTNIYTLSGEQRNRGVELNVFGEPVFGTRLLGSAVWLDPILTEAQNSQNNGNYAVGVARYQLVFGGEYDIKAVEGLTATGTVTRSGSQYANQENTLKLKPWTRLDLGMRYTMPLKDTNLIWRANLENVTNERYWESVEDTGTYMYQGNPRELKLSVSMDF

SEQ ID NO: 1915 - protein, 983 aa, Microscilla marina ATCC 23134
MATYAESVGAPVVETVLQQKAISGKVVDSKGESIIGANVMEKGTTNGTITDFDGKFSLNVSAKAILQVSYIGYKSQEIPVSQLKAGAVITLKEDTEVMDEVVVIGYGTQRKGDVTSAIASVKAEDFTVGKVGDAADLIKGKVAGLSIAKGSGDPNATSSIRLRGVISVNGSTTPLILIDGVEGDLSTVAPENIESIDVLKDASAAAIYGTRGANGVILITTKTGRREAHTTASYSGYVSASQFGKKLDFMTAEDVRAGKTNFTDKGYDTDWLDAISRTGFTHNHNFNITGGTKQTTYSADFTYRKEDGVIMNTYAEDIRMRFDVSHWMFNDMLKVNLNMVKKWHKNSATNATATDQSNIYRQAIARNPTAPIYNEDGTYNEDFNVSYYYNPVGMLEERLGNYTYEETRATGNITFEPIKGWQTNLMLATSRFGAHDKGYNTSDYYGNKLSEWTGYAYHTNSESYQNNLEITSKYDLNVGKHRMNAMVGYSYQYYKYEQNYANNYNFPTDFYQWYNLGIGQALKDGKAGMGSSAEDNTLIGFFARVSYAYDNRYNLLVSVRREGSSKFGADNKWGTFPSASLGWTISNEEFMEGLTWLNNLKLRAGFGITGVIPSSSYMSLTTYNYGSSYYYDNASGEWLPGLSVASNPNPDLKWEKSTEFNVGLDWSVLDDRLGGSIDVYNKKTTDLLFWYSVPTPPNLYNTTFANGGSVRNRGFEIAVNAVPVRTKDFEWKTVVTLSHNESKLLSLSNELYETESYMNVGGLGEPISTTTHRMEEGRPLGEFWGLKSVGVSENGLFLIEKPDGEVVEFTTAYATDDAYKQYLGNGLPKFYLGWNNTFTYKNWDLSMQFTSQLGFKILNEPRAYYENNSIAYNRLKSVEDAPYGGQYTLSSSQAQTFVSYYLEDGDFLKLTNLTIGYTFPIKKSNKYIKGVRAYLSGDNLFCITGYSGLDPELSNWYPTYAGIDARDKYPSIRSFTFGLNLTF

SEQ ID NO: 1916 - protein, 194 aa, Microscilla marina ATCC 23134
MNKVTKTAIAGLLALFAGNAAATDGEIVFDGEILKSACEINDSDKKIEVALGHYNAEQFRNIGERSPKIPFTIPLVNCPMTGWEHDNGNVEASFRLWLETRDNGTVPNFPNLAKVGSFAGIAATGVGIRIDDAESGNIMPLNAMGNDNTVYQIPAESNGIVNVDLIAYYVSTVVPSEITPGEADAIVNVTLDYR

SEQ ID NO: 1917 - protein, 905 aa, Microscilla marina ATCC 23134
MLYHHSYAEDAGRAGSEAQIQVLEDVHVKAKRVPKDKKVFTDARAVSTRQDVFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGAEYLERRKQRYFVQEGGLKFNSNSGKWERDFQRPYWKTKWYQKYNDPQELQKYIEGHDKSWRENLAPQYDITPIDPSSLKQQSAGNLFKLEYDGVFNKYTAQFRDLNTKIGSRKIINRNYQFNYGLSLNPYTNLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 1918 - protein, 906 aa, Microscilla marina ATCC 23134
MKKFYIKPLVAAIALTAAGQGYAQEASAENTLEEVVVTGFRGSLQSSLNTKRDSVGVVDAIYAEDIADFPDNNLAESLQRIPGVAISRAGGEGQQITVRGLGPDYTRIRINGMESMSSTGGTDAIGGNNRGRGFDFNTFSSDLFSNLIVSKTNSAEIEEGSLGATVDLKTARPMELDDFVLSVGGNLNYNDKSEKVDPKIAVMVSKQFSDTFGALLSVSYADRNITDEGNSTVRWATYPDVGSYRGITDPTLSPELARLEETEEDRRLFHPRIPRYDSYTHEITRTGVAATFQWLPTDATDIVLDVLYSKHDATRNEIFMQGIGNSTADYDDYNFTDYEIDGQTIVYAAISNANAQVENRFDELTTEFQQVTLSATHEFTDRLRMNVLLGNSSSEFSNPVQTTIIARANGVGMTWDYRGDSADTLLTWGEDAYDESSYTLSGIRQRPQGTNNEFTNLTADLEFDFNDSVTLKAGVTSKSFKFDTYQSRYATNEGAKGLTIAGNMYEYDSGLGDGRAWLVPDLDKFIDAGILSNSGDFALSPRTNDIYAVEEDTTSLFTQVDFNTQLGEMPLSGNFGFRFFSTDQASTGWFENSEGNDVQEWVEHSYDDILPALNLRLEPMEDVVFRFSVSEGITRGGLSSLRADQGVSVNGSSYTITGGNPFLEPTKATSYDAGIELYITDTSAMSMTVFKKEIGSHIQRLRDQKTPAELGIPASEVAAQCENAAQNPESCNVNAVFDRSVPLNGPGGDLHGFEWQLQGDFGAFGDAWANVGYIANYTYVKTELAYLNEFGAVDVVANLQNLSEVTKSATLYYENDVFSARIALVDRSDYLTDPRGRDSNNQHGTYGTSNVDFSSSYQFNDNLKFNFDISNLTNQGDDQWVDREDLRLSYYHETGTQVSLGAQYKF

SEQ ID NO: 1919 - protein, 839 aa, Microscilla marina ATCC 23134
  misc_feature (356)..(356): Xaa can be any naturally occurring amino acid
MRFFIYLIPILSRIPLAFINLKNIMIIILICIFILGNYTMYQKKPLMLLFCSTFVSPFVMGKTIETTNKNILPEIVVYGDNNKSLSSVKTLSSDEISKTPTSNGNITDYLRSNPHIRYENSDQNGFQRGEIKPENISINGADPNQSAYFVDNVNINNDLAIDSSIFDGAMQVVPGISHTQAYFFDATMLSKVEVQDSNISASLGGFMGGAVIAKTKQYSGTDSIKLKYRTTNSSWAKMEAGDSVQKILKLVRPDDVGVAELQPKYNKQTFNILAEKRLNDNLGMVFGYSRRTSSIEQNRLIGFDKDANNKAQLDKQNHQRLSDNLLLNFNWTPQEKERIEFGLRYSNYKELKYFKXNINNNVSDYHQALGATLAWVHSFNSGVWTNTLAYDRFQDKRKSSSNSVEITSVLDEYYEPLYNFEKGGYGNSQLIQDNLHFSTEYVMDPFYLASTEHSISVGGIYQATKYQFYRPQDVHSKIILSTLKSDGSMEEPPTSTENTTSKGRVKTSYQNIAIYAEDLIKWNKFELRPGIRIERDDYLKNNNIAPRFVARYHPWDNTGFTLGLNRYYGRSFASLKLANGILKLNNDSTRQHQNFSSLKSPYADELSLSFDQNMGNFALKLGYIHRDNKNRIILKREPIQGERKTSYINGHPFGVDIYTFQLNNIEPWKLGKTYWTTSLGFDWLNTKRADVSNEFNPNEPVYLDGKLMTRSQMLQQVNSSTEDWIARLGIDMTIPDYNITWSNKVYMKAPIRSYEELDGDNGDGISRFRSYHYGRHTQWDSSIRWQPTIRGKHSVYMQVDILNVLNKTRKNKVTTISTSDEYGVYTPGREFWLEVGYQF

SEQ ID NO: 1920 - protein, 1056 aa, Microscilla marina ATCC 23134
MKKVLFILLGCLLSFNVMAQVKAISGLVTDVTGEPVIGASVVEVGTTNGVITDLNGKFSLKVAPNSQFLVSYIGYKQQTIKVGSESTYNIVLKEDAEVLDEVVVVGYGSQKKVNVTGAVGMVSAEALEARPVANASQALQGVVPGLNLTVGNNGGALDGTLNMNIRGAGTIGDGSGSSPLVLIDGIEGDLNTVNPNDIESVSVLKDAASASIYGARASFGVILVTTKSGKSGKTNVSYSGSARFSDAIGVPDIMDSYTFAQYFNRASANKGGGDIFAPAVMERIKAYQEGTLKATTVDNGAGIWQKWANANGDTDWFEEFYDHWAPSQEHNLSINGGTDKTQYLISGSFLDQKGLMRHGKDKFQRYTLNGKITTAVTDWFKVTYSTKWTREDFERPSYLTGNFFHNLARKWPVHPAYDPNGFPMDEGEVEQMENGGKQNSQKDFYTNQLQLVFEPIKNWKINLDGSVRTTTQYQHWEVLPVYAYNVAGDPYYTVWDMGYGSYAAGSSRVNEYSWKENYYTTNIYSDYFKQFDNGHYFKVMAGFNAELYKTRNITAEKNTLITPGVPTINTATDDPQAYGGYADNSVAGFFARVNWSYKDRYMFEANGRYDGSSRFVGKERWGFFPSFSAGWNIAREPFMESFAEKINMGSLKLRASWGQLGNTNTNDAWYPFYQTMPVGSNYGWLVNGERPNYATNPGIVSSKKTWETVETWDVGLDWSFFNNRLSGSFDYFVRYTYDMIGPAPELSSLLGTSVPKINNSDMKSYGFELEVNWRDRIGEVSYGAKFVLSDDQQKILRYPNDSYDVGSYYKGEHLNDIWGLTTIGIAKSQEEMDAHLAKVDQSSVGTNWGVGDIMYADLDGDGKISNGTNKLGDTGDYRIIGNSTPRFKYGITLDAAWKGFDFSIFMQGIGKRDLWLDGCYFWGANGQGNEWQSTGFAEHWDFFRPEGDPLGANLNSYYPRVNFSGDRNTKVQTRYLQNGAYLRLKNVQLGYTLPRVWTEKAGISSVRVYVSGDNLATITSLSKIFDPEATGSLAGTGSGKLYPLQRVISVGVNVNF

SEQ ID NO: 1921 - protein, 707 aa, Microscilla marina ATCC 23134
MMKHLLTIVLCLTTLTGLAQEEKIKKSEWWNGNPSYAVPIREVNVTARRPMKEIGIQKTQLDTTILHENIALSMADILTFNTSIFVKQYGRATLSTVAFRGTSPSHTQVTWNGMRINSPMLGMTDFSMIPSYFIDDASLLHGTSSVNEAGGGLGGAVKLSTRPADADGFNLQYTQGVGSFSTFDEFLRLTYGNDRWQTSTRVVYSSSPNDFKYRNYDKNVLILDDDHNIIGSYYPIERNKSGAYHDFHALQEVYYNTGHGDRFGLQAWYVNSKRGLPMLSVDHKENDDYLNQQREQTLRSILSWDHLRKKWKVGVKAGYIHTWMAYDYERELGNGKMEKMIRSRSTINTFFGQVDGEYYLGEKWLFTATVSAHQHLVRSIDKNIIPMDNQQPTDPNGNKTKVPVGYDKGRIELSGYVSIRYRPTERLGLSIGLREEMFGSEWTPIIPAFFTDYLISKRGNLVAKASISRNYRFPSLNDLYFLPGGNPDLKKEHGFTYDAGLSFATGRDGVYTLRGEATWFDSYIDNWIVWLPTAKGFWTPKNVKEVHAYGVEVKAGLDVQLAKDWQLSADGNFSWTPSINHGDPVDWYDKAIGKQLVYIPEFSASVTGHLTYRSWRFTYKWCYYSERFTTSDNDMKTKIGRVKPYFMSDISLEKAFSFRWADLSLKGVINNLFNEEYQSVLSRPMPRLNYEIFLDIRPKWGKRNKKQ

SEQ ID NO: 1922 - protein, 398 aa, Microscilla marina ATCC 23134
MVLLAMSNNALSNDDIESFSEWIHNGNVGGTARSYYFEQDFDDSNTENSSIWVNGGNVTFNTSEFNGFKLGGEVQGSYVSNINDDDDTTAGDMNAQGLVLSEAFLKYQFGDTVFSGGRQHFSSPLIANSGSRLINESFEMYQVSSSHFDGTDISIGYVTKYQTRTDKSFYVDNEFVDFDFNGSGSPGDFYKIGNDGVFFVQVNKRIAKKFKVNSQYANVINEVQALYADVEYTLPTNFNSYIAMQYYKTKWDKNELVDNDLLGFKVGFSQGGVDFFAGYTLAGGNEGDNRVFRGIGQGAYYQFTATTKTAGVGAFESGTNSYQLGLGSAISNLKGKIFYTSFDNPIVGKDLNEWTVNLAYQFDGKLENIGISIDFSILDYENNQKDATDLRTKFTYSF

SEQ ID NO: 1923 - protein, 1023 aa, Microscilla marina ATCC 23134
MQFYQKTRENCVKTHVILKKASFYACLTLFAGMAFPMPLWASLSTAIVQQHVKQITGIVKDANGDPVIGANVVQVGSTNGTITDVDGKFTLNVSVGAKLKVSYIGYNDQQITVSNSNSYTIILKEDTESLDEVVVVGYGTQKKVNLTGSVATISSDKLVNRTSANVTNMLAGQMPGVTIIQNTGQPGADAGVLRVRGLGTMGDASAMVVVDGVESTMSSVDPNDIENISILKDAAASAIYGVRAANGVILITTKKGTKGRAIVSYDGYAGWQSASRMPNFLDSYNYAVLMNEAYTNDGLKGPYDETALQKFKDGSDPDFYPNSDWLGTLLSENGLFNNHHLSIKGGGDKVTYSLAFNYHDKDGLIVNTNYNKFNVRANIDAQINSRLKLTTNMAVYRSNMTAPAAGISNLMHYAFRETPVTPIQLSNGNYALFKNEHNSVAYAREGGTYKETNSNFQGNVGMELDIIDGLKLRGIAASTFNLTDNPTHVNTMTFYQAGSDTPVKKTTNSITEYDIKSMELNLQAYLDYNKTFGKHTVGALLGYSQIYKQTRYLQAYRKNLPNSNSLDQINAGEVTGQTTYGTEIEYALRSVFGRVNYSYDNRYLLEANLRYDGTSRFPKNNRFGAFPSFSIGWRISEEEFFKVDWVDNLKLRASWGLLGNQETVNSDNSSNYYPYQNTYLFGYDYSFGNTLTPGISISSPMANQDITWEKTDQWNVGVDAAFWSNKLTLGADWFRKETRDILLQLPVPNMMGVSAPMQNAGVVRNTGIELQLGHNNRINDWSYSIGANFSYVTTKIIDLKGGDTPGQSVGDPLWAYYGYVCDGIFQNEEEIKNHPTQSMGTPVPGDLKYRDLNGDKVVDSKDRQVLGSYFPKINFGLNLSVQYKDFDLSALLQGAADVKSAPVAEIRYAFYNGGKVTEQHLDRWTPENPNATYPRLSMSDSKNRVTSSFWMQDASYAKLRNLQVGYSLPKQLISKYGISRLRVYCSIDNLFMISGFDGVDPEAISGNYYPLTRNYSFGLNVTF

SEQ ID NO: 1924 - protein, 171 aa, Microscilla marina ATCC 23134
MKKLISIAVLSAAAASPAFAEGPYLGATYNSLGITDSRIGGVELDVDTLGVVGGYELSPNLAVEGRLLTGVDEENSGAFRAEVDSYIGANLLGKLPLNNQFSLYGTLGYGFLDANVSGPGFNTSDDDGALSYGGGVMYTAGSVNIRAGYEMLYDKDNIEADGLNLTATFAF

SEQ ID NO: 1925 - protein, 163 aa, Microscilla marina ATCC 23134
MKTPFSIIVFSLLLPVKALADNHNLSVGYQLSNMTNDTHGRRSNDDRLDGFNIKYRYEWGEPLGPIGSLSYMTANASSSWAVANKVQNDLRYSYSGFSLTAGPVWRFNDYVSVYGVIGINYDDYSSHFRKSTFKTGDAPATNYSRSELKKPHSPMAQAYKSTR

SEQ ID NO: 1926 - protein, 445 aa, Microscilla marina ATCC 23134
MKKLLLLLLIISPYLANAQEIVNDTIKKEVSIDSLKQSLDEHTMKFGDIDERLATIESDLSKLTKIKLSGYMQVQYDMYDFQDDKGPVLGSSAQAPVTNSFHIRRARLKFAYETIEGIKFVLQPDFAVDKVSLKDAYVVLNDRWFMQTYSLTFGQFNRINYDVEFSSGTREFLERSRMTTTLYPNERDLGAKLEANFMTKYEIPLKLQLAIFNGNFGQGAIANQVRDVDSNKDVMARATYSFQFPSKGLGIDIGAHGYFGSTKVLPQAVTNPVTPPAVFSDQNNNNFTPVVGTTLKKDWFGVEAQIYYDFLGGTSLKGEYISGTISGSSNPLQTYTAFGANKVRKFDGFYLSFTKNVGKHLQAAVRYDSFDPNSKLSGSNVTRADDLKYNTWTFAWQYFYDENVKIILGYTMPINEKSDLVAGDYATINKDKKDNIFSIRLQARF

SEQ ID NO: 1927 - protein, 1032 aa, Microscilla marina ATCC 23134
MRKYWLCSAAAVFIAGAAMAQTAPIDSVEEVVVTGSRIARAGFDTLEPATTLSVEQLQNRNATNVGEVLLQVPGFSMGQTTTGAQSEFSPGASYVDRFGLGSSRTLTLVNGRRFVSTNPPSTQNGQTPGNQVDLNVISPLMVERIENLAIGGAPTYGTDAIAGVVNIILRKKYDGAMANVQAGVTELGDNERIAFAGLIGRNFADGRGNIMLAASYDKSDPADYRKWQSPQNFFVGNPLATSAAANIPGRTPGNDGRINPNVPFNTGPADGIPNSVLIHDYTIPSVSRGGIILPVGTIQQANFYPTGFGANGQTLIQFGPNGDIVPFNPGSPFAPTFASGGDGYRNAIANVVAGTKRKTVNLNASYDVTDKISAFFEGSYFNGGGTLSNATPKYFSRIFGGSQVVMGPLLASINDPRLTPQAKATLQSLGVQNFEISKVTQEIGQAYPSTDNSVYRGVVGLSGQFAAVGRTFRFDASLNRGRTEGHAFKTSVIQQNFVNAMNVKLDASGKIVCDPNPTQLATGGAVKPIADAACVPLNLFGANQVTDAARAYVEARAEAKSQLDQTDVLVNFGSSNLFSLWGAEPVGFSVGLEYRKESGEFNPDPLQASGRTQEALVRPVAGEYTTKEVFGEVLVPLASPGQSIPLIDTLEFEGRIRYVDNSLTNGFTAYTYGGRYRPVPDIELRGNFTKSLRAPSIAELFTPASVGSGFFPDPCDVRNITSGPNPTVRQKNCAVFFKAYGITDPTSFFSTTVGVAIPIQLGGNPKLQNETAKSYTYGVVLRPRFLPKFQAAIDWNRILVNGNITALTSLDIAQGCYDDPDFNAANPDAGNAFCSLFRRTKGGPQNGQLVVDPQNPGLSNQFVNGASIRFQGLTVDAAYRDIPIKAAFVEGSLRIDARFYYLDKLCTSNNGVTTICLQGTHTQPRYTAQVDATYVQERFALNLQANYRPSTQYDLLFTEENQDVLKRGSQVLFNLGASYRLGENTQIRGAIQNLLDSSPPGPIAGFNNSFGNTTAVGDILGRRYSVAVTHTF

SEQ ID NO: 1928 - protein, 341 aa, Microscilla marina ATCC 23134
MLLLATMAFGQAKEDAGDGKMLDKQTMEFKDYLPEIHGTIRGKYEYQTETSESRFEVRNARFSVSGNVHPIVAYKAEIDLSDEGSIKMLDAYARVFPVKDLNFTIGQMRVPFTIDAHRSPHQQYFANRSFIAKQVGNVRDVGFTAGYTNKGGFPFILEGGLFNGSGLTNQKEWHKTLNYSIKAQLLPNKNWNLTLSTQMIKPENVRINMYDAGIYYQNDRFHIEAEYLYKMYGHEAFKDVHAVNSFINYDLPLKKVFNKISFLARYDMMTDHSDGKMDETTKALIINDYARHRVTGGITLSLSKAFIADLRLNFEKYFYKNSGVPKESERDKIVIEFMTRF

SEQ ID NO: 1929 - protein, 912 aa, Microscilla marina ATCC 23134
MQRIKKRIKEMSTKLDLGKIFFLILFLTLSVMTVMAGTIKGSITDKQTREPLTGATVQIVGTTQGAIADMDGNYSLNVTNGIYTLSIKYIGYKDIVVNNVKSGKADVVLNFELESDAQTLGEVSVVARKNLEGERALQMERRKATLAIENIGSKEMSIKGISNVEEGVKKITGISIADAGQLIVRGLGDRYSTTTLNGLPIASPNPDNKLIPLDLFPSSTIQNITVSKVYNAEAFADYSGAHIDISTKENIAEDFFSISFNTGGKFNTLGKDRYQMNRNGSLFKTSGVDQAALDMSLSDFDNYVKTRNIFDTSFAVKKKSTLPDFSSNLGFGKNISIDSQTLSILASVSAGNGYQNMDNAFYKTLEATGNVQDNFSYDSYAQELKLAALGYIGYTLRRHDRIGYTFFYTRNATDTYQRREGTDAEDHELTGSNNITHIYTLQNHQLNGLHSFGEQDRWELTWGGSYSKTGSEEPDRRQVMYIKNDDGTLGLFKLNRQETMRYFGSLDEKEWNGNLALRWKWNENNFLKLGFNYKNKSRDYKATRFYYNLNKINPTVTDIYDTDGFLNQENIADGNVTVQRVMQPKDSYRAGNEIYSGYLLTDFYPVPSLLVNLGVRYEISKQWVDYATDGGDWYAERRNLDKNDFFPTLNLKYTINDANSIRFSASRTITRPSFIEMAPFLYQESYGSAQIRGNDELQNGYNYNFDLRYERFGKNGDMISLTGYFKYLDSPIERIQALQGGATLHSFRNADNGMAAGVEVEFRKQLIKDLRLGANLSYMYTNVKLPEGGAYTNKERPLQGASPILANADLTYSPRFGEERQLNLALLYNLQGSRIHAVGVSNLGDIKQQTLHTLNFSAGYDLNRHFSLKLQVNDLLNRNVIFKQEVPSTGTEVEVERYKKGTDFEIGFSYKL

SEQ ID NO: 1930 - protein, 784 aa, Prochlorococcus marinus
MTKIWGRALGLGAVSYLVLVLHAPSPAIAQTAPAASSTLPAVTVDAPKQQAKRRATARRSSHSRTTARSATRGRGAEQAPPARAADGRGAPERANGPVNGYVANQSATATKTDSPILTTPQSISVVTQDQIAAQQAQSMNEALRYTPGVMTEIYGASSVSNDVKVRGFLAPRYLDGLRLPIDPMVTFAQTRIEPWNMERLEILKGPSSGLYGETSPGGLISMVSKRPTPYRQNQIELQTGSYGRAQGAFDFSGPIDANKEFLYRIVGLGRMSDTWIDYNTDERIFIAPSLTWRPTTDTNFTVLASYTRDNLKGQPQQYVPGVGTLYPSPLGRLPYSRYLGEPDYDRTKGESAMIGYSFDHRFNEMFQFRQNLRYSEVKSDVTSLRNETGDPSLSGGIIQRSANRVLADSKVFALDNQLQADFMTGPLVHKMLVGVDYLDAKSTAFFSSSMGFIPGVGIVGELYPLNAYAPVYGQVNPNAYLYPSLYQTSKQSQVGVYLQDEVKFDRFTLALTGRHDNWQADTVDHLAAGTVIRQDYSAWTGRAGLSYLFDNGISPYISYSTSFQPLVGFSRAGPQGVFKPTTGEGKEIGIKFQPPGTKALFTIAAFDIKQQNVLTADPVDPRFSVQTGEVTARGIEFDAKASLSNEIDVVGGYTYMEPKVTSSNSGDLGKDVVNVPRHYASLWGFYTFRSGPIAGFGLGAGVRYIGESFGDGANTVIIPGYGLMDASVSYDFGYLGRQYQGLKLQVNATNLFDKYYVSTCFTGLPYCGLGEPRRVLATLKYSWN

SEQ ID NO: 1931 - protein, 515 aa, Prochlorococcus marinus
MKLFQQLLVFPAALGLVAPLAANAAEVNMTDVSKYAAKTAKSIKAPSSAQFSDIVPGDWAYTSLKNLSASYGCVDNAYTQNLNSGLALTRYEAAALVNACLDNGLVASGEGLSSDASLLADEFGVEMAILKGRVDGLEYKLNELSAGQFSSTTKLNGKAAFVVGAVDYEDSADTAVDHGDKLTGTYSYRLDVNTSFNGNDRLYTRIITGNMDGNNPWGDKDGGTYLAVANDHEQVLEVDKLWYEWTKDDLKFWAGPKIENYYMLAASPSIYKPVQKQFALGGNTAAYASSTTAGFGVAWTQPTEADRKWTVSSNYASVGADDATKGILTDEQTKWLTQVTYGGKRWQIAAAYARHGCAGQDANSSCKAWSDYYSTAAGDNATGEGENAYSLRYWWRPAETGIMPSIQLGMDYRELDDAADTEVQSTAAWMVGLNWKDAWIDGNRAGIAFGSREHATDYAGSGDDEADDNLVWEAYYDYQLTDGITITPALFGGSHVYDGSNDDIFGALVQTVFKF

SEQ ID NO: 1932 - protein, 558 aa, Prochlorococcus marinus
MKLFKSILLIAACHAAQASAAIDINADPNLTGAAPLTGILNGQQSDTQNMSGFDNTPPPSPPVVMSRMFGAQLFNGTSADSGATVGFNPDYILNPGDSIQVRLWGAFTFDGALQVDPKGNIFLPNVGPVKVAGVSNSQLNALVTSKVKEVYQSNVNVYASLLQAQPVKVYVTGFVRNPGLYGGVTSDSLLNYLIKAGGVDPERGSYVDIVVKRGNRVRSNVNLYDFLLNGKLGLSQFADGDTIIVGPRQHTFSVQGDVFNSYDFEFRESSIPVTEALSWARPKPGATHITIMRKQGLQKRSEYYPISSAPGRMLQNGDTLIVSTDRYAGTIQVRVEGAHSGEHAMVLPYGSTMRAVLEKVRPNSMSQMNAVQLYRPSVAQRQKEMLNLSLQKLEEASLSAQSSTKEEASLRMQEAQLISRFVAKARTVVPKGEVILNESNIDSVLLEDGDVINIPEKTSLVMVHGEVLFPNAVSWQKGMTTEDYIEKCGGLTQKSGNARIIVIRQNGAAVNAEDVDSLKPGDEIMVLPKYESKNIEVTRGISTILYQLAVGAKVILSL

SEQ ID NO: 1933 - protein, 999 aa, Prochlorococcus marinus
MVILAQKTLTGCVVGEDGVPLAGATVLEIGTSNGTVTDMEGKFKLTVADNAMLRFSFMGYKTQEISVGGKTFLNITMVEDAVELDKIVVTALGIEKKEHSLSYAMSQIKNEELTRVKMPNLITSLTGKAAGVQINQVSSGLGASAKVSIRGIRSVAGENQPLYVIDGVPMLNSSSEQAFSAIGGTANAGNRDGGDGISNLNSEDIESISILKGAPAAALYGSQAGNGVILITTKKGKSQGQRSISFSTSLMFDKAVSLPEMQNRYGVSEIIDSWGERQNLPKNDNLKDFFSTGMASITSVSLSHGNEKLQNYFSYANTTGKGIIDKNRLSKHNLTFRETSTLFNDRLRLDGSVNLMRQVTKNKPTVGGFYMNPLVGLYRFPRGEDLTYYKDNFEVYDESRNLNIQNWHTSYDDFEQNPYWIVNRIQSKEVRLHAIVSLSASFKVNDWLTVQTRGNVDCINDKLRQKFYASTAPALAGTNGRYIEMDYQDIQFYGDLMLMMKKQWGDFSVNGALGTSLNDKTTNSTRYDSKTASLYYANVFNLANIIMNGSAALDQKIDARRQLQSLFATVQVGYKESAYIDLTARNDWASTLSHTKHEKRGYLYPSIGTSLILSRLFTLPEWVSYAKVRGAYSMVGNDIPPFMTYPLSHITAGGEYLANDAAPFKEMEPEMNYSWEAGAEARFLNSRIGFNLTFYKTNTRNQFFKLPTLAGDKYAYRYVNAGNILNRGWEIALDATPVLTKDFMWSTTLNFATNKNKIVALHEELKEFVYGPTSFSSSYAMKLVKGGSIGDIYGKAFVRDASGNIVYETEGSNAGLPKIEGDGNTVKVGNSNPKFQMGWNHTLSYKDISLYFLVDCRYGGKVLSQTQADMDLYGVSEVTAQARDEGYVMLEGHRIDNVKGFYKIVGGRAGTTEYYMYDATNIRLRELSLSYQLPASWMEKSKVLKKVQLSFIARNLFFFYKKAPFDPDLVLSTGNDNQGIDVYGMPTTRSWGFSLKCEF

SEQ ID NO: 1934 - protein, 452 aa, Prochlorococcus marinus
MKLFQKLIAVPAVISMSTGFAVNAAEINSIDLNSYSDSSKVASMSDFQSNEFFPGDWTYESLKELSTKTNNVDSSIFNGKSISRIQAAAVLNSVIQSDDLLAGGEGMMNGSMINRLSDELGSELAIMKGRVDGLEARVNEFEAGQFSETTTMSAGAGFLIGATDSASGQTGLNNNDTVQFEYILEVDFNTSFTGEDKLNIEIETGNGLTNVGADKVGLDWGSGNADVLKLDDINYSFPVGSWDMAVGHSMDASKTWPNACSMNNMVDNLGDCGAANSVDLSGDTSFSASTGFGDGFELGIGVSGGDGTGLFTEQSSDAYGLAVGYETDSYGFTAAYSDKDTASYYGLTAYYSPEGLPTTLSGGFEFGTPEGTGEDTTQWAFGISGDVGEGTLSANVGTNGQMKDSTTDVYAYDLSYEYPLNDSMSVTPFVYVSEVAGSDNTTGFGSFLSFSF

SEQ ID NO: 1935 - protein, 414 aa, Prochlorococcus marinus
MKLFQRLLVAPAALGLMAPLAANADVSPVSSESDLSSEIIQARVDGVEAQLGEVMAGQFSSSTKMSGKAAFITGYVDDDSESDTDSITMEYMYQLNLNTSFTGEDNLYTRIKTGNVSDHFGDSGQGTYLSAANKNGGTLKVDKLWYQFPVGDSLQVWVGPRIENYYMLASSASIYKPITKQFANGPNGSSYGSSTSPGFGVAWTQEVEDPSAARWAVSANYTAKDGADSSSDNGLFGEKTRNFVLTKIEYGSPQWQVSLATSFKENGANGYDGYYHSKLADHDGDITAYGLRGYWKPDETGAIPEIQVGYESASMDSPSAGQAEDTSGWMIGLGWKDLFVDGNRAGVAFGSRQAATGIKGSGSDPSEDNTVWEAYYEFKINDGVTVTPAVFGSTDVEAEGKDITGAVLLTEFRF

SEQ ID NO: 1936 - protein, 902 aa, Prochlorococcus marinus
MQLNSRLAKAIRFALATGAATAALSSPVVLAADDENVERIQVTGSRIQRSDMETATPVTVLSADEMANQGFTSIQDALESLTSSTSAMTTQSVHGFTPAASSISLRGAGANRTLTLINGKRLNQYPKPAGGTDNFVDTANLPMEAVQRIEILQSGGSAIYGADAVGGVINIILKKDFEGVAVKYRHGDTTNGGGGNDRVALSIGASSDRGNVSSFIEFTDNESLKATDRENFGLHTDKVPHSPFSQYSSYGARIAGTGDGARQLTAEECTAGGFLWDSARNICGFDRSAWRDLQPESTRFISSTIFNYELADDVSFVGRLDFAEAKSVTNIEPSAIDDYDIAVDGNQLTVSYGQVGADNYMSKVFDDKSTALNGDFANAEDGDYYYARRLHELGNRTTETKTSNYFFTAGLEGLIADEYNWDASVNYGRTSVDVFGGGNATVGGMFDYLTAGENGNSLLENMSPEDAEKASYSSFERAQSTQKNIQANITGSLFEMDAGDAMFAFGGEYTIQSYETDSDSESKNGNILGKGGSSGAGERKNWATYAELSIPVLDELTIDAALRYDHYDNFGGNLSPQIAVEYRPLRELLVRGSWSSVFRAPDMHRVYGDPTNGFNTVIDFKQCQAMGGTPGTSYPDENLNAICNELHIDTTTGANQDLEAETGYTANLGAVWGGDSFNASFDLWEWKLDDMVSDISASQAAREYELYEDMITRDDKGTITHINATAQNLAYQEVRGFDLTAGYDWDLNSFGELKLNFSGTYILNSEYQLTQSDPVEDDIENGGLPQYRANLILGYFIDDFEATLGAYHTARMHGSQYKSFKEAAEAAGDVFVEEDHEVASQTKWNLTTGYTFSDSIKVKAGIVNLFDAGPNFDPTATSWPHYPRSIYNARGREWFVEGEVKF

SEQ ID NO: 1937 - protein, 555 aa, Prochlorococcus marinus
MKLFQQLLVAPAALGLMAPMAANAADLDIKGVSDYSASSEQVTSISQFQDVYPTDWAYQALSNLIERYGCVAGYPSGSYLGNRAMTRFEAAALLNACLDRITEVTDELRRLLNEFEQELAILKGRVDGLEARVGELEATQFSTTTKLVGQTSFVLGAVNAGGDESLSDPYNEEVGAFTFTYDLRLGLNTSFTGKDLLYTRLRSGNMDSTAWEGEGLKGSLTALDTASATDDIVTIDRLYYRFPVGDEFTFIAGPLARNTEMLGIKPTAYGKSKVLDYFGGTMGTPGVYNKETGGAFGAIWKQKTSKGDPAFSASVSYVSDAGEANDGNPSTGGFITDNAEGNITGQLAYSSKRWGVALGYRYGQCGVKFRRGTDFVADNKWHQNCQQVVGFDADGDEVFDQRSGAYSNNFAVNAFWKPEDSGWIPSVSAGWGLSGLSGDFYDLADNDLEDDLEDQVADQFQSWMVGLQWSDVFIEGNYLGLAGGQPQFVTSLKGDETTYDGNYAFELWYKFQVTDNISITPAVFYLSRPMGQNTGDQYDNQFNVFGGVVQTTFKF

SEQ ID NO: 1938 - protein, 904 aa, Prochlorococcus marinus
MMRRDIMKYSTTLLPSAIAMSLAFAAQAQDSAGAQATDLDAVQVVGIRASLEKSLDTKRNNTGISEAITAEDIGKFPSTNVAEALSQIPGVTLDRRFGQGERVSIDGTDPSLNLSFLDGHPLAQAIWLYGEQPSRGFDYTLLAPQILGRAEILKSSEARLTEGSLGGTVLMHTRQPLDLKVNEVAASIGYSDSDQASQDKPNAALLYSWKNAAETFGIAVSAQHYEERVDRRGMEVFGYVPARTFANAAGGVPADADVPNSINAAWFQQDRERDSAVVNLQLTPSDALEFNLSGLYINENFDNYNQSMYSFLTWNPGTVAAVDQLGGVRNGVVTSGHSSANANANANANASANASANANANASPLGGTVIYDNNVRESEVTTKGLDLRGAFRGDVWGLNGQVGQSKSENNDLSQYFIEPFYNGGFSWDTRRGIRFDDPAAARDPANWGSAGGWFGNKGIFSTESKDTYGQLDFNLQFDGVFNQLLFGVRHGKHDERFELNVDGGVTPGKLADVGTIGLTDLQDFYPDHGQHVQAGRNNVLNWIRNSPIDDNAPDPASYLNNSWALEQTNNAAYAQLNFSGGGLRGNLGVRYVDSKTEGSGFVYSGTPSLANADSLWQTRTRKEDFLLPSLTLSYDTSDDWVFRFAAAKVIAWAPYNQMVNNTFLNDTTLTGSGGNAELSPYESWNFNLSAEYYFAQQAVVAWSLFYKKINNYIDTSASVERQYNALRDTAPQSWAQLVGSNGCTADGYCDYSIQRPRNAGDGKVKGFNISFQQPFGDSGFGLTANYTYAAGENNTGDALPYQSRNSIAFSPYYEKGPLNARLTYNWRDSYLAGGYVAGAAPASVDDYAELCASVGYAFSPNWSLQVDAQNLLDEQYLQYLGDKDHLTGRYRSGRRYMASLHLKF

SEQ ID NO: 1939 - protein, 531 aa, Prochlorococcus marinus
MKLFQQLLVAPAALGLMAPMAANAADLDIKGVSDYSASSEQVTSISQFQDVYPTDWAYQALSNLIERYGCVAGYPSGSYLGNRAMTRFEAAALLNACLDRITEVTDELRRLLNEFEQELAILKGRVDGLEARVGELEATQFSTTTKLVGQASFVLGANSFAGSLDDVRDIYNKEWGATSFNYDLELVLNTSFTGKDSLSTTLRAGNFGKTVFGGDGPTNLSTLEVASESETGADLVYIDKIFYQFPIGENFTATLGAIVGQEDMLAIWPTAYASDGSSTVLDVVTLPGASAGAFNKNLGQGAGIWWENNGWAISVNYVAANGRNGDPNSNDYLCGGIANDCSAGTGTAQIGYIDEQWGVAATYSYLQNNDLVLYSSMDVADSYGFTSGTDSYTNAFALSAYWMPQENGWIPSVSLGWGINSTSFEDDHDVYKGEVSQSQSWMVGLEWNDLFVEGNAGGFAIGQAPFATRLKGGGTPHDGNYVSELWYKFQVTNNIVVTPGLFYLSRPASGLMDTDETLNQLGGVLRTTFSF

SEQ ID NO: 1940 - protein, 123 aa, Wolbachia endosymbiont of Cotesia sesamiae
FNVGAGYADQDDQNEYMLAASYRMENLYFAGLFTDGELAKDVDYTGYELAAGYKLGQAAFTATYNNAETAKETSADNFAIDATYYFKPNFRSYISYQFNLLDSDKVGKVASEDELAIGLRYDF

SEQ ID NO: 1941 - protein, 542 aa, Vibrio vulnificus
FDQETIDNTPGATEIDDLLQLIPNMVDSGQGNSMPTVRGIDGSGPSIGGLASFAGTSPRLNMSIDGRSLTYLEIAFGPRSLWDMQEVEVYLGPQSYIQGRNASAGAIVMKTNDPTHHFESAVKAGVGELNYSQTAAMISAPVIQYELAFRLSFDQQKRDSFVDLASYEPAGDAKKIEMNSVRGKLLYEPSALAGFKTTLGVSHMDSRGPQSESTNVVGNEAFRPVYETKSLSTAWDISWQLNEVLTFENNLVYSKFAFDRYTNPLQKGDYTAEGKEFHVEPLLRYLSLGGRVNALVGARYYKSSQDDEYVDATSANPMSGSTKTQSAFAELTYALTQSIDVTVAGRYEKERVKRKVSDPRFKLDHDDTLSVLLPKFDIAFKPDMAQTFGFKVAKGYNSGGAGLAFNPILGGGFSPYQFEEEYIWNYEFYTRHRLGNSVELMTNTFYNDFDNMQMTQTLSNGDVLIANLYNAKTYGAEIGTRWYATDSLELFANLGLLKTEYKEVNGTSKELERAPNMTGNLGGQYSFFDGFELSANAAYTGD

SEQ ID NO: 1942 - protein, 543 aa, Vibrio vulnificus
FDQETIDNTPGATEIDDLLQLIPNMVDSGQGNSMPTVRGIDGSGPSTGGLASFAGTSPRLNMSIDGRSLTYSEIAFGPRSLWDMQQVEVYLGPQSYIQGRNASAGAIVMKTNDPTHHFESAVKAGIGERNYSQTAAMISAPIIQDELAFRLSFDQQKRDSFVDLASYEPAGDAKKIEMNSVRGKLLYEPSALAGFKTTLGVSHMDSRGPQSESTNVVGNEAFRPVYETKSLSTAWDISWQLNEVLTFENNLVYSKFAYDRYTNPTPRQKGDFTTEGKEFHVEPLLRYLSLDGRVNALVGARYYKSSQDDEYIDATSANPMSGSTKTQSAFAELTYALTQSIDVTVAGRYEKERVKRKVSDPRFKLDHDDTLSVFLPKFDIAFKPDMAQTFGFKVAKGYNAGGAGLAFNSIQFAGFSPYQFEDEYIWNYEFYTRHRLGNSVELMTNTFYNDFDNMQMTQTLSNGDVLIANLDNAKTYGAEIGTRWYATDSLELFANLGLLGTEYKEASGDSKDLPRAPSMTGNLGGQYSFFDGFELSANAAYTG

SEQ ID NO: 1943 - protein, 712 aa, Mesorhizobium sp. R88B
MSRLTVLAAACGLFATSATPPVLAADPAPPASTPIQRLPAVQVDAARVRGVDDFDLPASFTVVSADDDNRRGAQVSELLDGIPGLVARDRQNYAQDTQLSIRGFGARSTFGVRGVRLLVDGIPASMPDGQGQLSHFNVLGAERVEVLRGPFSALYGNSSGGVLQLWSADGAPNDPWRLRATYGSNATVDVGTQLLGQQGAVHYNLAANHFETDGVRDHSRAKRDSVNAKLGFDLAEGSRLDLVLNYLDAPDAQDPLGLTRAQFNADPAHATSVATQFNTRKSVRQSQAGAIFTQQFDNQALRLMAYDGQRSVEQFLAIPLAVQRNPLHSGGVIDLDSNYEGADARWAWQGEALGRPLQLTVGTNVDRQRQHRTGYENFVGDILGVKGALRRNQRDEVQNVDQFAQLWWQWSERWSALLGVRHSDVRFASDDHYTVGRNPDDSGQREYSATTPVAGIVFRADEDLRFYASLGRGFETPTFNELGYRSDGGAGLALDLGAATSRNVEVGSKWRAQSGAAVEFALFRADTDDELAVASNTNGRSTYRNIRATRRQGAELSWHQPIGATQQLQLAYTFVDATVRDGYLTCASSGCATPTVPVANGARLPGVPRQQLFARWQWQPAQWRFAAESVASGATVVNDLATERAPGDALVNLEASRRWTTTLGALRTFARVDNVLDRQYVGSVIVNDGNGRYYEPGPDRTYTVGLQWDFGG

SEQ ID NO: 1944 - protein, 392 aa, Aeromonas hydrophila
MKKTIKLALVAALALGATSAFATNGSNLIGVGAKARGMGGAGIGVAHGAESALANAALITSVENTEMSFGGTIFMPKVSFDNGGGAGSKDSKADMNVIPSVSIASKVNDNFYWGIGMWGTAGMGVDYRTEQANFKMVTNLQLMQFGVPLAYTMNNFSVALTPLLQYGALDIDYNTNGTTAGKFGTGVAQDLQFGYNLGLAYEIAGATIGATYKSQIDMNYNGVLSGAGTLFGLTLGDELSTPAEIGVGISYKMKEHTIAFDYKQIKWSDAKGYKDFKWDDQSVYVLGYEYATSGWAARAGYNYAKSPITDQGVANTAINTLNLLGFPGIVESHITIGGTFNASKTTSIDLAYVYSPEVSQTVTASNAPSPGTRETTVKHSQTALTVALNYAF

SEQ ID NO: 1945 - protein, 374 aa, Aeromonas hydrophila
MKKTILAIAIPALFASAANAAVVYDKDGTTFDVYGRVQANYYGDHNKAVGATDDAYKFDTKTGQSVFVPGTAASYQDVDGELVGSSRLGWSGKIALNNTWSGIAKTEWQVSAENSANKFDSRHIYVGFDGTQYGKIIFGQTDTAFYDVLEPTDIFNEWGDVGNFYDGRQEGQIIYSNTYGGFKGKLSYQTNDDKAVKVTDVGQGIKETAVYGPNVKRNYGYAAAAGYDFDFGLGLNAGYSYSDLESTTSSASGDKKEWALGAHYAINGFYFAGVYTQADLSYDHTTGGDKDKGRGYELAASYNVDAWTFLAGYNFTEGKAASNTAGAEYKDIVDETLLGVQYAFTSKLKAYTEYKIQGIDKMDDEWTVALQYNF

SEQ ID NO: 1946 - protein, 325 aa, Anaplasma marginale
PVAATADVTLYGAIKAGVQTYRSVGHWEGKVVSVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWHANSHNSQTEVAATAAYRFGNLTPRVSYAHGFKGSVRSADYDNTYDQVVVGAEYDFSKRTSALVSAGWLQEGKGADKIVST

SEQ ID NO: 1947 - protein, 283 aa, Anaplasma ovis
MNYRELFTGGLSAATVCACSLLVSGAVVASPMSHEVASEGSGVMGGSFYVSAAYSPAFPSVTSFDMRESSRETSYVRGYDKSVATIDVSAPANFSKSGYTFAFSKNLLTSFDGAVGYSLGGARVELEASYRRFTTLADGQYAKSGAESLAAITRDAVITENNYFVVKIDEITNTSVMLNGCYDVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLFS

SEQ ID NO: 1948 - protein, 282 aa, Anaplasma ovis
MNYRELFTGGLSAATVCACSLLVSGAVVASPMSHEVASEGGVMGGSFYVGAAYSPAFPSVTSFDMRESSKETSYVRGYGKSIATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 1949 - protein, 283 aa, Anaplasma ovis
MNYRELFTGGLSAATVCACSLLVSGAVVASPMSHEVASEGSGVMGGGFYVSAAYSPAFPSVTSFDMRESSRETSYVRGYDKSVATIDVSAPANFSKSGYTFAFSKNLLTSFDGAVGYSLGGARVELEASYRRFATLADGQYAKSGAESLAAITRDAAITENNYFVVKIDEITNTSVMLNGCYDVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLFS

SEQ ID NO: 1950 - protein, 283 aa, Anaplasma ovis
MNYRELFTGGLSAATVCACSLLVSGAVVASPMSHEVASEGSGVMGGSFYVSAAYSPAFPSVTSFDMRESSRETSYVRGYDKSVATIDVSAPANFSKSGYTFAFSKNLLTSFDGAVGYSLGGARVELEASYRRFATLADGQYAKSGAESLAAITRDAVITENNYFVVKIDEITNTSVMLNGCYDVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLFS

SEQ ID NO: 1951 - protein, 375 aa, Enterobacter aerogenes
MKVKVLSLLVPALLVAGAANAAEIYNKDGNKLDLYGKIDGLHYFSSDDSVDGDQTYMRIGVKGETQINDQLTGYGQWEYNVQANNTESSSDQAWTRLAFAGLKLGDAGSFDYGRNYGVVYDVTSWTDVLPEFGGDTYGSDNFLQSRANGVATYRNSDFFGLVDGLNFALQYQGKNGSVSGEDQTNNGRGFQKQNGEGFGTSVTYEIWDGISAGFAYSSSKRTDEQNNSTYFSKSYQRTYGVLGEGDHAETYTGGLKYDANNIYLATQYTQTYNATRTGDIGFANKAQNFEVVAQYQFDFGLRPSVAYLQSKGKDMGRYGDQDILKYVDLGATYYFNKNMSTYVDYKIHLLDDNKFTKDASISTDNVVALGLVYQF

SEQ ID NO: 1952 - protein, 179 aa, Wolbachia endosymbiont of Blattella sp.
LVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSA

SEQ ID NO: 1953 - protein, 189 aa, Wolbachia endosymbiont of Supella longipalpa
  misc_feature (5)..(5): Xaa can be any naturally occurring amino acid
  misc_feature (33)..(33): Xaa can be any naturally occurring amino acid
  misc_feature (69)..(69): Xaa can be any naturally occurring amino acid
  misc_feature (74)..(74): Xaa can be any naturally occurring amino acid
ETSYXIRLQYNGEFLPLFTKVDGITYKKDNSDXSPLKASFIAGGGAFGYKMDDIRVDVEGVYSYLNKNXVTDAXFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 1954 - protein, 784 aa, Vibrio cholerae 1587
MFVGARSLKSLLQIVDNSYQLHQYSCFIFDKDQIMQLKPLFTLLPFVLSSVVQAQENNEQAVDETVTVHGQSIPSDQRTRSDLDKVRGIANADIFSGITSVQSNNMHNEAGALDIGIRGVQGEGRVPIFIDGSLQSTHTSRGYQGVSDRTYIDTDLLSSLTVNKGATIDSSPYASGAVGGVVNATTLGIKDIIKDDQAFGVVLKARANNHNRTPDVSGDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASNSVLQNDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKRNLYLNVGTKFFHDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 1955 - protein, 331 aa, Vibrio cholerae 1587
MKKAAIAVAVLSAVVSGSTLAATVYDAEGTSLKVGGRLEFRGDFNGDDKGKEIEGTMLNKSRVRLNVAGETDIGAGMKGFGFWEAEQGVKSSAGTSTEQETTFKQRYMYVGMKGDFGSLSFGRQNTAGVQISDMSDIGTFTGDQKAFVSAGNEQINNTIAYGYDFESFKLKASYIADDEKNADGYGLSGIYSAPFGLDIGLGYAANDLGTDKGSADQIIAGLGYTMGDLYFGATYTTGDKDDKADTEFTGIEVSAQYKITKEFRLIAAYQNQEEETKNVTKDKADFFELTGRYDFTKNFRSYLAYKANGLDDKDAGYKVEDTIRLGLRYDF

SEQ ID NO: 1956 - protein, 344 aa, Vibrio cholerae 1587
MKKTLLALAVLAAAGSVNAAEILKSDAGTVDFYGQLRTELKFLEDKDPTIGSGSSRAGVDANYTVNDSLALQGKVEFALKDSGDMYVRNHILGVKTNFGKFSFGKQWTTSDDVYGADYSYFFGGTGLRYGTLSDALHDSQVKYVYEADSFWVKAGYGFPEDNAKQELAELYVGATFGDLAVHAGGGQNRDKAFKVGSNTVGTTTTDIKADVTNSYFEVTGEYTIGDALIGVTYYNAELDVENNPLVIDEDAISVAGTYKVADKTKLYAGYEYVMQEANTGADEDGTLVYLGVEYKFASWARVYAEYGYGDGTTLGYTNKGSDAEVKATKVDSANNFGIGARIYW

SEQ ID NO: 1957 - protein, 321 aa, Vibrio cholerae 1587
MKKLAAIISATLLFASSAAVAEVYVGGKVGKSWLDDACLAGQSCEDDDQVVGAFLGYQANKWLSLEAGYDYLGKFTAAGLNDEKVQAVTLAPKLSIPLTEGIALYGKVGGAYVDYGSKDDYSYLGAAGLEFNTNHNVTMRLEYQNLTDINNDIVRARAETATLGIAYKFGGSEEPAPVVEQRPAEPAPVATPVEKVAVTKTFTFQHLDSSTFATASAELKPATVQKLDKIVGYLNQYPQAKVEVVGHTDSTGSEAYNQKLSERRAQAVAKALEAQGIDASRISAKGLGESSPIASNATAEGREKNRRVELVIPEFQYQVTE

SEQ ID NO: 1958 - protein, 687 aa, Vibrio cholerae 1587
MAALCPARVSVAENKKFKLHTLSAVMMGLFTGSFAYAETQTTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNALIGARYYQSSQDDMYIDAASAYPMDGRTKAKSVFAEVTYALTPSIDVNLAGRFEREQVKRNVSHPRYKLDYDETSSVFLPKIDVAYTPVQGQTYGIKAAKGYNAGGAGLAFNSMQFTGFRPYEFEQESIWNYEFYTRHRFSHSVEVLTNLFYNDFDSMQMTQTTSSGDVFIANLDEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDKTTLYLSTNNTLDQLKQQPRMIGASVQLNF

SEQ ID NO: 1959 - protein, 412 aa, Vibrio cholerae 1587
MLYKSSLAVAISALIAGQVSAAGFQVAEHSASGLGRAFSGEAAVADNASVLARNPAAMMLFETAQFSGALSIVDPEVNVDDLSNNQSMKDVAPLQIVPAAYYIRPINDQWAWGLAMFTTYGVATDYPNEIYAGDLAGDTSLISVNLNPNIAYRVNQELSLGFGLDLVAAKAKLTRHKGGLAPFMGGGNPSDNLIGMTGETLALGWNIGALYELDEQNRIGFGYRSRVKLNFDDGEFSSYDSGIATSAVVPGQLKIELPAIWELSGFHQLNEQWAVHYSYQQTDWSSFEELTATSSQCKNGTCFQKIEQYQDNGRWSVGATYTLNTTWTLRAGLAFDEQAGKATLSIPDSDRFWYSAGLTYTLTPQLTMDAGFALVQSRKGSFTEKNQIGQNLQFESEAVAYISALQFNYRFH

SEQ ID NO: 1960 - protein, 693 aa, Vibrio cholerae 1587
MYKKSLLSSAIMLALVPSAYADDYASFDEVVVSTTRLNTQITDTAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDNNANNLLVKLQYQLNPKHRLEFSGNYIRNKNDLENLEFSGYKNASGTDETTQYQLGIKHIWDAEFSLADRITWQFDVVGKEETGITDRTSKSNGNIQKKDYLYSDKGFSFDSQLDKSFMVSNTEHYIVYGFSLSDKDIENTNQEFNSIGKNNVIFYIPNASEKRYGFFIQDEIAFDNLIVTPGIRFDSFETKPGDTSANPSLNDASEYKKYSDSALTARLGTVYKLNQENRLFAQISQGFRAPDFQELYYSFGNPAHGYVFKPNPNLEAEDSVSYELGWRYNADSVSNELSIFYSDYDNFIDSQIVSGSFKTRDAVHQSINIDKATIKGIELSNQFFWDRFMPIVGFSSRIAAAYTEGKDGNGKPLNSVSPWNAVTGINYDSENNWGTAVNLTYTAKKKASEINGDYQPISSATVIDVTAYYKPIKDLTLRAGVFNLTDEEYYNWNDVRGLPSEDKDKTQAKRNFGITAKYEF

SEQ ID NO: 1961 - protein, 419 aa, Vibrio cholerae 1587
MNNMRLFKKSLLAVTVTLATQQAFAAGFQLNAQSATGLGRAFAGDAVIADNAAVMSRNPAAMALFDEMALSLGFETITTMIDVKDAKYGTQAGTFPVADTDDVGGTSVAPNIHLIVPVNDQFAWGVNAYSNFGTKTEFSDNYLASEYGGLTDVKSFNLGLSGSYRLNEQLSFGAGLDLIYGQGTMKRVAGASFGSLKGASLINVDKADGWAVGFNLGTVYEMDENNRFGLSYRYSPEFKAKDDYGQEITLPLPDIAEFSGFHKIENTQFAVHYSVQWIGWSAFDKIDFKNLSATRSPIGAQLAAAQGGIYAKQYQWQDGWHYSIGGTYYLNSDWTLRAGYMYDTSAQDSVTSISVPDSDRQWLSAGFTYNIDDRSNIDFGFTYLMGEDVQVKESLSVSSVTATTHADAILLGLQYSRTF

SEQ ID NO: 1962 - protein, 659 aa, Vibrio cholerae 1587
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDNQQGSLTVYGQLSETVDAMVYGQGISRDNFEDGAGKETFGVKGDTYNVLAKVGFEPAVGHRFQVSYDVYRDQGDYSPRPDMAGSANLGLSKNRLVPTHYDRDTITGSYELKQDKHRGKVTLYSSQTEIDRDESVMAGVWPGNRLSRNTATNRNVGINALFQSDYELAAHRNQVSYGMDYVDQTSKATYGSTPFMEESAVSTAVFAENKLYVNDVWSLTAGLRFDDFKRKAMTGTKDFDEVTWSLGTEWDVTSDWTLFANARSLFKGPELLETFVRYQDQARLADNIKPETGLYTQGGVRFDKTYGDHFVGANFTLFKTQIDDHIRTSNSYLISNVGDMEIKGFELSTTYAYQAASAKLSYAHSDANDVTNGGPMLNSVGNSADMGDSIALSLGYQADSIDTLFGWTSIVVLDEDNVVAGAAKKEGYDVHNLYAQWTPYSVPNLVLTFGVDNVFDELYVSHASRVGLAKSFVADDYEPGRSYKLSAAYQF

SEQ ID NO: 1963 - protein, 718 aa, Vibrio cholerae 1587
MRKINTNKNDSQIYSRGFIMRNIRPSQLGQYIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPPGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPNYGNFTPIDESSAADRTITKEQASLYAQYQIKLDQQWIGLIGGRMDWVDTENESQKNMQRKSRSDAEFSFNAGLMYLASNGVSPYLSYSQSFDVLSTIDSATGELYKPLKGEQTEVGVKYQPEFYDGYINLAWFDITQQNALVTNPTTFVATQTGEMTAQGIEVESVGYITDSLKLTASYTFTDAKTDETGGKGTQQAGLIPKHQASAWLDYDAAQLGLQGWTFGSGVRYIGESKDNPRSSDRTVPSVTLVDLMAGYEITENWQAQLNINNLFDREFVSGCDYWCYYGQSRSAVLSANYRW

SEQ ID NO: 1964 - protein, 652 aa, Vibrio cholerae 1587
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDEIEHGYGDKSLRSLTSKLNYQLNPDHQLQLEAGVSAQDRENNVGKSAQSSGCRGTCSNTDNQYRRNHVAVSHQGDWQGVGQSDTYLQYEENTNKSREMSIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSGGGNIYGNPDLQPETSINKELSLMYSTGSGLAASLTAFHNDFKDKITRVACPANICTAGPNQWGATPTYRVNIDEAETYGAEATLSLPITESVELSSSYTYTHSEQKSGNFAGRPLLQLPKHLFNANLSWQTTDRLNSWANLNYRGKEMQPEGGASNDDFIAPSYTFIDTGVTYALTDTATIKAAVYNLFDQEVNYAEYGYVEDGRRYWLGLDIAF

SEQ ID NO: 1965 - protein, 217 aa, Vibrio cholerae 1587
MKQTICGLAVLAALSSAPVFAHQEGDFIVRAGIASVVPNDSSDKVLNTQSELAVNSNTQLGLTLGYMFTDNISFEVLAATPFSHKISTSGGELGSLGDIGETKHLPPTFMVQYYFGEANSTFRPYVGAGLNYTTFFDESFNGTGTNAGLSDLKLDDSWGLAANVGFDYMLNDSWFLNASVWYANIETTATYKAGADAKSTDVEINPWVFMIAGGYKF

SEQ ID NO: 1966 - protein, 713 aa, Vibrio cholerae 1587
MKLSPVSAAVLSVLAAGFAHAETEPSHYEEVVVTANRIEQPLSEVAGSVAVLEGETLEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFTHHYWLNDALRLKTHLEYFDDYAKRREGTSSIQKDDKWDLVSFYEYQRSQTRLASVGADYTANLSWMDTLEGKLYWRSTENITQTNRLMANDRSGAGILSYRRELRDEGFNDEALGATLNAQKEWQQGERLHQFAYGMSVDGHDYQRPKSIRRMESSGDDLQADEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFLIKPNNKLRAETSDSFELGSKYDNGQTQLYVAVFYSIFDNFIDVKQVGYDNATGSVIQQYQNIAGVKTYGAEMSVMHRLDDRWSVENKLGYVDGKDGENQYVRTLTPLEGSVQLNYQRERWDAYSRLNWASAMSRVPTCTTEQGKEAECATTTGWVSWDIGLNYQWNAQLSASFNVVNLLDREYTRYQDVAGVTPSDTLYSTEPGRYFTVHAKYVF

SEQ ID NO: 1967 - protein, 345 aa, Vibrio cholerae 1587
MDKMFKRTLLGAAVAIASTSVMAKEVGVNSDFNVDVYGVAAISLVNYNTTDNRDASSGYAVENESRIGFRAHKDMFENFTVTMQIESGYVDSTDWGHGGVSGGVLGFRDTYLGASGDWGNVRVGRVLTPLYEIVDWPFSNPGLGAAFDWGGIAAHYDRQSNQVRYDSPKFGGFTFAASVGRDDNNNGGGAATRDSSFAGANARYTIDTVTLMGGIESASDFGGTAGKDTFAYIVGFEAGLPGGFGIAAAFKGEEIEELGVKHTQDSFSVVGQYWNGPLGIKVGYAANLDSEKGGVDQDDANNIVSAQVMGVINGFVPYIRVAGRSDFTADKDTDIVTRVGLEYGF

SEQ ID NO: 1968 - protein, 350 aa, Vibrio cholerae 1587
MNKTLIALAVSAAAVATGAYAEGINQSGDKAGSTVYSAQGTSLEIGGRAEARLSMKDGKADDKSRVRLNFLGKAEINDSLYGVGFYEGEFTTADNDSGSDLDNRYTYAGIGGTFGEVTYGKNDGSLGVLTDFTDIMSYHGNSAADKIAVADRTDNMLAYKGQFADLGVKASYRFADRDTSTGEFADNKEDGYSLSAIYAFGDTGFNIGAGYADQNDNNEYMLAASYRLENFYVAGLFTDGEKNFDSNSNGNNSVVKGKFTGIQDYTGYELAAAYKLGQAAFTTTYNNAETANDTSANNVAIDATYYFKPNFRTYISYNFNLLDAGDKLGNSTVSKIDAEDELAIGLRYDF

SEQ ID NO: 1969 - protein, 610 aa, Vibrio cholerae 1587
MQKSALAIALASLLTPISYLHANEAQPQETVVVTANRFEQVESSVLSSVTVVSRQEIEAYQANSLTEVLRRVPGVEIAQNGGRGHSASVFIRGTNSNHVLVLVDGIRINSSAGGVALNRFPIGLVERLEVIRGPNAAVYGSDAIGGVINIITRSRRGDDAKQVSLGIGSLSSKKADVIAKADVEESGHFQVAAGFEQTDGYDIKNTGNGTQYGFDGQNLMAGYEHQLNEQWLGYFSASWFDSDAQYDESGSVKHGYSQNESFTGQLNFQGEQLKSLVSLNYQQTENLDYSLSEGKANASTKANITMTQLQWANLYQLTENAEVGAGVDARRESLADDAKNYGASHKLAGESRDTQGVFASGRVYVDSWTFESGVRYDKHDKYDHYTTWSLAAGYQLNDEHRIRAAYGTAFKAPTYSDLTTTPDLKPEESKNIEFGVSGVYSFASWNASVYDNKVDNLIIWYKPALSSGRWYSDNTDARIKGFEFDVNFNTGPVNHMLVAEFKDHKDDNGVQLSRRAKQNYKWISSLSFGQFDLNATYTYTGKRLDLPTATPKDEDYIPATNLWDMSVGYWVSQDMTLRGRIENVFNEQYESAIGYKAPERAYYFNVSYQF

SEQ ID NO: 1970 - protein, 296 aa, Vibrio cholerae 1587
MRFLSLLCPPVERAAVKRPPYTTHLQRVPLMRKSLLALSLLAATSAPVLAADYSDGDIHKNDYKWMQFNLMGAFDELPGKSSHDYLEMEFGGRSGIFDLYGYVDVFNLATNKSSDKVGDPKIFMKFAPRMSLDALTGVDMSFGPVQEVYVASLFEWDGTDFKTNAFSVNNQKIGLGSDVMVPWFGKVGLNLYGTYDGNRKDWNGFQISTNWFKPFYFFENGSFISYQGYIDYQFGLKDEYSTASNGGAMFNGIYWHSDRFAVGYGLKGYKDVYGIKDTDGFKSTGFGHYVAVTYKF

SEQ ID NO: 1971 - protein, 718 aa, Vibrio cholerae MAK 757
MRKINTNKNDSQIYSRGFIMHNIRPSQIGQYIRRALRLHFIPVVLVAAPSAMANTDQETQQLETLVVTASALKVETPAQETPKALSIVTQEDIVARAPQKLDEALRYTSGVTAQPYGADNDTDWLKVRGFDAATYQDGSRLFRDGYYTWLVEPYALERIEVLKGPASILYGEAPPGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPIYGNYTPIDESSAADRTITKEQASLYAQYQIKLDQQWIGLIGGRMDWVDTENESQKNAQRKSRSDAEFSFNAGLMYLASNGVSPYLSYSQSFDVLSTIDSATGELYKPLKGEQTEVGVKYQPEFYDGYINLAWFDITQQNALVTNPTTFVATQTGEMTAQGIEVESVGYVTDSLKLTASYTFTDAKTDETGGKGTQQAGLIPKHQASAWLDYDAAQLGLQGWTFGSGVRYIGESKDNPRSSDRTVPSVTLVDLMAGYEITENWQAQLNINNLFDREFVSGCDYWCYYGQSRSAVLSANYRW

SEQ ID NO: 1972 - protein, 652 aa, Vibrio cholerae MAK 757
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDEIEHGYGDKSLRSLTSKLNYQLNPDHQLQLEAGVSAQDRENNVGKSAQSSGCRGTCSNTDNQYRRNHIAVSHQGDWQDVGQSDTYLQYEENTNKSREMSIDNTVFKSTLVAPIGEHMLSFGMEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSGGGNIYGNPDLQPETSINKELSLMYSTGSGLAASLTAFHNDFKDKITRVACPANICTAGPNQWGAAPTYRVNIDEAETYGAEATLSLPITESVELSSSYTYTHSEQKSGNFAGRPLLQLPKHLFNANLSWQTTDRLNSWANLNYRGKEMQPEGGASNDDFIAPSYTFIDTGVTYALTDTATIKAAVYNLFDQEVNYAEYGYVEDGRRYWLGLDIAF

SEQ ID NO: 1973 - protein, 214 aa, Vibrio cholerae MAK 757
MKQTICGLAVLAALSSAPVFAHQEGDFIVRAGIASVVPNDSSDKILGSQSELAVNSNTQLGLTLGYMFTDNISFEVLAATPFSHKISTDLLGLGDIADTKHLPPTFMVQYYFGEANSTFRPYVGAGLNYTTFFDESFNGTGSSATLTDLKLDDSWGLAANAGVDYMLNDSWFLNASVWYANIETTATYKYDGAAQSTDVKINPWVFMIAGGYKF

SEQ ID NO: 1974 - protein, 368 aa, Vibrio cholerae MAK 757
MENHLQKTGNRTRNSHIKKRQWINMKKTLLALAVLAAAGSVNAAEILKSDAGTVDFYGQLRTELKFLEDKDPTIGSGSSRAGVDANYTVNDSLALQGKVEFALKDSGDMYVRNHILGVKTNFGKFSFGKQWTTSDDVYGADYSYFFGGTGLRYGTLSDALHDSQVKYVYEADSFWVKAGYGFPEDNAKQELAELYVGATFGDLAVHAGGGQNRDKAFKVGSNTVGTTTTDIKADVTNSYFEVTGEYTIGDALIGVTYYNAELDVENNPLVIDEDAISVAGTYKVADKTKLYAGYEYVMQEANTGADEDGTLVYLGVEYKFASWARVYAEYGYGDGTTLGYTNKGSDAEVKATKVDSANNFGIGARIYW

SEQ ID NO: 1975 - protein, 412 aa, Vibrio cholerae MZO-3
MLYKSSLAVAISALIAGQVSAAGFQVAEHSASGLGRAFSGEAAVADNASVLARNPAAMMLFETAQFSGALSIVDPEVNVDDLSNNQSMKDVAPLQIVPAAYYIRPINDQWAWGLAMFTTYGVATDYPNEIYAGDLAGDTSLISVNLNPNIAYRVNQELSLGFGLDLVAAKAKLTRHKGGLAPFMGGGNPSDNLIGMTGETLALGWNIGALYELDEQNRIGFGYRSRVKLNFDDGEFSSYDSGIATGAVVPGQLKIELPAIWELSGFHQLNDQWAVHYSYQQTDWSSFEELTATSSQCKNGTCFQKIEQYQDNGRWSVGATYTLNTTWTLRAGLAFDEQAGKATLSIPDSDRFWYSAGLTYTLTPQLTMDAGFALVQSRKGSFTEKNQIGQNLQFESEAVAYISALQFNYRFH

SEQ ID NO: 1976 - protein, 698 aa, Vibrio cholerae MZO-3
MQVVQMYKKSLLSSAIMLALVPSAYADDYASFDEVVVSTTRLNTQITDTAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDNNANNLLVKLQYQLNPKHRLEFSGNYIRNKNDLENLEFSGYKNASGTDETTQYQLGIKHIWDAEFSLADRITWQFDVLGKEETGITDRTSKSNGNIQKKDYLYSDKGFSFDSQLDKSFMVSNTEHYIVYGFSLSDKDIENTNQEFNSIGKNNVIFYMPNASEKRYGFFIQDEIAFDNLIVTPGVRFDSFETKPGDTSANPSLNDASEYKKYSDSALTARLGTVYKLNQENRLFAQISQGFRAPDFQELYYSFGNPAHGYVFKPTPNLEAEDSVSYELGWRYNADSVSNELSIFYSDYDNFIDSQIVSGSFKTRDAVYQSINIDKATIKGIELSNQFSWDRFMPIVGFSSRIAAAYTEGKDGNGKPLNSVSPWNAVTGINYDSENNWGTAVNLTYTAKKKASDINGDYQPISSATVIDVTAYYKPIKDLTLRAGVFNLTDEEYYNWNDVRGLPSEDKDKTQAKRNFGITAKYEF

SEQ ID NO: 1977 - protein, 718 aa, Vibrio cholerae MZO-3
MRKINTNKNDSQIYSRGFIMRNIRPSQIGQYIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPPGGVVNAVQKKPTDIPQGEVGLQVGNDALRTLALDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPIYGNFTPIDESSAADRTITKEQASLYAQYQIKLDQQWIGLIGGRMDWVDTENESQKNMQRKSRSDAEFSFNAGLMYLASNGVSPYLSYSQSFDVLSTIDSATGELYKPLKGEQTEVGVKYQPEFYDGYINLAWFDITQQNALVTNPTTFVATQTGEMTAQGIEVESVGYVTDSLKLTACYTFTDAKTDETGGKGTQQAGLIPKHQASAWLDYDAAQLGLQGWTFGSGVRYIGESKDNPRSSDRTVPSVTLVDLMAGYEITENWQAQLNINNLFDREFVSGCDYWCYYGQSRSAVLSANYRW

SEQ ID NO: 1978 - protein, 686 aa, Vibrio cholerae MZO-3
MVHLTFLRSLLLSTAFTVSAAHAADDDLSEMSLDELMAVEVTSVAKKPQSVSRTAAAIFVISENDIRTSGATTIPEVLRLVPGVEVAMIDDSTYAISIRGYNWRYANKLLVLVDGRAVYQPTLSGVFWDAQLLPVEDIERIEVIRGPGSTLYGANAVNGVINIVSKHSVDTLLQSTTLSGGLTESGEDFGRLYVRQGMRLSENAAARMWATVQKSAPLIASIVEEPVNEAALRGQLGFRVDWEPNEEDSFTLQGDGVFAEYDQSSTYNNPLIAPPGEIETISDSEHREFNFLSRWSRKTESGGQITLQSYFADLERDATNLIVKSRTFDLDFSHSITWNARWETIWGMSYRQINDDIDSNPQVVGVVSEGPSNNRSLYAGFIQGDVFGFDRKLRVSFGTKVEHNEFTGWEVQPSVRSIYTTDRSSYWAALSRAIRTPGIFERGIENSFTTAANPPAIPVPVDSTLTGGGDLSAEELIAIELGYRRQVTDRLTIDVTGFWNEYSDLMGFQTSEFSFVFAPIGPGGSPVPVRALNATNIISGGDETTKGVELHAEWTASDRATVNLIGNYLSRSESYDPLVLGSGSIEYNQGAGPEAQIGIKTDLSFTEKTNGSVWVRWVGETTGGLVAEDYTDLDLRLSHALTPQVSLTILGENLLDPSRLETVDLLYPTLWSENERRLSLQLSLRR

SEQ ID NO: 1979 - protein, 423 aa, Vibrio cholerae MZO-3
MKTNKTLLSCAVAFGLASVSTFTQAAGFQLAEYSATGLGRAYAGEAAMADNASAQWRNPAMLTYLEGTQISAGAIYVNPNVDVEGTVIHQQLGKTHASSNDFAHDAVIPNFYLSHQLNEQVALGFALGTNYGMETDLGTEFAASHFGNQASVISKEANLNIAYQILPQLSIGGGVRYVMGEGHFGATAPAKNALKLPQGTTLKYMEGEDNSWGWQVGSAWQINQNHRVGFAYKSEVVMDFEGHAEGVSYGSYKPGMMSVTLPATAELASFHQLNDQWAIHASINWTDWSSFKELTAVFPEKSDLIKSENWEDNYRFALGTTYQYDAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 1980 - protein, 713 aa, Vibrio cholerae MZO-3
MKLSPVAIALSPLMALTAAPAFAEVKDTTSPDTIAIERMIVTGSRVPERLDEVPSSVTLIDSKTLATEMSISSELQNMLATRVPGMSPATGTSSNAGQTLRGRKALILIDGVPQSTPLRNGSLDIRSIDMNAIERVEVIKGATSIYGNGAAGGIINYITKKPGADGAIGGVLGVSSRFSAVKFEDSVGSRVEGALNGSVGQLGYLISASRDDYGLQRDAEGDVPGLVYGLSETTTDNLFTKFHFNFDDEKSLQLTYNYFSSAQDARMVDVTGSVNSGQKTYAIEAGPDTLILGEPQGVDGNHNLMVKYEDLALFDNTRLAIDAYGQKIENVFFYSLTLANPEQGLDGGQSIIRSEKRGVRANFNSDFTLGDTELDLLYGIDYLQDVSSQPLVDGRMWVPEMDMQNLAFYLQAKWLFAEDWVLKAGVRRDQMAIEVDDYQTLRLCRTATQCSTPVAVKGGELEFDANTYNIGLRYKGSTVFSPFISFSQGADISDLGLLLRTATVDDLAKIQSQAALIDNYEAGFDGHWEAFSYSAAVFLSKSELGTRTVLNPASGIYEPVRAPQEIKGIELAASYDVNDELTLGANYSWMEGKDTDQDIYLDGQAITPPKFAAYLDWATTDNSSVSLTWLHVGDRKRFEPVNGQYSGSQGPVESYSLLNLAGNYRVDQLLFTLGVENLLNEDYYSARSQAFTFPGYNTKGLGTTVNMGLKWSF

SEQ ID NO: 1981 - protein, 680 aa, Vibrio cholerae MZO-3
MSHFTRSRTWVSLAVFAACAPAHAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTNKEETISSNSLSPRLGVVWTPVQEHALYASYSQTYSPVGGGVIGITPGDKHNHLDPEHSRLYETGVKSDWLEGRISTTLSVYRLEMYNRRMRDPNDQERIILTGLQRTDGIELSSRALLTDEFSLRGGIGLQDAKYVEADASEQGKRPTNVSRLNGELFVAYQSASDGWFGETGFVAVGDRYADRTNTTKLPGYARFDARLGYQWQAWRTQLSVENLLDKDYYLSATSSTQIQPGAPREFYLTASYQF

SEQ ID NO: 1982 - protein, 1787 aa, Vibrio cholerae MZO-3
MVRDDVDYQIFRDFAENKGKFFVGATDLSVKNKQGQNIGNALSNVPMIDFSVANVNRRTLTVIDPQYAVSVKHVKGDEISYYGHHNGHLDVSNDENEYRSVAQNDYEPNKNWHHGNQGRLEDYNMARLNKFVTEVAPIAPTSAGGGVETYKDKNRFSEFVRVGAGTQFEYNSRYNMTELSRAYRYAIAGTPYQDVNVTSNLNQEGLIGFGDNSKHHSPEKLKEVLSQNALTNYAVLGDSGSPLFAYDKQEKRWVFLGAYDYWAGYQKNSWQEWNIYKKEFADKIKQRDNAGTIKGYGEHHWKTTGTNSHIGSTAVRLANNERDANNGQNVTFEDNGTLVLDQNINQGAGGLFFKGDYTVKGANNDITWLGAGIDVADGKKVVWQVKNPNGDRLAKIGKGTLEINGTGVNQGQLKVGDGTVILNQQADADKKVQAFSQVGIVSGRGTLVLNSSNQINPDNLYFGFRGGRLDANGNDLTFEHIRNVDEGARIVNHNTGHASTITLTGKSLITDPKTISIHYIQNNDDDDDGYYYYRPRKPIPQGKDLYFKNYRYYALKSGGSVNAPMPENGQTENNDWVFMGYKQEEAQKNAMNHKNNQRISGFSGFFGEENGKGHNGALNLNFNGKSAQNRFLLTGGTNLNGKISVTQGNVLLSGRPTPHARDFVNKSSARKDAHFSKNNEVVFEDDWINRTFKATEIAVNQSASFSSGRNVSNITANITATDNAKVNLGYKNGDEVCVRSDYTGYVTCNTGNLSDKALNSFGATQINGNVNLNQNAALVLGKAALWGQIQGQGNSRVSLNQHSKWHLTGDSQVHNLSLADSHIHLNNASDAQSANKYHTLKINHLSGNGHFHYLTHLAKNLGDKVLVKESASGHYQLHVQDKTGEPNQEGLNLFDASSVQDRSRLSVSLANNHVDLGALRYTIKTENGITRLYNPYAENRRRVKPAPSPATNTASQAQKATQTDGAQIAKPQNIVVAPPSPQANQAEEAKRQQAKAEQVKRQQAEAERKSAELAKQKAEAEREARELATRQKAEQERSSAELARRHEKEREAAELSAKQKVEAEREAQALAVRRKAEAEEAKRQAAELARRHEKEREAAELSAKQRVGEEERRQTAQSQPQRRKRRAAPQDYMAASQDRPKRRGHRSVQQNNVEIAQAQAELARRQQEERKAAELLAKQRAEAEREAQALAARRKAEAEEAKRQAAELAHRQEAERKAAELSANQKAAAEAQALAARQQKALARQQEEARKAAELAVKQKAETERKTAELAKQRAAAEAAKRQQEARQTAELARRQEAERQAAELSAKQKAETDREAAESAKRKAEEEEHRQAAQSQPQRRKRRAAPQDYMAASQNRPKRRGRRSTLPAPPSPSFDSSAYAAPRALHNPDWYENDYEEIPLDALEDENVSESVDTSDKQPQDNTELHEKYENDYEEIPLDALEDEDVSESVDTSDKQPQDNTELHEKVETVSLQPRAAQPRAQAATQLQAQAAAQADAVSTNTNSALSDAMASTQSILLDTGASLTRHIAQKSRADAEKNSVWMSNTGYGRDYASAQYRRFSSKRTQTQIGIDRSLSENMQIGGVLTYSDSQHTFDQASGKNTFVQANLYGKYYLNDAWYVVGDIGAGSLRSRLQTQQKANFNRASIQTGLTLGNTLKINQFEIVPSAGIRYSRLSSADYKLGNDSVKVSSMSVKTLTAGLDFAYRFKVGNLTVKPLLSAAYFANYGKGGVNVGGNSFVYKADNQQQYSAGAALLYRNVTLNVNGSITKGKQLEKQKSGQIKIQIRF

SEQ ID NO: 1983 - protein, 1874 aa, Vibrio cholerae MZO-3
MGIYVYQPRNVQNTYTWYSTYAKVINAITGKIYLSGKESYGMRIAAKSEGQAEMTNKGLIELRNSPLSGGKDKADKSVAMIMKADDTVKHKVSIAENKINNEGTIKISGTVENSIGMYLDIASNMTNKKEIEISSKASDGNLNVGMRADQVQDKYTDSNYDTSVINAGTGKISLIGENSIGMIAANTSKWGSAKAKNLGEISITAGKRNIGMLSANEASVINETTGKINIGTSPNSVGMASIIQGSKVSKAENKGKINVTGANSTGVYNTGEFLMNTATAEINVAGRQSIGLYAKGNTPQTKTELKAGTVTASNSGVGLYADKSTVRLGGGTDPLNLIANNGGLLFYNYESNNKNNVANGVFNLAGNVKATVNNGGYAFYLKGTTINPDGTMTNLANFFNSMFDDKNSTGKLDVTLNSGGTLMVLDRPNGGNIRLSNVANTSSIVSSLGNRVNINSASTKYKVYAVYRGGLQIDQNVNLDNDSNSTNPDAFYKVDFRSSNMTLDSGKSMIGSKQGQVALFQGNYAETGDVGTVDKVKITNNGKISLSGNSGTKTTTAMAGDFVTLTNNKDIEVTGDRAVGMFGAGGSKVLNNTNGTITVGKEGVALYGINKLGTSTLGDQTISLTNKGTLKGINGKTKAFGIFAENTLAVNKSTLINSGTIDFSNSQESIGIHSVDSTVSNTGKINMGLKGVAINAKNSDITSSGDITLAGNGIAFNLGGSFTGRTLNFSSKVTLNGDGNAIFNLKDMTFSSSGSSLTENLNIASNGKSFSYFSMDNSVLTYDKNKTFAGNKVTLVSAKNSTVDWKANLVLSGEESVAFYLNGRRAVANPELTIAAGKTITLLGNKSVGAYGVNGARIINNGNITIGTNGAALYSTGATGTINNTGTLTLGKNSTGIYMKDGTGVNNSGEIVSTQEGAKGLVVSSNTAALYSNGGKIKLTGTGSIGIHAEGAAHSIISSADVEVGDTTGTNQSVAIHLKDGGEVRVLSHTSVKAGNNSIGIYGSTILATIENDAKVEVGDGGIGIYAKNGNVNLESGSKMTIGKTLGTNKEAVGVYYVGNGGTVNNNLSSFNIGKGSIGIVDAGTGASTINNNLTSVVLPGDAVYTYTSNTNSNVIGNTKITSSGNGNYGYYVAGNLTNNAAASINFANGTGNVGIYSAYRAGGTGIARNAATITVGKTDLENELYSIGMAAGYTDSKDTSKNRVGHVINTGTINVGFDNSIGMYASGVGSIAENDGTINITGKKAIGMYLENGATGINTVNGKITIESSAEGAIAAYSTGKNTIFKNYGTITLKAPSSKGIVTANDGQGTNLGAGNIDVQNGSAEATKNIEGTAGGDKRFGDKTLSVPKGGRTKSTITDADGKVLNPAEIDVTKVGNLSVTDPGQVAKNMKALQGHNDFSSVSRIGMYVDTSGVNYTNPIQGLEHLRGLKKADLIIGAEAAEYTNAKTISIGPNILKRYNEALAKTGLEKYDIISGSLTWAAATNGLTGTGAIKSVILTKVDYKEYAKKSTTPYNFLDGLEQRYDKNALDSREKRLFNRINSIGKNEAILLTQAFDEMLGQQYANVQQRVQATGDILDKEFDYLRDEWRTASKDSNKIKTFGTNGEYKTSTAGIKDYKYHAYGVAYVHESEDIKLGRGTGWYTGIVHNTFKFKDIGKSKEQMLQAKVGLLKSVPFDDNNSLNWTISGDIFVGRNKMHRKFLVVDEIFNAKSKYYTYGIGIKNEIGKEFRLSESFILRPYAALKLEYGRVSKIREKSGEVRLEVKHNDYFSVRPEIGAELGFKHYFGMKALKTTLGVAYENELGRVANAKNKARVGYTSAGWYNLRGEKEDRRGNVKFDLNVGIDNTRVGVTANVGYDTKGENLRGGLGLRVIF

SEQ ID NO: 1984 - protein, 659 aa, Vibrio cholerae MZO-3
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDNQQGSLTVYGQLSETVDAMVYGQGISRDNFEDGAGKETFGVKGDTYNVLAKVGFEPAAGHRFQVSYDVYRDQGDYSPRPDMAGSANLGLSKNRLVPTHYDRDTITGSYELKQDKHRGKVTLYSSQTEIDRDESVMAGVWPDNRLSRNTATNRNVGINALFQSDYELAAHRNQVSYGMDYVDQTSKATYGSTPFMEESAVSTAVFAENKLYVNDVWSVTAGLRFDDFKRKAMTGTKDFDEVTWSLGTEWDVTSDWTLFANARSLFKGPELLETFVRYQDKARLADNIKPETGLNTQGGVRFDKTYGDHFVGANFTLFKTQIDDHIRTSNSYLISNVGDMEIKGFELSTTYAYQAASAKLSYAHSDANDVTNGGPMLNSVGNSADMGDSIALSLGYQADSIDTLFGWTSIVVLDEDNVVAGAAKKEGYDVHNLYAQWTPYSVPNLVLTFGVDNVFDELYVSHASRVGLAKSFVADDYEPGRSYKLSAAYQF

SEQ ID NO: 1985 - protein, 331 aa, Vibrio cholerae MZO-3
MKKAAIAVAVLSAVVSGSTLAATVYDAEGTSLKVGGRLEFRGDFNGDDKGKEIEGTMLNKSRVRLNVAGETDIGAGMKGFGFWEAEQGVKSSAGTSTEQETTFKQRYMYVGMKGDFGSLSFGRQNTAGVQISDMSDIATFTGDQKAFISAGNEQINNTIAYGYDFESFKLKASYIADDEKNADGYGLSGIYSAPFGLDIGLGYAANDLGTDKGSADQIIAGLGYTMGDLYFGATYTTGDKNDKADTEFTGIEVSAQYKITKEFRLIAAYQNQEEETKNVTKDTADFFELTGRYDFTKNFRSYLAYKANGLDDKDAGYKVEDTIRLGLRYDF

SEQ ID NO: 1986 - protein, 652 aa, Vibrio cholerae MZO-3
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDAIEHGYGDKSLRSLTSKLNYQLNPDHQLQLEAGVSAQDRENNVGKSAQSSGCSGTCSNTDNQYRRNHVAVSHQGDWQDVGQSDTYLQYEENTNKSREMSIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSKGGNIYGNPDLKPETSVNKELSLMYSTGSGLAASLTAFHNDFKDKITRVACPTNICTDGANQWGAAPTYRVNIDEAETYGAEATLSLPITESVELSSSYTYTHSEQKSGNFAGRPLLQLPKHLFNANLSWQTTDRLNSWANLNYRGKEMQPEGGASNNDFIAPSYTFIDTGVTYALTDTATLKAAVYNLFDQEVNYAEYGYVEDGRRYWLGLDIAF

SEQ ID NO: 1987 - protein, 749 aa, Vibrio cholerae MZO-3
MGARNNLYLAVLLAISGGSFTVNPALAADSTTAATKAVTLKTVKVTADTEDDATENTNSYAAKKSRSASKLNLSLKETPQSVSVVTRQQMEQQGLISLDDILAATPGVYTTKLDSERSSYYARGFAITSRQIDGLPVGDNSPRFDNFFFDRIETIKGATGLMGSTGNPSATINMVRKRPTQEFRSTFAITAGSWDHRRLEADISAPMSESGHVRGRVMAARTEEDSYMDFYHEDSTAAMAMMEADFTPNTLVSVGVQYQKNAPTGSTWGAVPYWNKDGSLANLPRSFSLTTDWSSIKNNDLSLFAEVQHTFANEWLAKAVVSQSTSKSDWMAAYGGSGFPDPETGTGMSIWTGIWPYSTNEKFNLDLYATGPFELFGRTHELIVGYSGFTSENTSDNVDTNLQYSAQIADYRHWKGNLPKPTYAKNGSGSDNTTDIYGAYTTARFSLADPLQLIIGARLSAYDYDSQSWTATTPKTQTADPRSLDEVTPYVGLLYDINERFTAYASYTDMFQPSSRKDRQDNYLDPESGISYELGIKSDWNNGKLLTTAAAFWSEKDDLAVLDVEYNNAVKDAINNGADPQDFKVLTAYVASGQGLKIEGFEIEAIGLVNDTWNISLGYTYVNSISSAISSELTNIPQHQLKLHSSYTLPASLWQGAEKVTLGGKVRWQSDISNKWGGAPVNSIGDGVITQDAYYLADIFATYQFNDYLSANLNVDNLFDEKYYTNVGFYNGIFWGEPRNIKLTLRTRF

SEQ ID NO: 1988 - protein, 206 aa, Vibrio cholerae MZO-3
RARTDNYRTNWVQGTILNATSGFTQGTVGVSTEVAVYNALVLDRSKRDIKGGSNRTLADSDGDAVDQWSKLGLANVKFRVSNTTLTAGRQNFSSGIIDTIGNRALPSSFEGVSFNSEEFSNLSFQGGVFDRVSPRTEQSLSKFRTEYGNGRQETDKVNTLGVNYQPFKSLKTSLFAANVEDFWNQYYFGATHELGDSQTLSLTTGS

SEQ ID NO: 1989 - protein, 170 aa, Vibrio cholerae MZO-3
MKKTLLALALVGASTSAFADAWLYGGVSAGRADYNGNSDTPMGFHVGTGILPIIGIEGGYWKHGNFDGTSEGKKGYAELGSWYAALKPSIDIGPVQLYAKGGLHYYNADYKDGLSGSDSGTDFMYGVGAEYFVTDMLSVGASWQRFNGVKTKFDDKDLDSFTINATLHIF

SEQ ID NO: 1990 - protein, 611 aa, Vibrio cholerae MZO-3
MQKSALAIALASLLTPISYLHANEAQPQETVVVTANRFEQKASSTLADVEIITRQDIEQTQAKTLPELLRRLTGVQITQNGGRGQLASLFVRGTSSDQVLVLVDGIRFARAAKGAVDFNQIPLTYVDRIEYVRGARASLYGSEAIGGVINIITKARSQQQGTTVSAGLGSLDYQELSIASGVAIGEKGQMNVALGTESDKGYNVRPVPGVNDGDRHGFRSDNALLGYVHQFDESWSLFANARAYENIYQYDNSYGTRDYKEAEKDDLSFTIGTQYQSERWVSELQLTTQKQKSWDYTQSKGKYSDTSDNLEQRNIQWINRYLVNDVWTFAGGVDWRDESYIDKTADKEFDRSNTAAFAVVAAEWQQWLLEASLRFDDNQEYGSQTTHNIALGYQFIPEFGVKASYGSAFKAPNLYQQYDPSYGNVNLQPEDADSAELSFYGLFSGIKWSITGYDYKINNLIDYNSTTKNYQNVIGESNIKGVEFTAEFATGIVQHQLSVDLKDADDSKGKTLQRRAEHMYKWNALVAFEQVDWSIGYQYVGKRPDLDYNTYPTQNITLDAYSLVDTSVSYYVTDSTTISARIDNLLDKEYETANGYPAAERAYYLNIGYQF

SEQ ID NO: 1991 - protein, 363 aa, Burkholderia mallei
MKKHRRLAGTTAISASLAACAGLASGHALAQSSVTLYGIMDAGIEYVNHAAPDGGGAFRMKSGNKNTSRWGLRGVEDLGGGLKAVFRLESGIDLANGAFDDGPDSIFARRATVGLKGQWGELTLGRNFTPTYDYMLPFDPMGYAQNYSWATSSTATGGRKDGLFTRSSNAVRYDGAYGGLRFGAMYGFGNVPGSMKTSSKYDFALGYESGPFAAVVTFDRQNGAADSVTPADPVNYVQGIHAGVSYDFGRLKTMAGYRNYRRTYHTAAATQLSDMYWLGGSYDFTPAFSLTGALYHQNIKGGTDADPTLVSLRAQYALSKRTVLYAAGGFAIAKHGQNVSVSRDSVGYADTQLGVTVGMQQRF

SEQ ID NO: 1992 - protein, 856 aa, Burkholderia mallei
MRHRMDGIEQGTAGSGLRPQPRGAVLGGIKDAVARTSLFVVLVGAAMTIAPTALAQTDARPFDIPAQPLGAALIEFSQQSDVLIFFSPEVARDKMSRPLRGAIPVNVAIAALLRGSGLRAVPNPKGGYRVERIVPGRWRAADRSPDRELGSGASAGGASAAAPAGPSDIIVTAQKRAERLQDTPVPVTALDPRSLAERNLTRLQDYASEVPGLGLNPQGNGKTNIVIRGISTGVFSNPTVAVTIDDVPYGSSVALADGQLVQPDLDPADLRRIEILRGPQGTLYGASSLGGLIKYVTADPSLDAASGWVQASASVVRRGESGHGLLGAVNLPLSDEAALRINAYSRRTPGFVDNILTGRKDVNGIDVVGGRAGLLWEAAPAVTVRLGMLHQSSRSDGTARVTTDYHQQPLLGDLRQALPEGSGRYRTYSTLLTANIDVALGWSDLKSVTGYGHNVNREAGLFAAFGPDAQLSNHMRTRKFTQEFRLSSPTGRKLEWRIGGFYTRENSRSFQQIDTITPGTGGFVSNLLVAIFPTSYEEVAAFGDVTYHLSRPFSVQGGLRYSRNWQTYRETDTGPLGDVTPGVPFRASAQSNDDAVTFLIVPRYEVSRHLMAYVRFASGYRPGGPNGSAIVANLPETFGADTTLNYELGVKGDMAGGRLTFDLSAYHIDWRKVQVRIFDSATQFSYFTNGGRARSDGFEAMLQYRTPRGLRVALNGSYNLARYSRTPPAGIVAVKGDRLPFSPRFSGNVSVDRDMPIAPDWTATIGATIAYVGERQGMFPQRPGNLRIAWPGFVRMDLRAGVRSTRWAIGLFARNVTDRRGVLSSTSDTPASLTTSVYGTNFNPPRTFGLYLERTL

SEQ ID NO: 1993 - protein, 384 aa, Burkholderia mallei
MKNIRFACATAGVLAATAAHAQSSVTLYGLIDAGIMYTNNVASGNSHGGLVQATTGAVNGTRFGLRGTEDLGGGLKALFVLENGFNVENGKLGQDGRLFGRFAYVGLSDDRFGTLTIGRQYDSLVDFVAPLSATAGTFGDASFAHPFDNDNLNHSLRINNAIKYTSNTYAGLKFGGMYAMSNSTDFATNRAYSFGASYTRGPLNVAAGYLQINGSKGTTAGSPGAVDIVESAANGKGGFSLGADRMRSYGGGLNYAFGPATLGFVYTRAEYENTASFGSTGGTVRFDNYELNGKYQLTPAFSVGGAYTYTNGHVENTVKYGSDPKWHQVDLMAVYRLSVRTDVYLEGMYQHASGRNYVAMINTAGGASSTGNQVVAAVGLRTRF

SEQ ID NO: 1994 - protein, 365 aa, Burkholderia mallei
MKRKSLAMAVAGIGIGAAVPPALAQSSVTLYGIVDSGITYTNNQKGHSAWKATSGNEQAARWGLVGREDLGGGTSAIFRLENGFDIENGTASQGGRLFGRRTYIGLANDRWGAFTMGRQYNAVQETLAPLHIATVLGRYAHHPFDADDLDSTFRTNNSVQYQTPDWGGVRAIATYGFSNSTSFARNRTWSVGASYARGPLQLAAAYVRVDYPAIDATGAIASDNYYGFVKGVARQQIWGAGGAYAWGDATFGLLYTSALFSLQTGGAERFNNFEGSVRYRVTPAVQVALGETYTQVLASHAAAHDAHYLQTSAGIQYFLSKRTDVYLNVSYQRASSNAVAWIKGLDGASSTRTQIVAVTGIRHKF

SEQ ID NO: 1995 - protein, 767 aa, Burkholderia mallei
MARRPLRAALFGAFGLYAAAARAAGPASEPAAAAPPAAASAASAASTSQVRHAAIAAARKDAPALDPITVTATRTASAASRTAASVLVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 1996 - protein, 751 aa, Burkholderia mallei
MAPAATRAPSRRIDALPHGPSCALILIRYIVSCSSRDSARDSVHPDHTTPITAMDDHRRIAPPFARRLHPLSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGKLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 1997 - protein, 386 aa, Burkholderia mallei
MKKLALSTLSLALLGAAGAAQAQSSVTLYGVIDTSITYVHGNAGQGNNSWSMGSGNLQGSRFGLKGSEDLGGGLKAIFQLENGFNSASGALGQGGRMFGRQAFVGLQSDQYGTLTLGRQYDPLVDLVQAVTADNYFGSVFATPGDVDNNDNSLRVSNAIKYTSPVFAGLQFEGMYALGGVAGSTGKGQTWAAAAAYNNGPLGVAAGYFHANNASALTAGKRSGWTGTSDAIFDGDSGTTFINNAFTSSTSIGIAQVAAQYAFGPVTVGAGYSNAQYKADGASTFGTNQKYNTGRGFVTYQASAPLLLGLGYIYTKGSGDNNAKYHQVSLGADYSLSKRTDVYLVGAYQHASGHNADGSDAQASIGSYGIAGKSSQEIVALGLRHKF

SEQ ID NO: 1998 - protein, 135 aa, Burkholderia mallei
MAGIGIGAAVPPALAQSSVALYGIVDSGITCSRNQKGRSAWPATSGNEQGARLGARRARGSRRRHERAVQPADGRRRALRPFRGQRADRVTRAAPVALGGTYTQVLASHAAAHDAHYLQTSAGPGISCRSVPMSI

SEQ ID NO: 1999 - protein, 753 aa, Burkholderia mallei
MKVRPLRPLCNLEQRKMEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAADNSLTVPSYTLFDAALHYELRNWRFALNATNLFNRRYVAGCQSDAVCMYGNQRTVIATAKYNW

SEQ ID NO: 2000 - protein, 386 aa, Burkholderia mallei
MKKSLLALVALSAFAGAAHAQSSVTLYGIIDEGFNINTNAGGKHLYNLSSGVMQGSRWGLRGTEDLGGGLKALFVLENGFDVNSGKLNQGGLEFGRQAYVGLSSGFGTVTLGCQYDSVVDFVGPLEAGDQWGGYIAAHPGDLDNFNNAYRVNNAVKFTSANYGGFTFGGLYSFGGVAGDFSRNQTWSLGAGYTNGPLVLGVGYLNARTPSTAGGLFGNNTTSSTPAAVTTPVYAGYASAHTYQVIGAGGAYSFGAATVGITYSNIKFMNFASTVFPNQTATFNNAEINFKYQLTPTLLAGAAYDYTQGSKIAGSSAAKYHQGSVGVDYFLSKRTDVYAIGVYQHASGNVIEADGNTVGPATAAINGLTPSSNRNQFAARVGIRHKF

SEQ ID NO: 2001 - protein, 756 aa, Burkholderia mallei
MSRAPHAPSRRRAFGRGFAAAARAAHGAPVAHGAHACFAAASRRATAVERCVTALACAVTASGALAAEAEPADAARGPHRELPTVRVTSDGVHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGARLSYRFYLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDADLVLYARNLANRTYAASTLNGGAQWLLGPSRSAELVATLRF

SEQ ID NO: 2002 - protein, 610 aa, Burkholderia mallei
MTIGSKTKLALGIALAMPAAAWAYTFYALGDSLTDNGRVVRLTGILPNATSTIFRGGRSSNGPVWAEYLPGLIGARFAPDDDYAINGALSGHGGYLNIIPTRPTWRTLPGFVDQVEQLIAAHPRLRRDDLVGVWIGTNDQDLTKASLNGIEPFLGVPRPANIAEMSAYTLTNLNAQLQRLIGAGARQFVILNLNDAGGTRPGYVDYNGKLPEDLARFSRQGVNVHLFDVSALLNQMRRNPSAYGLNDTPDVQCRYVPSCSGGSIELQNTYLAADGTHMMTSVHEYIARYLANQLNAPAAISTAPVLGLDVARAGALSALNAADGGPLGPARVAWSDRLSLFADVGYTRNFHGAAGGMNAFDSDVEMFSIGADYKLSEASRAGALLSSGNANGSLAGGQGRIGLHAYRLGVYHAFERAGLFVRAYAGAGWSRYRLDRAAVLPGAVRASTSGFDFGALVKAGYLFALGGVRLGPVADVGYTQLVARGYTEDGDPILAQNVGVQRLKGVSAGAGVRFAAPLAAIGLRAGELSAEAQLRHDAFGDRTLVTAQRYAPGLPIGTAVDGASATYERLSVALTVNPAKRWRGKLVVQTDLGTAQRRSYTLLALLGGTF

SEQ ID NO: 2003 - protein, 320 aa, Methylibium petroleiphilum
MKKLAAVISETLLMASAAQAEVYVGGKMGKSWMEDACVAGQACDKDDSTLGAFVGYEMNKYFAVEAGFDNIGDFNQTSFSGHVEAITLAPKFSLPITEDIALYGKVGGAYVMFDGKDDYSYLGAAGLEFNLSQNVTARAEYQTLTDISNDVTRATGNTATLGVSFKFGGNDEPVIVEEPVVVEEVVVEEVVEEPVVVTKTFETQTIGTGSFDLNSTTLKPESAAKLDNLVAFLNEHPQANVEVVGYTDTSGPAAYNLKVSEKRAESVANALVEKGIDSSRIQARGEGENNPIASNDTREGRQQNRRVEVVVPEFEYQVQQ

SEQ ID NO: 2004 - protein, 728 aa, Methylibium petroleiphilum
MFTKDLPYAHVFHLVRHFLNWLLFMKIISARQATLSLLWVPIVLAPAVALAAQEQTMIVSATPQTVSELDTPAAISVVNGDDMRQAAPRINLSESLGSVPGLQIQNRQNYAQDLQLSMRGFGARSTFGVRGIRMYVDGIPATMPDGQGQTSNIDLSSIESVEVLRGPFSALYGNASGGVINIATQTGQQPPTIEASSYYGSYGTWRYGMKATGAMGDGTHAGDVDYTVSTTRFTTKGYRDHSGARKNLANAKLGVRVDDASKLTLIFNSVDMKANDPGGLDYQEWRDNPRQSPRGDQYNTRKTIKQTQAGLRYDRQLSELDDLSVMAYAGEREMTQYQSIPYQPQLRPTHSGGVIDMQRHYQGIDTRWTHRGELLVPVTITTGLNYENMREDRRGYENFVMRDGVPDYGVKGDKRRDERNLMWNVDPYLQTSWQLTQKLSLDAGVRYSSVWFDSNDRYVQGANGDDSGEASYHKWLPAGSLKYSVTDAWNLYTAAGRGFETPTINELSYRSGNQSGLNFALKPSTNNTYEVGSKTRVGNGLLTAALFRTDTDDEIVVDASSGGRTSYKNAGKTRRQGVEVSLDQQFAENWKLKMAWTYLDATYRTNVCSDGDCNGNRMPGIARNMGYASFGWQPEEGWYAGSDIRYMSDIMADDENSAKAPSYTLVGLNTGYKFNYGNWGMDVFGRVDNLFDKEYVGSVIVNESNGRYYEPAPGRNYGVGMSVSYRFE

SEQ ID NO: 2005 - protein, 402 aa, Methylibium petroleiphilum
MNRLGILVLSATTGFVSGAAWAENSVTLYGIVDAGIQYNSDVAVAQNIGAAGRPVNYASKGRLGFQSGADYGDRWGLKGVEDLGDGYTAIFQLENWFNIGNGALNVSSSTLWGRQGYMGLNSTRYGTLTFGRQYDVTNDLVEYYGPDSAGGIGTYPGDLSNFDGSIRINNSIKYRTPTIDHLTGEIVYGFGGVAGSAWRNSTLSVGANYVAGPVAVGAAYMRMDNSGATGNTWSSASADSNFGSSVTAGFAGARAVQTANAIAAYTFGTLMLGVNYGYTQYRPSALSSFHQVVAYNSAGIAMRYQYSTTMSFALSPTYTRGQSVGDGKARPWYASIAGVGFYNLSKRTSFYLYGGYQRAGGDTFDAFGNLVAATPSLGDAANGSSSGSRNQALIRIGMFNKF

SEQ ID NO: 2006 - protein, 623 aa, Methylibium petroleiphilum
MKKFACATILCTPTFLLAAERDDALKLPDVLISASRQVESRTATSAANTVFTRTDIDRLQPTSVTDLLSRVPGVQVAPTGGRGSLPGIFIRGTKAAQSLVLVDGVRIANATSGDSGLQFLDIDQIERIEVLRGSRSAVYGSDAIGGVIQIFTRRSSGPGLQPRLRMAAGSNQTFQRSLGLSGGNDTTRFNLGASLDETAGIDSTGPSFASDGDHDAYRNKALNLSLSHTFGERFEAGLNVLDSRGRSEYDNPFGGFDPVTFESFGQQPYTDFSVSSLGSYVDVQVTETWHSRLELAHGENRDDKRDKLSAERFVFNTYRDQATWQNDLALGEQNTILIGGDWYEDRVHGSTDFTEDSRWNRAVFAQHRYQGEQISTELGVRHDRNQQFGGQTTWSGSLTVPLNAHNDVLLSYSEGFRAPTFNDLYYPQFSNPNLDPEHSRSYELQWRSQLTAESRLEVSLYRTDLRDAIIFGQDSIPRNVASARINGVEMALAQQWGAWHSQLGLALIDPRDRDTGHTLARRARRTLSLDLDREFGRFSVGASWQAVSSSYDDEANRNRIGGYGLLGLRGSWAASDELKLEAKLDNLLDRSYSRALYSYEGAYHPYREEGRTVLFSVTWTPAL

SEQ ID NO: 2007 - protein, 728 aa, Methylibium petroleiphilum
MSSALRDRLRYGLAAFLAGTAALGSSGAAWTQEAVTLETLSVEGSGRGGSGPGGAGTESAFGPVPGYVAQRSATGTKTDTALKETPQSISVVGEQQVREQAATSVQEALRYTAGVAAEAYGPSTRGDYPRIRGSDAAIFLDGLRLKDPDVFNEPRPDPYTLSRFEVLRGPASTLYGSSPVGGLINLVSKRPLDVPYTEAGVRFGNYGWKEAFTDSTGRLTEDGQFLYRFVGVGRLADAQTDFVANDRYVINPSVTWRPSADTSWTLIGLHQKDAFGASDAFLPREGSLYAGPNGFIPLSRFTGDPNFNRYETETSSITSLFEHRFDDSLILRQNLRYSHIDGTYQSAYGNVYTLTPSADLPNAPFLDPARRTVDRFTYRVSSVKDRIATDTNLQGRFDTGPISHTVLGGVDFRQQWDSTRTGFGTDPRPFDLYAPVYVGVTPPDLGVPTALSQSQTGLYLQDQIKFGQWIVLATMRHDWVNSATRGAESVAGEATTGRIGLMYAFENGLTPYVSYATSFTPIFGANVCAGGACRPIEGEQIEGGFKYNPTPWFAVNAAIYDTVERNRLTPDPSGLPISIQTGKVKIQGGDIEAIATINNDTNIIASYAYTDARYAAGDNAGARVETQPLHLASLWVTHRFTLAEVPGSFLVGGGVRHIGESFDGSLNSFNTPAVTLADALVGWEDAHWRAQLNVSNIADTRYLSTCLARGDCFVGTRRTILGSLTYKF

SEQ ID NO: 2008 - protein, 750 aa, Methylibium petroleiphilum
MASATALHARASLAPRSNLRPLALASALACAAISAQAQQQSSESVQVAAARADRSTPVLRDVVISASRDEQDADSLPMTVDVIDAKQMEAEQIGDIRELAAKLPNVTVPRSPARFTLAGSPTGRDQNSGFNIRGLEGNRVLMLVDGVRLPRSYTFSANSFGRDYLDLGLVQRVEILRGAVPALYGSDGMGGLVNFITVQPDDLLKDGKSIGGRVSASYDGSDNGKRVGATIAGRASPEWSWLVSAGMGRSSALENMGSNNSVGALRTTPNPETDKSHSLLGKLVYTPSAVQKHVFVLEGVDKRADYDLLSARSATVTDSKSNTSMKRWRATWQGQWQQLDTALADELKLMASYQSTSSREFVTETRTPPLAYRERDVTYDEDALQLHAQAGKTLRWSNGLSGKFSYGVDYLRGKVVNEQNGITPPAGESFPLKRFPDTTETSTALFAQAELHYGAFSLTPGLRAEHYSIKPKQQGFGGTVVSNSDSAVSPKLGAMFQMNDAWSVYGNYAAGFRAPNAGQVNAFFENPLAFYRSIPNPDLKAEKSNTFELGMRGRVNALRLDAAVFTGRYKDFIQDQVLVSGNYGDRNNPATFQSVNLNRVHISGFELKADYDWGKFAGGDWRTNAAYGYTKGTDKSTDLPVDTISPQQLVLGVRYDRSNVGVQFSASHWAGKKAGDAAANAWLSPSATVLDLSAQWRIRPGTRLNVGVYNLTDKKYWRWSDVRSLTNTTQIADAYSQAGRYVRVSLVQDF

SEQ ID NO: 2009 - protein, 847 aa, Methylibium petroleiphilum
MATSKKYVYILFFAICHLLSAQNSQEKQLLKDIITSLEKKHDVKFSYAVEDLGTLSITPPKDILTLQEAIAYLNAQTLLNFKMLSERYVTVSTVNKKIAICGYLKNAETNEPLFGATIAVVNEARGSTTSVDGKFTLDEVSPEAKILISYIGFNSEFFQAKELFTTGNCRTINLQPIREDLEEIVITKYLTTGLQKVLDGSTVLNTEEFGILPGQIEPDILQSIQALPGVESSDESIANINVRGGTNDQNLMLWDGIKMYHSGHFFGLISAYNPYLTEKVTVTKNGTSSEYSDGVSSTIKMETKNNITNTFSGGFGFNLISADAFLQVPITEDLEVHISARRSYTDVFNTPTYDQYFDRSFQDSDINTNNTINQAETSSDFVFHDYSAKILYDFNKNHQFRLSFISIDNQLDYMESTVNTSNEASSRISELNQRNIGASGHWKAFWGDKLTTEFSGFYSTYEVDAVDYTVETDQELAQRNEVIETGVKLKALYEITDEIQLRSGYQFNEIGILNRTRVSLPFFDRIKKDVLWNHSFFAEAEYYKENTFVRVGARATYFQQFDEFRLEPRINIRHKISNQFSVKMLGEFKNQTATQIVDFQDDFLGVENRRWILANNEDIPIAKSMQGSAGIEFNHNNFLIDITGFYKNIDGITTAGQGFYNGLQFVDATGSYRSYGVEFLANKTADLYSAWISYTYSKNEYTFDQFTPATFPNNVDVRHSVSAAFNYELMKDLKVSLGGIWRSGRPFTQPVAGNETVQNGNFTQVNYDEPNSSFLDDFKRLDASVSYAFNIHNNIKGTLKAGVLNITNQRNVINRYYEVDSEDTSRAKRIDNVSLRMTPNVSFRVRF

SEQ ID NO: 2010 - protein, 622 aa, Methylibium petroleiphilum
MMCLTMAQAAETEQSSTDKKPTKVVKVAVTGSSIKGVAAQSASPITIIKGEDLANAGVTTVEEALTRVSSNQAGFSTDQNVGASNTDGSTANLRGLGSDKTLVLLNGRRLAANPFGTSTVNLNIIPLAMIDRIEVLRDGASAVYGADAVAGVINFITKKTYQGVGISAGLLQPEHKGGDKQDISIFGGYGDLDEDGFNIFGVVDYRRTNGIMAKDRKISERGGVLPELGLDGRSANTFTSNFYDPISGVSGNPYAQNGQCLGPAESAEKGLCYANTQALIGIKPDVENVSVLGRGTYKVNDNLNAIGEYIYSRSEVITSVAPDPFSRGNLSTRVTLPSDSPYYPGNGIVPSVKGLSGAPLELYLRSHAGNRIAKSINESHRLFAGLEGDVWGWDLNTGVTYAKSEASDNFVTGQLNKTKLQDALNNGTLNPFGESSDPNIWNNLSVKGKYNEATLESTTADFSISRPIFTLPAGEIGFALGGSFTNQDWKQHINADLVRQAPSSGTDPSKPDNSGDRDITSAFAELQIPITKTIEAQLAARYDDYSDFGDTFNPKFAIRWEPLKQLMFRTSYSTGFRAPSLYEINAAQSKIYTGAKHNDPLYCPGGEVVEGKIKMTFVILNL

SEQ ID NO: 2011 - protein, 263 aa, Methylibium petroleiphilum
MDKHENEVAGYMDFRQDFGRWLTLNAGLRIDHHSRVGTEWVPQAGLAFHLPHAIELKASASKGFRYPILREMYMFPPQNPDLQPESMWNYELAFSQQLLDGRLRYGINLFYIDGKNLIQALPNPGGSGMLNQNSGKIDNTGVEVQAAYRISPDWSADANYSFLHMENPVIAAPEHKLYAGANFSKGRWRVSSGLQYIAGLYTAVGETEITENFVLWNLRASFRAAKWLDIWARGENLLAQKYEINAGYPMPRATVMAGVNLNF

SEQ ID NO: 2012 - protein, 901 aa, Methylibium petroleiphilum
MRTLAILGAGFTMLPQAAMAQEVADEGDMVDNADVDDTTPVIVVTAQGRAQNLADVPVAISAVSSETLENSGTSDIRELNQVAPSLLVSSTGNEANGSARIRGIGTVGDNPGLESSVAVFVDGVYRSRSGNALSELGPLERIEILRGPQGTLGGRNSSAGMISIYTAEPEFDFGGYADFTYGNFDALRIEGGVNAPLGDTVAARIDGVWFQRDGFYNDVVNDTDVNNRDRYLVRAQALFEPNDDISFRLVGDYSKKDEACCAATFVQPEVAPLARVSPGFDPFARPETGSPALASTGNPIVNVLLGLGQDPRAFTQSTYDRDIYVTQGRSYAGETEDYGVSGELNWDLGGANLTSITGYREYFNTQASDTDYTQVDILYRAPGDDAGAREFKTFTQELRLNGEAFGDRLDWLVGAYYANEKLETRDNLRFGEDYGRFVNCRLVIAVNPALLAPGADDCLGPARAFLDGTVGDPAFGPATPLILAGLDNLAMVSDVGGTGDQYNQTSENFAVFTHNIVHLTDRLDLTLGLRYTSETKDFDASFSNDNTICPTNRALVGDLLATPLAGLAGGIIALSCQGNSTAELDGVTIADSRDEDEFTGTAILSWKPVDDLMVYTSYSRGYKAGGFNLDRSALGNPVTFNVANIDPASLQFDEETVDAYEIGMKYSNRQWSLGLTAFRQEFSNFQLNTFNGSVFLVQNINGCGTDLNDLDRDASATTGACDAGDVTPGVVSEGFEFEASLSPTRNVNMTLGVTHANTRYADDLVGSDQGDPLDPALRLLPGDNLSNAPAWVGTTSFTWTPNIGGSGMKGLLFVNARMTGDYNTGSDLLYGKEQDSFVVVNGRIGLTNIADRFAIEGWVQNAFDTDYTQVAFNTPFIAPQQTYSAFLAEPRTYGVTVRAEF

SEQ ID NO: 2013 - protein, 701 aa, Methylibium petroleiphilum
MSRRNWAAAPMAIVVGTTGMGSADAQETALPTIEISAQRATAPFRTRESTSATRSEADVMEIPFAVSSVDTKLIQTVAATRGDDLYDWVAGVSRQNNFGGLWDNYAVRGFAGDGNTSGTDYLVNGFSWNRGMSVPRDTVNLERMEVLKGPASALYGRGDPGGIISYTTKQPQFARATTVGVSAGSYGALRQTLDTTGPVTQSLAYRFVAMNENNGSFRDTVSSKRYLFSPSFTWDIGADTTLHYEFESARQRAPLDRGVLAVNGQLGVIPASRFLGEPRDGDYDVRNTGHQFTLEHRIDSAWSINAGVAQRKTDLSGRSSEAFALQPDGRTLWRRYRQVAFHSNDLQGRLETAGSFRTGGIGHTLVMGVDAYRFNYDQFVTRSTPTAAAPYAIDIFDPVYGQPAPTPRTATNLLERDDGQGVYAQDTLAFGPHWKILAGLRWDRFHQSIDNRLKGVTTSQLQTALSPRIGVVYEMSPAWSFYANTAYSFRPNNGADINGRAFDPEKGHGYEAGAKWAGARSLTTVSAFYVTKRNVLTADPANAGFSRAAGEVRSRGIEFEWSGDLGHGLRGLANLAYVDAEVTRDAVLASGARLVDVPRLSGSALLMYETTLPFADKAGAGAGVIYVGRRAGNTANTQDGFELPAYATVQLNGYLQVNKHLRASVVLNNLFNRTTYVSSYNSLWVTPGAPRSLFASLAYSF

SEQ ID NO: 2014 - protein, 692 aa, Methylibium petroleiphilum
MSVRRLRRSTALAPLLTLAIAFVPGALVPAAAAAQSGGTAPADPAASPPAEDEPVIRLKRITVTATRTPRPAIEVPAAITVIDEEEILRRQAQSLDDLLRDVPGLEMAGGPRTTAEQPSIRGLGDERILIRLDGARQNFQAGHKGRTFLDPSLLKQVDVLRGPASALYGSGALGGVIALTTKDPADLLKDGDKAGGRARLSWQDNGDEFVASLTGYGAPSDTVGLLASATYRNSGDVDSGSDLSIPYTGDDLVSGLVKMDWAVQPDHRLRLSWQGYRNDQDLPSAPDTDDLSILVDRITRQDTATLAYEGQSGPWFDMRGTVYWTRTKLDEDRIGQPRADDTELETIGVDLANTSRFTAGPAAVALTYGIEAYRDEQRGTRDGGPRPQFPDADSEVLGLFAQAETVFAERFTLTPAIRYDRFDQSADGQEGRTDSEVSPSLRAAFDATPWMTLYASYATAFRSPSLTELYNSGLHFPGVCPIPGRPCIIPNNFFVPNPDLEPESGATVEIGGNLDFDDVFLARDRLLLKAALFRNDVDDFIEQAVLISQGQTTRRNVQDAIIKGMEVELTYDSPTWFGSVSGSLLRGEDDDTGLSLDSIPADRLVLTAGRTLPEYDLSAGWRTTLADEQDRVASAEPTAGYVIHDLFVVWQPREALRLDLGIDNIFDKAYRRHLSSIPERGRTFKVAAGVSF

SEQ ID NO: 2015 - protein, 142 aa, Methylibium petroleiphilum
MIASYGFTDAMVTEDPTLAGNRLLNTPRTTASLFLTHQVGLVARATSLGSLSLGDGFLELGWGSRYVGERPGDATNSFTLPDYVVCDAFLSYRTSVNGLPAALQLNLKNVLDETYYPSSGASNVLVAVGEPFQALMTARVSW

SEQ ID NO: 2016 - protein, 1014 aa, Methylibium petroleiphilum
MTRPGVRSVLCRNIKRSALSLALGMCVVGGVQAQSAVGSIFGSGQPGSTIAIQSPQTGVSRSITAGADGRFTFSQLPPGKYVITADGVTREVDVKVGSGSQVLLGSDAKTLDRVEVVGVQAFNPIDVSSVESTTVFTAEQMVSLPVASDVSSVALLAPGAVRGDSGLGAGNLASFGGSSVAENGYYINGFDVTNMRTFLSFANIPFQGIGQLQIKTGGYGAEYGRSLGGIVSIVTKSGSNDWHYGASVEWAPDWGAAAAKNVRERDPDASDPLYQYRSDDQFDSTIYSAYASGPIIKDRLFFFAMVEGRQETEDNFYALTSRRVSDTTPQGLVKLDWYINDSNLVEFTGIYNQAKTKYRTYEYDTDANGDNRYNVGRHEVPIEQYEMENGGKVGILKYTGYFTDNFTVSAQYGYLSNLIDSRLPANPAGGECPWAYSFGLTTSVIDRYIGCNPGTITTIADLDAEPDEDVRKAFRVDGEWVLGEHRLRFGVDQEKYESSHRGQTYAGGINWAYYTVPGNAVATGAFAGQPGRTVNGQLVPRGALYARSRVYQTSSSSYENTNSAFYLEDNWQVTENFLAVLGLRGEKFENKNGDGIAWIESDYKMAPRLGFSWDVLGDASLKLFGTAGRYYIPVATNSSIRATGAESTVSNWYFVNGWSEADGTPVGQGAQIGQTQANGSLTAPNPASVASTNLSPMYQDEVILGGQLQLTENWMAGVRMIRREVKSGMDDTCTTNPWIDWAADNGYPDFDPGSVPSCYFLNPGSDVTLNVDLNGDGEVELATLPASYLGLPEYRRLHTALEFFWERTGEKFNFQGSYTFARTRGNVEGYVNSTLEQEDAGLTQDFDHRLFTDGTYGPTPNDRQHTLKLFGAYNLTPEWQFGGNLVLQSGRPINCQGYIPLDDIPQPDQGNLSGYSGSSFYCLNAEGTRELRQRGDEGRTPWTWTFDLAAAYIPNWADNKLRIKLDVFNLFNNDRVTEYNEFSEASRDVISPNYLNDGNYQTPRSFRLTARYDF

SEQ ID NO: 2017 - protein, 635 aa, Methylibium petroleiphilum
MKSFRIILSLLALSTWLNAYALDSELSLEDLMNIEVTSISKNEESSFTAASAIYVITEEEIKNKGAQNLAEALRGVPGVQVSRRTNNSWEVSIRGFDNLYSNKLLILIDGRTVYTPIFSGTYWNFTNYPVSDIERIEVIRGPGASIWGSNAVNGVINITSKHTKDTIGGFSKLEYGEDFQQAYLRIGESLNEEKTLNLRAYAQLQKYDTLNPGQQTKNSQQNDDWDHLQGGFRLDYDITSKDALRVSADAYSVDQVTYNAINNNGFYEDSDATGYNLSLDYTKQITSDEKFHSLIYYDFYDFNQDLTTNTYVQSWNFEFDYHFSPIKNHNITVGAGTRIYRSQVKDPSGQLRMYPENETTQNYSFFIQDKITLQPDRWTLTLGSKFEEHDYSGFEYQPTARLAFTPNRKNTLWLAASRAVRTPNRYEHNSNLFFGSAIGNHDVDSETVETYEAGYRVLATEKLSFDFTVFYNDYSDLITSKVEAGNDPIINASTAESYGFEVSSNYLVTTDWQLKLSYSYFDFDLDQQDGTSDFLASENVTAQHQASAYSFYKLTNALQWDVTAYYQDSKNPSLNSTNTPSNSPFIKLDSKVTWTCSPKLEVYLMGQNLWDSSTSETVYYLENPRTFLMGLNYRF

SEQ ID NO: 2018 - protein, 1029 aa, Methylibium petroleiphilum
MHERRGVWAARLAAAASVLLPTSAFATGSGVLTGTVLDSSTRQPAADVVVTVTSPALQGEQLVVTDPSGQFRIPNLPPGTYTLRLDKDAYRPYSRGGIELRVDSTIRVNSELLPEALKAEEIVVVGSAPIVDVGSSATGVNVGSEFASRIPLIPTGAKGAATRSFEALADVAPGASADRYGVSISGTTSPENQYVIDGLSVNNPAFGVIGTPLSVEFIKEVKVITGGYLPEYGRATGGYLDAVTKSGSNELHGAVFFSVTPGLFEASQTGVQSAASTITTDTRLSSLRDAGVEIGGPILRDRLWFFAGVSPSAASYRLERELRFGRSDPIPGTQRVYYATQQSVQYLGKLTLLIDPDNTVSLSVYGSPTTSGGDGNFGINPKDGTVELNNSSSNNVINGSFGALAHRYVSSATDAALKWSSAFQNKTYLLDVTLGVHHEENAIRAADGTRIGSGKGLSDIAQVHWQRSDPGFHSINDFEPSEATRDCEPAGTQAAERCPVATYFSGGPGALSETTLDRYQGKGVFTGLFTALGHHIVKAGVDLELMRYASSRGHSGRNVFAETTDGGAFTGFRRLGFIANPDDAVPLDRFETVSKSTTIGGFVQDSWSILDQVTLNAGVRYDAQLLYGGDDKLAIALPNQWSPRVGVIYDFTQAGRSKLFVNYARFYESVPLNIIDRAFPGERQVFTLHAAAACDPRDRAQQRGACDRNENLIPTSAPYSPNQKWRVIGGDGGIDPDLEPQSTDEIVLGGELEIYPRLRVGAQYTKRYQNQVIEDISRDEARTYLIGNPGYGVAKDFPKPTRDYDAVTVHAEKAFADAWLAQASYTISYLRGNWAGLFRPETGQLDPNVNSDFDLVSLLPNRTGPLPGDRRHQIKVFGAKDFTIHHRVIVSVGGTYRSASGGPTSHLGSHPLYGPDQVYILERGSGERLPWAHSVDAHVGVGVQLAKESTLSVTVDSFNVFNFQAATAVDQRYTVASVLPIPNGTKGDLGQLRNVDGSAFNPVNKNPNFGKPVAYQAPRTFRIGAKVTF

SEQ ID NO: 2019 - protein, 735 aa, Methylibium petroleiphilum
MHGRPLATHFFRTIAQQCCNSLALALAAPRRSANPTGGHVKKLFLLTAAAATFPATAVASEAEREDARTILVIGKSDGYVATNSVTATKTDTPLIDVPQTISVVTRERLDDQASRSIADVLRYVPGTTIGQGEGNRDQITLRGQNTTADFFLDGVRDDVQYFRSLYNIERVEILKGPFAMIFGRGGSGGVINRVQKTPSADALAVGGTVSANSFGAWDVSADVNAPLGGGAAFRLNANYESLDNHRDFFEGERYAINPYVAADLGRWKLGLSYEYVNDDRVTDRGVPSIATAPGRPNRPITGYRDTFFGVPGVNRTGLEAHIVKARIDGELAEALTWSTTLLYGDYDKYYTNVFANGPATSPTGTVALSSYTDATRRQNFIAQSNLLWDVDLGGIDNRILFGLEYGDQDSTNQRRNGTLSNGTLDLANIVYPTVSFGPLVRNTDSRVRFFSAYAQDQIAFGSHVDLVLGVRYDRFEIKGTDLIGAPRPFARTDEKLSPRIGLILKPRENVSIYGSYSRSFLPRSGDQFLTLAPASGSSPAQEDLTPERMINYEVGAKWDIRPDLNVTAALFQLDRNNTAVPVAGVPGSQFLTDTRTRGVELALTGRITPNWQVSGGYTWQDAHRKNDDSIRLGQVPEHQFALWNRYDFNRNVGMGLGVVHQSSQFAAIRTAPTTTRLPAFTRVDAALFVKANERVAFQVNVENLFDERYFSDAHNLNNITPGAPINARFTARVKY

SEQ ID NO: 2020 - protein, 638 aa, Methylibium petroleiphilum
MRSSLYRSYRPALPTVRPSVAAVLAAVSSLVLNPALAQTETGSGSQPVAGTAAATQLPPVVVTSTRTAQPLTEALPHTTVVTQEDIVNSQAPDLRTLLRNQAGVELTANGGMGSNTSIFMRGANSNQTLILIDGARVSSVSSGTAQLANILPDQIDHIEVVRGNVSALYGSDAIGGVVQIFTKSGAGQAPAANAQVEYGSNNTRQGTVGYGGQIGDTSFNVTGSAFKTDGFSSINTKQAPRANPNDNPYENQSVSAQVKHRFTPDWDAGMAGYYSKSKLSYDSSFGRPTDDNRSNSELYTVSAFVNGKVLPDWATHFKLAQSEDRSENFLNGANNGTFNTRNRQFNWQNEYALAPTHTLLFGTDYLQQELDSNSYGAPSRNVFSVFGGYDGRFGKHQIQLNGRNDHYSDFGNQGSFFAGYGYNVTDALKLIANVSNAFRAPTFNELYFPGFGNPNLNPERAKSAEVGVQYNTPQTGLLRVTTFETRYDDLIVNVTQPNGLLAPTNVNKAKVQGIEASWRASLWGTDVGASVTFQNPVDEQTDTQLLRRARRHAAFDVGRNFGNWRFGGEWLLSSSRLDTGSRTLGGYGIVNLNARYNIDKQWFVAARVENLFDKNYQLVYPYNTQGRAGYITLGWRQK

SEQ ID NO: 2021 - protein, 363 aa, Methylibium petroleiphilum
MTKKTLLALAACTIPVAAFAQSSVTMFGLLDAGISYVSNEGGHGNAKFDDNIFFPNLLGFEGKEDLGAGTRAIFRLVNQFSLANGSMIGGGLFARTAYVGLQNDRYGTLTLGNQYEFMVDSLAASGNEIAQDLVGLYGFRNGPFDTLALPNNPTGAFDWDRVAGSNRIANSVKYTSASIAGLTFGALYGFGNVAGSVGANNTVSVGASYDNGPFGAGVAYTNQKYGAADGRPATTVRNWGAGAHYTLGTVTAKALFTTVHNALNGAGAWSAEAGAAWHPSPVWVIGASYTYMKGNDTLENAHAHQLLAAVQYWLSKRTMVYVAGLHQHASRGSHAQINGVMDANSASSGALQSVARIGFSTRF

SEQ ID NO: 2022 - protein, 538 aa, Methylibium petroleiphilum
MSGKYPSVGIADSTYTSNPSNYFWSAAMDHLAKNRGRELATRFDLEYAFDDSAWLRTFRAGIRATDRTQINKNSGYNWGVISDNWAQIPDTANGTGLADLATYMTGTSQLYSYSNLFRGKIDVPNSLYFPSNAAVKDYAGTSKMIEQIVALRGSGWAPDKYQLQDINRQFERTQAAYAVMYFGNDEALGVPVDGNIGVRIVQTKTEANGYGQFPDLSGSAGSEALREQYTGQYFANNAKGSYTNVLPSFNMRFKFSDALQWRIAASKAMARPDYTQLQPYLLLAANTESNGTVSRWTGTAGNPNLQPMKANQYDTALEWYFDTSDMMYLTLFYKSVKDYFSNQTVTENYGGQDWLVTRPYNMDKGRIRSFEYGYTQFFDSWPGWLSGFGVNANFTFVDSSGGANTATDPYTQTTVTGVSLPLEGLSRRSYNLAGIYEKGPLSLRLAYNWRSRYLLTASDVSTKLPTWSDDYGQLDASAFYRFNPHVQLGVQANNLTNTVTKVLMGPTSYTGGEVDNHLYTRSWFVNDRRYSLVLRMNW

SEQ ID NO: 2023 - protein, 512 aa, Methylibium petroleiphilum
MARAVHRSGLVALGIATALMASCAFAAKDVVVAVGSNFTTLDPYDANDTLSQAVAKSFYQGLFGLDKEMKLKNVLAESYTVSDDGITYTVKLREGIKFQDGTDFNAAAVKANLDRASDPANHLKRYNLYKNIAKTEAIDPTTVKITLKQPFSAFINILAHPATAMISPAALEKYGKEIGFYPVGTGPYELDTWNQTDFVKVKKFAGYWQPGLPKLDSITWRPVADNNTRAAMLQTGEAQFAFPIPYEQATLLEKNKNIELMASPSIMQRYISMNVTQKPFDNPKVREALNYAINRPALVKVAFAGYATPATGVVPPSIAYAQSYKPWPYDPVKARELLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 2024 - protein, 463 aa, Methylibium petroleiphilum
MHQKHLLFLAVLAALSGHALAAEESSVPPGSDGPALKGTGQTIPESDVYDLLTKSETTLSALYYGRDRQEKQPNNSNGGDIRVNALNLGLNFKSGYAWDKLGFDAAAHASLRLSKGIGFSEVLYHDYNDVSDPAEGGGGRDKSDAVLSQAALKFRQNPDGQGFSARAGYTPISIGAMGTSGGLQSHSYRGVEAKYKIGDFELGYGWADQFRNEWDNRFRDMTNSWEQGRSNGSNPGKIKYVNSIGFRYAPENAFVDIGFGEGKDYRRTAQIAGSYTWKLSGGDTLTSVGYYFQGKDEAPLGLKNSQTASHASASITYATGGLSLMAGLGKSRNPDGGEVNFRLTPYGNSDNRNFIQTWGQDDDFVWDGTRVMKLGVSYDFSKQGLPGFSVGASGNYATGLKNPNGAPDSKAHEIDLSASYSVQSGWLKGASIGVYPAWYRSGDFYGKKDRNDVKVIASYSKTF

SEQ ID NO: 2025 - protein, 484 aa, Methylibium petroleiphilum
MPNALSPPARVLLLSAGLACALPFFETSALAQSPSAVESFTGEAGPRTDPEAIGVAPDGKVKWHGPLAPYAASLALAGLSFDVNVYDFFFANPSAGLRPGQLSNSAYYLLSLDADLEKLAGVPGGFFHITQTFFGLRWNNRNMGADIGDTTIGYQPTFNRDVARLSILTYEQRLLDDRLAIEVGRTHPNRYYALPPCQSSVSCFQDILQINAGLSSPLYGVWGANVAYKTSPEDYIQAGAFAVTGRANFTSGWDFGHEPLNGVVTLAEIGHATTFVTDPYPSRVALTGFYNTADHEDNFKTIYGTSKGLNPSDPVRLRSGTSGVILTGSQVVWRADGGADASNLNPTSIQAYTSLAYAPDPTVPIRWNAFAGLTLQAPDQSRPLDRYGVKVNWQRISTDYAQFLGDANFISGGSGEIYSRDKLIFEANAHLALGKGIFFEPVVQYLVNGNAFWNPYTANRTKDGFYVGATLIVPLGQLLGLAPG

SEQ ID NO: 2026 - protein, 399 aa, Methylibium petroleiphilum
MKKKIFVTLAANSLGMVMLTSLPGVAWAQSSVTLYGIVDGGVEYLSGLAHGSLVHTESGYALPTRWGMKGVEDLGGGTKAFFRLESGASLMTGKIGNGSFFGRVAVVGFSNDAWGQFRMGNFGITELAQDAAFLADPQWELPYAIETLVRGRNWSQAGNGLEYTSPTIHGFTLKGQYDLGNSTHWNEGASGPNQMGEFTQGRSDGIQLSYEQGPAYLTVAYDEIRDGNGLFDNVYLNSRSLMAAGTYQLGAVKLYAGYQHLSAPDSTSASVFGSGVNPVLPSGATVPTSAEQEWLGAQWQVDPANSLTAGIYHANANHGNGNATLYTLGATHNLSKATFLYAEAGYVSNSKTSNIGLGDGFTDPYGPNGNDDPASGGSSTAPNYGRGQQGVFAGIVHKF

SEQ ID NO: 2027 - protein, 380 aa, Methylibium petroleiphilum
MAYGVFRKFMKKRKTVKKRYVIALVIVIAGLITLWRILNAPVPTYQTLIVRPGDLQQSVLATGKLDALRKVDVGAQVSGQLKTLSVAIGDKVKKDQLLGVIDPEQAENQIKEVEATLMELRAQRQQAEAELKLARVTYSRQQRLAQTKAVSQQDLDTAATEMAVKQAQIGTIDAQIKRNQASLDTAKTNLDYTRIVAPMAGEVTQITTLQGQTVIAAQQAPNILTLADMSAMLVKAQVSEADVIHLKPGQKAWFTVLGDPLTRYEGQIKDVLPTPEKVNDAIFYYARFEVPNPNGLLRLDMTAQVHIQLTDVKNVLTIPLSALGDPVGDNRYKVKLLRNGETREREVTIGARNDTDVEIVKGLEAGDEVVIGEAKPGAAQ

SEQ ID NO: 2028 - protein, 868 aa, Methylibium petroleiphilum
MLATAFGAHAQDSAPAAPPAGDASPAAGNGQTPVTLDNITVIGQRASLNQAVQAKQMSDHVVEVISADNMGQMPNVTVAEALVRLPGVNGTRDRGNESLATVRGLGPRMTMGTVNGREIASSEPNRAVRWEVFPTEIVSTVKVYKTQSADLVAGGLAATVDISTISPLDYTGPGFVGTAGPVFYDHAKDVDGYSPWGSRFGASWVHKLNDNLAVAFGATYQKQKNASSSIGSWGYTDATTSRDVDGDGTVDPTPWGAADQLKLIDQTRTGAMGTVQWRSGNVELKFDGLYSRIEIDEDQLQNWFNGLAFSTFSGSTNPYTTPGSSYTIVDGDVVAGTLANSNLQVDHVVSHYNEVKTLTAGGLNAKWSGDVWTLGSDLSFSQAKRDNTWQAVRFGSNPDTISFDFRRSVTPTISTSSDTPEYGIAGQTEPQALRDKIAALALNASRAVDAGPFTSLELGARAARREKQNRRFLSNQSGYDQPISEYQDLIYPVTMPDLNVPTLTGGNMAEIARIGFGGFDPSTLDEQLLDHWNVKEDVREAFAKAVFSSQLFGTDVTGNVGVRLVNTKTTSEGFDSVGSTIQPSTGSKEYTDVLPSATLNFLIDDQRILRFAVAKVIARPPLDELRTGRRLDDPSVTVGQLTGSGGNPQLDPFKATQVDVSYEWYFHTEALAALAVYRKEVDSSIGYRTDREVINGLDYLVSAPFNGGGGYINGVELTFQTPFYFIPHMENFGVYSNYSLVDSNLKEFSPEDNPLPLSGLARKTGTFDLWYSSGTFEARVGYKYHSPYTVVYGWNAARLARLQSEGTVDLSLNWQYSKQLGFRFQASNLTNEPLRAYTDNKPNRLANQDDGGYQVFGRRYQLEATYKF

SEQ ID NO: 2029 - protein, 396 aa, Methylibium petroleiphilum
MTSSRPNCLIAMVAALAVSALSSAALAQTAGEGAWSHEVVYTADVAGPVRGGAAHAGRALDNLDVIIDGDLDKAFGWRGLAVHGYLLNNSGGAPNDIAGTLQGVDNIEVGRPRARLYELWLKASFAGDKGSVLAGLYDLNSEFYSTQASGLLLAPPFGIGSELASTGPNGPSIFPSTALAVRMRVEGKQGRYVQAAVLNAKAGTVGDPDGPATEFDHGALIVAEAGIGATWRLAAGGWFYTQRQTDLRDLDAKGDPARSHARGAYLLAEYPFVDGGVSGRSVRGFARLGLSDGDTTAFRSGWQAGVLVEKVFASRPDSAFSVGVEQGMLSSKQRDNTRDAGVSPAHAESSIEITYSDKVLPRLTLQPDVQLIRRAGGDRDARDVVVVALRMTISLF

SEQ ID NO: 2030 - protein, 204 aa, Sphingomonas yanoikuyae
MKSKLTYLAASAAALVITTTNLQAKDEPGFYAKVDAGGSLQQDLKINGADFAFNPGFRANLGFGYNFCKAFAAEFETGSIWNSVDKLDGIPLASRASGDLYQYPFLAKAIFKLPFDNGLTPYIGGGVGGIGSTLHLKDPFLDSSSTDFTFAYQAEAGLKYAINEHIDVGVGYKFLGTTGYSFFHGPRTDDTFNHAIFASFVWNF

SEQ ID NO: 2031 - protein, 351 aa, Pasteurella multocida
MKKTIVALAVAAVAATSANAATVYNQDGTKVDVNGSLRLILKKEKNERGDLVDNGSRVSFKASHDLGEGLSALAYTELRFSKNVPVQVKDQQGEVVREYEVEKLGNNVHVKRLYAGFAYEGLGTLTFGNQLTIGDDVGLSDYTYFNSGINNLLSSGEKAINFKSAEFNGFTFGGAYVFSADADKQALRDGRGFVVAGLYNRKMGDVGFAFEAGYSQKYVKQEVEQAQAPKVFKDEKEKAFMVGAELSYAGLALGVDYAQSKVTNVDGKKRALEVGLNYDLNDRAKVYTDFIWEKEGPKGDVTRNRTVAVGFGYKLHKQVETFVEAAWGREKDSDGVTTKNNVVGTGLRVHF

SEQ ID NO: 2032 - protein, 649 aa, Photorhabdus luminescens
MKRAFIFAPGMLALSISAISNAHTYDHLYVFGDSLSDGGNKGRYMINGTTSQLYNDFIAQYLGTKLTHSQNGGTNYAVGGATAVPDLNKDNNTQNQVDNYLASHGGRADPNGMYVHWIGGNDLKAVMLGGDPKIVRNSAMNASAQVHKLLDAGAGIVIVPTVPDLGKTPMIMKAVVSQGLTKLPISLTPDQVEELKDMIRAGTNEYPTINEDIRSQVIQGIFEKLATRASKGDAKTAEEYKRQLLDKYNETSRKASGLVDKYNELEDTALSKKGGNIVRVDVNALLHEVIDNPLRYGFSNTLGYACVRDKEANSCRSDDTGFDASKSFLFSDDFHPTPAAQRMIGEQTISILNAPHQVMSLTNTNNVPVKGALASLDGRLQQLRSVGNEQSKIGVFGGYSGNHNSTLTLGSDYQLTDNILLGGMISRYQDKRSVNHFRADGRGYLFTTYGLWRYYDKGWISGDLHYLDMKYEDITRGIVLNEWLRKEHASTTGHQWGGRITAGWDIPLTSTVMTSPIIQYAWDKSYVKGYRESGNSSTAMHFGDQRYDSQVGTLGWRFDTNFSRFNPYAEVRFNHQFGDKRYQISSAINSTETSFVSKSQKQDTNWREYVIGMNAAITKDWGAFASISRNDGDVQNHTYAFSLGVNASF

SEQ ID NO: 2033 - protein, 342 aa, Dokdonia donghaensis MED134
MKKTIIALSIAGFVASVQAAPQANTFYAGAKAGWASFHDGLNQFENSTEKKGTVRNSVAYGIFGGYQITDHVAVELGSEYFGQAKGRKDKKEAKHTAQGMQLGLKASYPVLEGLDIYGRVGAALIRSNYLNVKNFENSADGVKNTLKVSPVFAAGVEYSLPSLPELALRLEYQWVKGVGKARKNDGKRFDYTPSIGAVTLGLSYRFGQKPVMAPEVVNKVFSLNSDVNFAFAKDTLKPEAQQTLDGVYGEIAQLKTAQVSVAGYTDRIGSDASNLKLSQRRADTVANYLVSKGVAQDAISAVGYGEANPVTGMKCDSVKGRKALIACLAEDRRVEISVKGSK

SEQ ID NO: 2034 - protein, 660 aa, Dokdonia donghaensis MED134
MFKKITLLSLILATAVYANDEADIKLNESVITAQNFKTTVRNTASNVTIVTAKDIEEKGAQNLVDALRMVPGIMVKNYYGNIAFDIGGYSSVHAERNSIITYDGVRISAKEATNIPISVIERVEVIPNGGGILYGDGANGGVINILSKSIYGKDNNKKISGNVRTEYGSRGSYKYGFSTIAKATDKLTFKVDYSRDRYRSERDSDENGKVVSRSQEVSIDIKYKFDNADLTVKYTRNEKHRADGGDLEEADYYKNRKMVTWVARDFTRSNDWYVNYRQNIGENTELLTYIDLYDTRENDDISKTLDRDYSRKTAKLQLKHKYLNSHYFIIGTDYMKEKLKGLGYNGEYTGKNTEKTDYGIFAMNELKFGKFTFAQGLRYNKAEYDFYWRNKYPVPRNIRGEHGEQEYKNYAANLELRYDYSDTGMVYGKWSRDFRTPIAREMYYTLEGSKLKAQTQNTFEIGAKDYIAGTYISLSTFYKKTNGEIYYQGTPNKESTRPGAVVFPYYNMGDTRRLGIELLTEQYVKNFTFTESISYLNHKIVDSDFESRKNKEIPMVPNWKLGFGVGYKFNNKLNVNADVVYYGKFYDSDDPENVRPKDRGNYATVSLSANYKFENGFAINARVNNLFDKKYEDYVGYWDGTRQYSPAAGRYYSIGASYTF

SEQ ID NO: 2035 - protein, 1150 aa, Dokdonia donghaensis MED134
MKFYKLSGIGYPVKIHKFYILLFALCFYNIAYGQNQPITVSMKNQPLLKVFEIIEDQTEFSIAYNQTKLDVKQKVSANFVREAVSSVLNSVLKGTGFTYRQEGKHIIIIPVPAKAEAAPNNTTSTQQSIKIRGTVTDAQGEPLIGANVLVDGSKQATITDMNGEFSLEVPANSKLRVTYIGYVTQEVTVKNKTLFNIQLQEDTQTMDEVVVIGFGTQKKVNMTGAVASVNIKESLGDRPITNVSAALQGVVPGLKIESTTGTPGDDMTYNIRGTTSINGGEPLVLVNNVPMDINMIDPQDIESVSILKDAASAAIYGARAAFGVILITTKQGKKDMAPRFNYNNNFSFSKASELPQKASPLESVLAYKEMGWANDTYVDGKNITQWEGYIRDYQANPSNYPNGYIFDDQGNLFLMRENDMFADMMDNFGFMQNHSFSVSGGSQRTSYRLSLGYTGEDGILVTDKDKFDRINMSSFLSVDVNKWLTTQLDIRYANSTQNKVEQGGRNGVWGSAMYLPSYHNILPYEQDGIEYPAETSATFVRYGEPRVIKKTNLRTLGRVIISPLKGLKITGEYTYNRITEYNRMYVNKYKYIGFNFTGLLNNVENSRYALTQGFTNYNAINAFANYDFSIGKHDISIMGGYNQEESHKESQWSQRTDVLLENLPSLSGSTGTASVTDSFDEYAIRGLFYRVNYTYDGKYMFEANGRYDGTSRFPKDSRFGFFPSFSAGWRISEEAFMKNTKSFLSNLKLRASWGSIGNQIILKPDNTPENYPYIPSMSPYLTEWLVDGQKTTTLNAPAMVSSSFSWEKVYTLDFGVDFGFFDNRFNGTFDWYRRDTKGMLAPGMDLPWVVGATAAKQNAADLKTYGWELELNWRDRINKDWSYRIGFNLYDSQSEITKYNNETNLLGDKIYRKGMKMGEIWGYVTDRFYTEDDFNADGTLKPGIPIPKGAGKVFPGDVLYKNFDDDTETIWSGEGTADNPGDQRIIGNSTPRFHYGITAGISWKGLDLSIFLRGVGKRDYWRTDQIAWPTGGWGSLFKETLNFWTPTNTNAYYPRVYSNDGVNTSYNHWKQSKYLANASYLKLQNITLSYTLPKVWSQRLYFDDVKVFFSGENLYTWDHLPEGLETDMLSKGAWEYPFMRKFSFGINVTF

SEQ ID NO: 2036 - protein, 294 aa, Dokdonia donghaensis MED134
MKPFLRWCFVATALTLAGCSNTSWRKSEVLAVPLQPTLQQEVILARMEQILASRALTDDERAQLLYERGVLYDSLGLRALARNDFSQALAIRPDMPEVFNYLGIYLTQAGNFDAAYEAFDSVLELDPTYNYAHLNRGIALYYGGRDKLAQDDLLAFYQDDPNDPFRSLWLYLAEQKLDEKQAKEVLKQHFEKSDKEQWGWNIVEFYLGNISEQTLMERLKADATDNTSLAEHLSETNFYLGKYYLSLGDLDSATALFKLAVANNVHNFVEHRYALLELSLLGQDQDDLAESDQQ

SEQ ID NO: 2037 - protein, 167 aa, Dokdonia donghaensis MED134
MSPKSNSGTFGGTQAEIQGAPALSCTYEYFLRNNLGLEVHAAVAGKHDLELQGLGKVGSYWSVPPSVLLQYHINGYGTVLPFVGVGINYTTFLGEDTEPTFGNGDLRFRACRGGRPLQRAQRPARGCALDRLAQQRRLQRCAAGQGANRSTDLRRVVPGALLILLCY

SEQ ID NO: 2038 - protein, 849 aa, Dokdonia donghaensis MED134
MKAQKWILSSCALAVALALPSVAVAAEDGAKVERLEVTGSRIKRTDIEGPSPIQSIGKDDIANMGFDNLQQLLEKMPANGAGAFSTRGNSQDSTANGSASISLRGLGPDATLVLINGRRVAISSFAEGVSNSFVDINNIPVSAIERIDILKDGASAIYGSDAIAGVVNIVLKKDIEGIEVNLGYGGATGPHYDEKTANLVWGTKGDKGTASIILDYFKNSTLSADEMGRFGTANQEPYGGDDNRSSRGYPGYFYVDGVKTPDPDCPADRLTGSGSCLFDYGPYNLTIPAAERVGAIGQFEYFFDNDVTAFLEFAVQHNTSEAGGAATPLDESAGLTVPGTHPDNPWGKDILIGRYRPVDAGARRWDIESDSMRLVAGLRGTLNEWDWEVAAQKGRQEQTQTGDRSQGWVRVDYLQREIDAGRYNPFGAAVNSPDVIDAITTSLVRQGVSHMTAYNASITGQAFTLAERDVMMAAGVEYREEDVSDVPDEQFQRGLIFGTEAVSANAERDQWAAYVEFSIPVTDNFELQLAGRYDNYSDFGTTTNPKVAFQWGITDEITARGSWATGFRAPSLAQIGLGPSQESLFLDDYYFCQANGLDASECENLDQNFLFSGNKELEAEESESWNVGMIYAPNQSFDLSLDWYNITQDNKIDKLEPQDVYDANCGSQNSPICQRLAPVGADSLGTIDKILSSFVNISSQEVQGIDVSSHYTLATDGYGDVKFGLEYSYLMDFEKGDKDWTGKYRFPEHRWLGTTNWTKDDLSVNLNLSYIGEFADYNETRNVDAQLLVDMSASYRFSETLKWTIGMNNVLDEEPPFAIGDGDGDLYGYVMATHNPMGRYAYIKLNINF

SEQ ID NO: 2039 - protein, 297 aa, Dokdonia donghaensis MED134
  misc_feature (281)..(281): Xaa can be any naturally occurring amino acid
  misc_feature (287)..(287): Xaa can be any naturally occurring amino acid
MTKKFNFINVILTFLLFLFPLKSFTIHADNNAIMQKIGLYISGQYKPSISYFKNFSVEENNNNTALDLIGLKSDVTCITEHILQDNTKFNTHYIAKFKNNFINFSSAIGYYSGQGPRLEIESSYGDFDVVNYKNYAVQDVNRYFALVREKDSSNFSPKPHESSQLSHNNPKKSFYTLMKNNGISVASVIINGCYDFSFNNTAISPYVCIGVGGDFIELFEVMHLKFAYQSKIGISYPISPSITIFADGHYHKVINNQFKNLHVKYPYPLKDSPTITSAIAXLNIKYXGGEVGMRFIF

SEQ ID NO: 2040 - protein, 824 aa, Dokdonia donghaensis MED134
MLFASLVHPIRFPLDPVRLLSLLLPIIVVTALPAQAAENALDTPAAARKHYDIPAGPLGRALSHFAMVAGIALSFDPALTEGRTSPALTGNFSVDEGFNRLLAGSGLELIRNDDGSYTLHRAPVKATQAGVTALPVVTVSTSTENADDTGYVTQRSSSSTKTDTPLIEVPQSISVITRRELDARLVQNISQAVSYTPGVLTEMYGPVMRDDYFNIRGFDAPQFLDGLGLWGVNYANLRIEPYGMESIEVLKGPSSTLYGQSSPGGLVAMVSKRPTAVPVREAFITGGSFGRIQGGLDLGGPIDSNGQFLYRLTGLVRNSDTQINHAHEDRYFIAPSISWRPTSDTTFTLLSHFQKDDAGNTLQFLPPEGSLLENPNGKIPTSRFIGEPGFDKYNREQYTIGYAFDHRFNESWGVQQNLRYANVSSNYPTTFYLDFLRDDDGVPLDFRTIDRLAALYQDKAGTFTMDTRVQGIFDTAMLRHNLLLGIDYRYLSGSNRRGFSEDMLLLDIYDPVYGEPFGLPVIDYISKQQRDQIGLYAQDQIKYDRWILTLGVRYDFSSAHTRNHDLFFDERSSTRQNDRAFTYRTGINYLFDNGIAPYASYAESFQPIAGTDFFGSPFKPTTGRQYEAGIKYQPVNHNALLTVAAYHLTQKNVVTPDLTPGHFGYNVQTGEARVRGVEVEGKARLMNDLNLIVAYSFADSKVTESNNPDELGNRLSLTPRHQTSAWLDYTFRGNQLAGLGLAGGVRHIGSNFGDLVNNLKAPVYTLFDAAVRYDMKHLHSVLQGASLSVNVNNLFDNKYIATCADMACFYGNRRTVYATLRYKW

SEQ ID NO: 2041 - protein, 928 aa, Dokdonia donghaensis MED134
MKKILLSLIILFSFQLSIAQNSNEKITITFKDETLENTIKRIESAASLKFYFDPIWLKSNKDLISGTYSDAKIDDILNSVLSKTDLNYIVLKNKVILTLNSTIHDKLPSNYFTDAPVETNQNTGNDHSDNPVFYQQYDSLNSYSVTKKASIVFIGKENKDNIKRNYTITGSVKNEETGKAEANIFIKVRNKNISTSSDPDGNYTLQLPRGINVIEIKSLSHKEVVRTLMVYDDGTFDINVNERSNQLDEVVIKKKGQKTTETTVSGLVSIDIEGIKNVPLILGERDILKVATTFPGIKTTGEGSAGFNVRGGKDDQNLILLDNAVLYNPQHFLGFFSAINPYTAKKADIYKGSIPADFGGRLSSVFDIATKNGNPEKFSGEGAIGPITSNLTLSMPIQKNKSSIIFGGRATYSDWILKSLDDENLKNSQAGFYDGILKYNNAINANNNLEATAYYSHDRFSLSSDSIYKYSNRLASLKWDHTFSKKSKGALIFTNSEYKFNIDYDSNDVNSFDFGYKVNESQLQAKLNYQLTPKHNLSYGLASKLYNISPGYQHPKDPNSLLIPTDVEKERALESAVYLADSYKVNDKLLFDLGLRYSFYASLGEANVNSYQPGLPLSNETITGTTHYNKNEVVKTYGGIEPRLAARYFLAEDLSIKAGYDMTRQYIHLLSSNVTQSPTDTWKLSDSNVKPQTAQQVSLGLFKTLQDEEYEISLEGYYKKSKNILDYKVGAQLLLNQNVETELLQGEGKAYGVELLLKKSTGRLNGWIGYTYSRTFIKLDSQFSSEIVNNGNFFPANFDKPHDLSAILNYKFTKRYSLSTNFMYQTGRPITYPIGTFQYGNSQYTLYSDRNAYRIPDYIRLDIGLNIEGNHKIKKLAHSFWNISIYNVLGRNNPYSIYFVTDQNGKVKGYKTSIFSIPVPSITYNFKF

SEQ ID NO: 2042 - protein, 629 aa, Dokdonia donghaensis MED134
MRILLLPGKTPFSLRDAFCLAAALLVICICNSIALANEQEPIALEDMVVTQSRLDEYVKNYPQQLDILQRESIQQGHYHKVSEALASMPGVDATESVTGGTRIAIRGAGQGHVLVLINGRPAGATQYGSADINSIPMEMVERIEVYKPPIPVWLAAGGSSGAVNIVLQQDVKRKKTFTGRAEAYGGSRGKVGGSASGSYKVNEHALGLSAGASHQDGFRVNSDRDTAKASVSWQNPKTSPTRWDGSARYYHSEHGSPGRTDNPTPDARQQYNKGSADLRARGFFNDQAEYEVKVFGETLRLEDESQSGLTSLLDSNLIGIKEETTIADSLGKWALRFGANGKWEGADHTLSGDHERTQGGLHGQFDRDEGAFTWTLGVRGDLVSDFDFQPGAMVGVGVPVGKGHQIKARAGYTTHVPTFGQLYQPAHGSIDQVRGNPDLIEERIVSCSLGWQWDISKKNRLECTLFREDVWDKIQYDDYTDLIKRPVNLDRTNRTGAELALSWTVGAVGLEGSYVLQTTENEHNGKDLPYSPAHTFKLTAKSKVGPWKTRLEGVGRVVSDQYSDISNTEEKQVDAYASFDAKAVQPFSLWGKSAEAYVKIQNLLDANYETHHSYPDDGFRFTAGLSMDF

SEQ ID NO: 2043 - protein, 283 aa, Dokdonia donghaensis MED134
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYRRDCFSLGSNVDIDFSGPTIYGWAVLAFEGWLAGYQMSFDTAKSKLSQNNFALGYKAADFQLHTHVNDGTEFGGSIYQKVNERIETSINLAWTAGSNNTRFGIAAKYKLDCRTSLSAKVNNASLIGLGYTQTLRPGVKLTLSALIDGKNFNAGGHKVGLGFELEA

SEQ ID NO: 2044 - protein, 782 aa, Dokdonia donghaensis MED134
MKKITFFLFLFASALVNAQSFTLKGKVVDTNNAYLPGATILVKETKQGTSSDFEGNFRFNLEKGTYTVQVSFIGYKTVSEKVSITENSQIKFLLVPDSTVLEEVLVAAVRVSTAVPVSFSNLSKKEIATRNLGQDIPILLNYLPSVVSSSDAGAGVGYSYMSVRGSNGERINVTVNGIPYNDPESHGTFWVNLSDFASSTENLQLQRGVGTSTNGSGAFGASLNILTDAASNDAFAEISNSFGSFNTRKHTVKFSTGKINKHIEIAGRLSNIYSDGYVDRAFADLKSYYLQGSYTDENTLIKAVTFGGKEKTYQAWNGLTASELEEDRRQNPYTYDNETDNYEQNHYQLHWNERLNAQWSTNLALNYTKGAGYFEQFKEGEDAVDFNNLIADGSDVIVRRWLDNDFYVVNLNANYKTDNLNFISGISYSDYSGDHYGEVIWGSDLSEGVNIRDRYYFSDAKKTDLSVFAKATFDITEKLIGYLDVQGRFVNYQTQGITNDIVPINIDANFKFFNPKFGFTYKINENSSLYTSFAVANREPNRNDFENGVATPETLNDYELGWRFKSDNVKLTINSYFMDYKNQLVLTGALNDVGAPIRATSGSSYRLGTEIDADITISDKFSIRPNATFSANKNRDFFITKDGNATPQSLGNTDLSFSPDVIVGNIFTYMPAKNVQLSLLSKYVGSQFMSNFSSEVSTNDVLDSYFTSDLNLVYTLKTNNIFKSVVFTALVTNLFDAEYVDRGYYFTFDDDYSNPGTVTTVDGAGYYPQATRNFLLGATFRF

SEQ ID NO: 2045 - protein, 779 aa, Dokdonia donghaensis MED134
MKQFSIIARALAVAALASSSAVALAQAAGPQAADDSGDIIVTAQKRAERLRDVPMSINAATGDHLKALGVTSSEQLEKLVPGFTFQRTVYGLPVFFLRGIGFNDTTLGVSPGVSVYVDQQPLPFSAMTRGAMLDLERVEVLKGPQGTLFGQNSTGGAINYIAAKPTDSFKAGIEASYGRFNEVTGEAFVSGPLTDSLSARVAVRGERQDDWQRGYTNGDEIGRRRFVNGRAIVDWHPDSAVRAQLMATAWHDGSDTQQPQTVAYTPLVTGPMARPIPFPLASFPVSPRSPRAAAWDPGVDFARDDRLYHVAGRVEVDLGGDMTLTSLTSYADYRQSIPLDLDGTTFASGRSDDTGRIKTFAQEIRLTGDRPSGLKWMVGGNYQHDKVFERLVFDPLITSGTAVGPVPFNAFFVDNDQRIASKAVFASVDLPLADRLVLQGSVRYTDQDRDFAGCVRDTGNGEIAAALGLLGTIITGAPQSIPPGGCGTLGANGAPVPIVTGKLDQDNLSWRASLNWTLGGQGLLYANITKGYKSGSFPTLPASSAVQLRPVPQESVLAFEAGAKLGFGRSLQIEAAAFYYRYRDKQLVGFLVDPVFGPLPSLVSIPKNHVQGGEITATLRPTAGLVVTASGTYVDTRIDRNPINPTGPYGTPSDFVGQRFPYTPRWQGSLDAQYRFPVFAGLDAFLGGTVSARSGTTGALLSGDPAVAALEDGLRIDGYALIDLRAGIEAADERWRLELWGRNVTNRFYVNGVTRNSDFTTRFAGMPATYGLTVRYRFD

SEQ ID NO: 2046 - protein, 229 aa, Dokdonia donghaensis MED134
MKKVLSLLMVFMVTVAFTATGYSAEKYVSGNIGISWMNDSEINDIIGLTEAYDVDLDLGFSSGLTLLGAFGCDYGSYRLEGELGYQGNDVKSLGVTIPDYYGQNEDLSESVDLQGDITVLSLLVNGYYDIDLGGVELSPTVGVGVAQVSIDNVTGDMEEINEVEMDEIGLDISETTFAYQAGIGLGIPVADNIMLDARYRYFATTDFMMLLVNTNVTSHSALLGLRVGF

SEQ ID NO: 2047 - protein, 1435 aa, Dokdonia donghaensis MED134
MGQSNNTTINGGRQSIHDGGISTGTIIESGNQDVYKGGISNGTTIKGGASRVEGGSANGTLIDGGSQIVKVQGHADGTTINKSGSQDVVQGSLATNTTINGGRQYVEQSTVETTTIKNGGEQRVYESRALDTTIEGGTQSLNSKSTAKNTQIYSGGTQIIDNTSSSDVIEVYSGGVLDVSGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDAGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQIVNEGGLAENSVLNDGGTLDVREKGSATGIQQSSQGALVATTRATRVTGTRADGVAFSIEQGAANNILLANGGVLTVESDTSSDKTQVNTGGREIVKTKATATGTTLTGGEQIVEGVANETTINDGGIQTVSANGEAIKTTINEGGTLTVNDNGKATDIVQNSGAALQTSTANGIEISGTHQYGTFSISGNLATNMLLENGGNLLVLAGTEARDSTVGKGGAMQNQGQDSATKVNSGGQYTLGRSKDEFQALARAEDLQVAGGTAIVYAGTLADASVSGATGSLSLMTPRDNVTPVKLEGAIRITDSATLTIGNGVDTTLADLTAASRGSVWLNSNNSCAGTSNCEYRVNSLLLNDGNVYLSAQTAAPATTNGIYNTLTTNELSGSGNFYLHTNVAGSRGDQLVVNNNATGNFKIFVQDTGVSPQSDDAMTLVKTGGGDASFSLGNTGGFVDLGTYEYVLKSDGNSNWNLTNDVKPNPDPNPNPNPNPKPDPKPDPKPDPKPDPTPEPTPTPVPEKRITPSTAAVLNMAATLPLVFDAELNSIRERLNIMKASPHNNNVWGATYNTRNNVTTDAGAGFEQTLTGMTVGIDSPNDIPEGIATLGAFMGYSHSHIGFDRGGHGSVGSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEIEPWLKAAVRKEFVDDNRVKVNNDGNFVNDLSGRRGIYQAGIKASFSSTLSGHLGVGYSHGAGVESPWNAVAGVNWSF

SEQ ID NO: 2048 - protein, 123 aa, Dokdonia donghaensis MED134
MLFSIHNFNQGVIMAGWFELSKSSDNQFRFVLKAGNGETILTSELYTSKTSAEKGIASVRSNSPQEERYEKKTASNGKFYFNLKAANHQIIGSSQMYATAQSRETGIASVKANGTSQTVKDNT

SEQ ID NO: 2049 - protein, 184 aa, Dokdonia donghaensis MED134
MKSFVLSALACGVAALPMVASAQYAGSTQLTRYGELGLNFLSIDIEDDLPFISEDSIDLEVLTGRLGAAISPYLSVEGELSFGLGDDEVAGVDVNLNYAFAGYLRGEYPLSPEFTVFGRFGLIQAEVGFEAGSIDDTESGGGVALGFGGEYRLQSNFYLRADYTKYDIDDLDGDSLTVAVGYDF

SEQ ID NO: 2050 - protein, 758 aa, Dokdonia donghaensis MED134
MKFLHARSVSCLALISAIGVTGIAPAAFAQADSEKKMETVTVTATRREQTLQEVPVAVSVVSGDLLESTGTGSMDALSDLTPSLTLLKGNNESNSSVSIRGLGTSVFSQAVEPSVSIVIDDVLMARSGQGFQDLIDVQRVEVLRGPQSTLFGKNASAGVVSVTTRGPSETLTGGFDVELAEEDSSYAVRGTLSGPISDTVGFRVSAFTNDYAGHLRNVATGERANGSDSWGLRGKLQFDITDRLALTLIGDYRESDSEPVVTVRTANNPAYLAQLAPVVPGQENTALRANADSYATTEQAGLSAKAEYTFDNDFTLTSISAWRSWDFANNLDVDGLSNENPLPGGLLTFDLNSGTINLNQYTQEVRLASPDLGNFDFLIGAFAYHLDLERHFERRLELMTPGGMIAQSGQFDGSVENNYYAAFASANYYFNDQTSLFGGARLLTEEVNWVAFRDPTNVLVPGDLPLTGVQGILADFTGGVSDTAVVGNIGIRHSFNDYANAYASYSRGYKGKSTTIDFASIQGEEPVDAEESDAYEIGLKLTSPGGRWAANFAAFHTQFNNFQSQAQLPGEIATVLINAGDVSTQGVEAELMARPTDLTDISLGLAYIDATIDTFPSGPCYAGQTVADGCVNGVQDLAGKDLPYSPDLRLTFFGRQTVPLAAMPFDGFIQASGYWQDDILFSLDQSPIATGEARTMVNAAIGVEDKNGRYNASIFVNNVFDEHYVTSISQLGLFGGFTFQYVPRDHQRYVGIRFGANF

SEQ ID NO: 2051 - protein, 781 aa, Dokdonia donghaensis MED134
MKYLFSLLLVLSFTVLYAQNTISGTVIDSDTKKPVVWADVILYQKGKIIKGMITDDNGIFKFEELDEAKYTLKVTFLGYQTFEKAIDFSNKKEQQLSVILSPSSAQLDEVVIQAEVTTIQYKSDRKIVNVGKDLLATGTLAGDVLGQLPSVEVDGQNNISLRGDQNVKILVDGKVSPLPNDRLLQQIPSDAIAKVELINNPSAKYQAEGLSGIINIITKKSYRKGGRLNVNLGYGTGEEPRANAGVGFSYATDKIKVSANYNYNTGFFINESTAEEERETISFLSDSRMKQTFESPYYAKAGIDFYIDSTNTISAFVATNKFGFDVNSKSNIIQMSNINQTSTNLEFLANNGGGGKSTTYNLNYRKEFDGSMQYIETDANYSTSPFNFFSNRITTNDNFTETQNDDFNNMSRITTLSSDYYHNNNDRILEFGVRAELRDLDESQFRTITNTEVTDINTLYNYNDGIYAAYGVYDRKIGKFGIKLGLRLEHTNLKLRANESRLKNDYTNLFPSASFSYSTEKNHNFSLNYSRRISRPSFWIISNTTFQQDQFSQFTGNPELQPEFANKFEFNYSKNFNGTDFNASLFLTNKENTIRSVQTVSGNNVVYSFDNVGSSNLYGLELYSRFKPLKWWNATVNATYYLSYFSETGNMFLNDQSFSHNYSFNNTFRPFKGFNIQANLNVRPKNISLQAENQGVTTMSLAVSKDIFNNKANISLRANDIFNSGRTRSIGEVNGLTFNRSSFSPSSRHLYLSFRYNLSFGNKNYAQKERNRKRRQYTERQ

SEQ ID NO: 2052 - protein, 921 aa, Dokdonia donghaensis MED134
MRHRATDCRTKVLLSGTALLTGLLLCCPPPANAACNFPAPVGNDIYICDSGTSVGGLTDTGGNNTLLLPSAGTGTVAGNVTFGAGADRIEIYSGTINGAVVQGDGSDAFVISGGAVTGNVQQGSGVDDFRMTGGTIQSLNQGDNLDTFFMSDGRIIDAFDDGDVATMTGGRIGRVNMKLDDNVFDMSGGIIDRNLVTGFGNDTIILSGGTIGGNISVSGGTDSVTVTGGVVGGSVLLSFGNDRFNWNGSGIIYGAIDLGADDDTATLTNLANAHIGATTQISGGLGTDSLTMSNVKTGGVARFDSWETINLTNDTELVFDGTLTLGDSGTGTGTLTIDSASTVYGGGQNGRVSAFSAGAFANLVNSGRIDLTNGGGGASDTFTVSGNYVGNGGQIFLDTVLGTDGSASDKLVIDGGAASGSTGMNVVNAGGSGARTTADGIMVVQATNGATTAGGAFALNSRVAAGAYEYYLFKGGVSAGTQDNWYLRSTIVPGSGAVAGAPDPLQPNTTPEAEAPDITGAPPASQLPPTPLPTEGSSTTEPTDPTPPINAGDPQPVAPPTPQAAGTASPPPAPPVPPTTLAMIPSASAIPPTPGATRVIADIVPLYRVEVPTYSAVQPLAQYLALSTLGTFHERRGEQALLQGDGWMPTSWARTFGQNTEMKWDGTVSPSFDGNLFGLQAGQDLLGRETEAGGFDRFGLFVGYSRMNGDIKGQALGWNNLAVGEVDIGGTSFGAYWTHVGAQGWYLDAVLMGTWFSGDATSRAGESVNIDGSSVAASLEGGYPIALTEDWTLEPQAQIIWQKLSLDDEADRFSSVAFDSDNAVTGRLGVRLQGNYQTDSGLIQPYLKANIWHGFSSDQMTRFDNDPIVTETGGTSLEIGGGLVASLTEKVSVFATVDYTTNLGGERKRAIEGNIGLNIKW

SEQ ID NO: 2053 - protein, 209 aa, Dokdonia donghaensis MED134
MKTLIVTSLLALSASTAMAADAVYETPAPPVAQETLPVFTWSGPYLGIQGGAGWANGDFSAGGPVVSDDFNGGILGAFAGYNYQFDNNMVLGIEGDVDYNWNDNDYSGIKVGTDWQGSVRGRVGYAFDHALIYATAGWTATRGFIETPVGDDKATFNGYTVGAGVDYAFTDNVFGRLEYRYNDYGDKDIFGINTDFDQHTVKVGLGVKF

SEQ ID NO: 2054 - protein, 458 aa, Dokdonia donghaensis MED134
MKKTRIALAIATAAMVSTPVLATNGTNMIGLGAQSNAMGGTGVAASYGAETVIANPAMIGKTTGTEMTFGGTLFQPSVETTNNIKNSAVAAANGITSAQAAAAGAPIGSATSDADTNVIPAVSLSSRINDKLTFGIGMFGTSGMGVDYQDEDMLFNAQTNMQIMKFAPTLAFNSSKFGIGVSPILQYGSLDINYQTQMTNNSGAPMYVQGGGNINSTPSATPAMKTVGHGMASDLGMGYNIGGYFNITNDLTVAASYLSPINMKYKGQLSTASGAFVNPASDFTTPFSDNLEQPSEIKVGAEYIMGRFSVNADYKKVAWGSAKGYKDFGWEDQDVYSLGAKFATNNYWLGAGYNYGSNPIKEQDGTSYKGAVINMFNNTFFPAITESHFTFGGGYSITKHTTLEGSVVYAPEVENSVDTTAVSSAFASGMAGTPTAAASTSTTKHSQIGYTVQVKYNF

SEQ ID NO: 2055 - protein, 450 aa, Dokdonia donghaensis MED134
MKKVIKLSLVAAFSGTLLLNAADIDVGGKKAGTVDFMLKGMYVIDDNKNGWAPSEGAGYLVKLKYETPDNIVDNLKVGVGMYVNGDGGITDWTPNDGGKPAGGLVVDKDGKSKALMGELYVSYKSKYFDAKLGRQTLNTPLTKISASLMPNFYEAYMLGFNPVDGLRLTAGQITKMSMGSRAATDFGLIGEGTTTGGAATKFIQQGGVVEQAEFISMSRVAGLNGNSDGRTVIGATYSGVKNLKADLWAYHSDEIVNDYYAEVGYKILLDEEMAVSLNAQYLMQKDTGSSLAGQKDFNMMGAKIALDTKKWGIYAALNKSGDQKDAASEKGYFNAWGADPAYTSTIFSRNAYRDDVEAYILGGHYVIIKGMKFMVDYANYGKSDTKAANGALVAKDDAYEIDIALNYKYNENWLFRVFNSRRVSEYNGILSGGITERRQNHYRAVVAYTF

SEQ ID NO: 2056 - protein, 443 aa, Dokdonia donghaensis MED134
MNVKQPLIYTLSGSLALILSTNTSATSFQILEQSPAYLGQAFSGTASYVSDASSIFFNPAAIGELEGSHLTVAGNAIFTRAKFNDQNSNTNGAPGKTDETGFVPNLYWTYPVAERLTFGLGVNAPFGLSSKYRDDWAGRYLATYSNLELINVNAVAALDLGDYWALGIGLNYQRLDVTLESRVDSTLGINPQPATDSSARIKGDDDDLVADLSLYFKPSSYTRLGLVWRQGGEFDLSGDAKFSLNALCSPGAGYPTGVPPAPTTGTICAAMLNARAGDAKTSIALPDTLTFSISQALSERWWLHVDVARTEWSSLQSVNIINTGNNLTISELELKYKDTIRYAVGLSYHPGFAWTWRFGVAADEAPQTNPELLNPRIPDQDRIWFSTGFNYELSKNVSIDVGYAYIKVDKSRIENTELQTGHYVEGEFDASVNILGVQGNWRF

SEQ ID NO: 2057 - protein, 1015 aa, Dokdonia donghaensis MED134
MKTKFSGILALLLVLVVQLSFAQQKTVTGTVNDDSGLPLPGANVVIKGTNTGTQTDFDGNYSISASVGQTLLFTYVGFGDQEIPVTASNVINVDLVPGAALDQVVITGYSRKNQTTQTSAVVSISASEISELSPTTSVDNLLQGKAAGVQVTAANGKPGQGAFVRIRGTGSLTAGASSPLYLVDGAPIREEDLGGIANEDIENITILKDAATTARYGSRGANGVVVITTKGGKRNNDAQVRISSRTGYSERIAPNYDLMNAEQKLQYEAELNALGVNAAGPLPGVTTLPGSEERQFLLDNQTDWSDLILRNGFIQSNNFSVSGGADKVDYFFSAGHDRNTGIIDQLSGYERTNARLNLNIDAKEWLTIGVNVGYSRSSSDEPRDRNNMQNPFRAMADYNPYETEFVLDENGNVTYDESGNPIYSPTTTSFNVRGALLSEPSVDYNNNLLASATAAVRLSDHFTYNFSAALNGLTTRTDGYSKPGGILDSLIGDADNPGNKLDFGSYLSDMTISNSLSYNLNGEKNNLNILGLYEYNIAEARSYTVRSIGFPSALLSTQSNAAQVTDGSTTRSKLALVSYGLFADYDYDERYLASASARYDASSNFGDDEQYGLFYSVSAGWNIAKENFFDVDAVNDFKLRGAYGTVGNRSGISRYASQGTVGFGSYPGGSSTIPDNIANPLLQWETTTTTNVGLELNMFQNRLRFVTDYFIRDTEDLLFDVPRAAESGIFSVTDNLGKIQNKGLELSLSGDIIRGENLTWTVGGNIILLDTEIVELPDGEDVTPNAFNILYREGSKINEHYLVRYAGVDPATGRPQYLNAEGETVFSDEIDGDTDRVLQGKSTIADKEGGFYSNIRYKGFGLRTDFVFKTGNWINDQVQANLNSDGALIGANQATSAFNYWQNPGDTNVHPSPLYIDEVIASDRFLTKGDYLRLRNVTLSYNFDKAVMDKTFLSSLRIYVQGQNLLTFSDFYGDPEVGISSGETISFADSVAPGELTLYSYPNTKSYQIGVDIGL

SEQ ID NO: 2058 - protein, 179 aa, Dokdonia donghaensis MED134
MRLKTVFILLSLTLLSQAAVANDNIIGGSIGYGAQNFNLKYDANDGDTVPFDVYYRHMLSDYMGVEAGYTRSSDGILSDFASMLSTAYVSSYGGPRLSLYGQYPLSHGNALYAKVGVAYHDVAYTVKDVKHHESKVGGDLQVGWEKRFHNGMGINVGYQFAHSSILTMNNLYVGTSYRF

SEQ ID NO: 2059 - protein, 464 aa, Dokdonia donghaensis MED134
MKKLFKKLGFVSLAASGVLLGSMNATDLQTYAALQKPSHVFGNYAEKDKDSKLTSDSPTQQQAQTQAQNTASSGTPTPPTKEEPKHTASSGTPSTSGSSVASQLTKDTTMVNNLKSVSVSGMNTTLSGVETMSKQTATISNLLSGNPNLGSVIPNAQGLSSAFSALESAQNTLKGYLNSSSATIGQLTNGSNAVVGALDKAINQVDMALADLVTADTQKTQAVTLAAASDSATTTTDAINFLNALKTNLMAQKDAFMSVHKNIQTAVAQAQATYTPSVINTNNYGQMYGVDAMAGYKWFFGKTKRFGFRSYGYYSYNHANLSFVGSQLGIMEGASQVNNFTYGVGFDALYNFYESKEGYNTAGLFVGFGLGGDSFIVQGESYLKSQMHICNNTAGCSASMNTSYFQMPVEFGFRSNFSKHSGIEVGFKLPLFTNQFYKERGVDGSVDVFYKRNFSIYFNYMINF

SEQ ID NO: 2060 - protein, 206 aa, Dokdonia donghaensis MED134
MKRLFFTTAIAALLTAAPASAESGDWLVRLRAINVAPNESADIATIGGDVDIDTSVVPELDITYFVRDQWAVELILGVTPHDVTAVGTSLGDVDLGDVTLLPPTLTLQYHFNPQGQVRPYVGAGVNYTHFFDADLPAGSALTSIDYDASFGLAAQAGVDFALDDDWFVNVDVKYIDIDTDVTINGAIAADVQIDPVVFGIGLGRRF

SEQ ID NO: 2061 - protein, 680 aa, Dokdonia donghaensis MED134
MKNNVYFDHSTLLGDVEFSSHWNNDGEFFYSTGYDSNGDGVKDTNGGWIDDSQNVDELNITLDNGSKWIGSANITADAIAPANMYDVAYNSLTPGATIEANDWDRVIDNKVFQSGVFNVALNNGSEWDTVNSSIIDTLAVNNGSQVNVTDSTLVSDTIGLTNGSSMNIGEDGQVATDHLTIDSYSTVALNDDVTHYGDYSLYANTITVTNGGMLDVNVDQFDNGVFSTDKLELTSGNTADHNGNVVSGVFNIHSSDYVLNADLVNDRTWDTTQANYGYGTIAMNSDGHLTINGNGDINNGDELDNSSVDNVVAATGNYKVRIDNATGAGSVADYKGNELIYVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 2062 - protein, 476 aa, Dokdonia donghaensis MED134
MNSRAYDLLGKIDYWLDDNQHIQLSINRYHLKGKNDYVSVTGEREQGIPTTSVKGTPEGEAPFNSVWTTGVTYDNYDLAGMKFNALAYYQDYEALFGSTLSGTFQDPEIAPVGTLYDQSRAVTSKYGTKMSLIKDDLWDDRLKVTLGFDTLFDSSKQDLWGTHRTYVPEVKYTDLSPFVQLEVAPLESVKLFGGVRYEYARLKVDNYQTLAASNSVTVEGGEPSFNKTLYNIAAVWTPIEPLSLFANYSQGFSMPDVGRVLRGINLPGMSVDSFLNLQPIVTNNTEVGFRVEKAPVDLEVSYYKSTSKLGSRVVRQGDVFVAKRQRTEIDGVEAAAGYNLTENHRMKLSYSHMRGRYDSDGDGSLDAKLDGLNVSPDRIIASWSANWTPQWSSFVQANWALSRDFDEEDKDFSGYALVDAAVGYKLPGKRGQLSLAVSNLLDKQYITYYSQSALVKDDRYFAGRGRTLTLGYRIDF

SEQ ID NO: 2063 - protein, 837 aa, Dokdonia donghaensis MED134
MKYLLATAAIAPLLMFSSANAEALSADAKPAAEKAVQSAGGKASGEAVFSTGVAKGRDRLDSATSTSALRASEFETYGARSLGEVLRNIPGIRAEYAGGEGNANYSIRGLPLSGTGSKYVQLQEDGLPVLEFGDMLQFTSDMFMRSDLNLSQIETIRGGSASTFASNSPGGVINLISKTGDTEGGAVQGTYGLNYGEKRLDADYGGKISDTLRFHVGGFYRQGEGPRDVGYTAYKGGQIKANLTKTLENGYVRVYAKLMDDRTPSYQFVPIRVTGTNAYPTFSNPANFNVKTDSLLSPYTSNIVTLDANNNIARDDIREGQRSKVASVGLDSQIELNGWTISEKFRISKISGGVRQVRPIAVAPAAALAFVYGGVGGALSFATGPQVGQAIANPTALNGNGLMTSAVKIKSDIDSLDNITNDLRASRVWKVGEGNLTTTVGYYKSSQDYDSYWSFMNTLTDVNGDGQTSLINVRTATGVAATQDGMVAYGVGGALFHRTYDVTNSVDAPYASINYHIGKISVGGSLRYDMGKVDGTLYGAELGGSRVGVISRDMNSDGVISLAETKTAALPLGQPGRVDYDYNYLSYSTGVNYRVAEQLAVFARYSRGGRSSAEKLLFTPAVDYNTGKLVDADSAYDTVKQAELGLKYRISGVTFNVTGFSAKTGERNIQVVSGSDGTTDVLNIVRGYKAKGVELEAAVSKGPFSVTAGATYTDAKITSADQSATLIGNKPRHQADFIYSVTPQVELKNATVGFNVIGTTSSYAQDTNQLKLPGYKLVNAFVQIRPMENVQLMLNVNNVFNTLAMVDSEQAAIPASGVILGRAYAGRTASATLRYSF

SEQ ID NO: 2064 - protein, 544 aa, Polaribacter sp. MED152
MSVRGKLMKHSVSVTCCALLVSSISLSYAAEVPSGTVLAEKQELVRHIKDEPASLDPAKAVGLPEIQVIRDLFEGLVNQNEKGEIVPGVATQWKSNDNRIWTFTLRDNAKWADGTPVTAQDFVYSWQRLVDPKTLSPFAWFAALAGINNAQAIIDGKATPDQLGVTAVDAHTLKIQLDKPLPWFVNLTANFAFFPVQKANVESGKEWTKPGNLIGNGAYVLKERVVNEKLVVVPNTHYWDNAKTVLQKVTFLPINQESAATKRYLAGDIDITESFPKNMYQKLLKDIPGQVYTPPQLGTYYYAFNTQKGPTADQRVRLALSMTIDRRLMTEKVLGTGEKPAWHFTPDVTAGFTPEPSPFEQMSQEELNAQAKTLLSAAGYGPQKPLKLTLLYNTSENHQKIAIAVASMWKKNLGVDVKLQNQEWKTYIDSRNTGNFDVIRASWVGDYNEPSTFLTLLTSTHSGNISRFNNPAYDKVLAQASTENTVKARNADYNAAEKILMEQAPIAPIYQYTNGRLIKPWLKGYPINNPEDVAYSRTMYIVKH

SEQ ID NO: 2065 - protein, 1024 aa, Polaribacter sp. MED152
MWNTAFGARLRRAALLSATMLSGLIAVEAHAQTTPAPAADDTVDAIVVTGYRKSLAQSTVAKRESTGFADAIFAEDIGKFPDSNIAESFNRIPGITITRDITGEGANVAIRGLGSNFTNVTLNGASIAVASSGVTDAQGTDRSVDLSFFPTDLFTKLTVNKSYSASLLEGGAAGNIDMRSARPFDRPGQSLTMNVQGVKADGAGVGGKGSLIASKTWDTFGVLFGISGQRLKTDTRGYETIGYTNPNLSAAQCGATSGCNPTGGGNWTIPGTVPVGAGGGLVAGTVIDRAFLLANNPGATIQQIDNGLLPRIGRPSASYGNRDRINLVGSLEWRPNDNVNFYVDGMYGYKKTDLVREDIMWIVRNGAVIPLNTKYDKADCSAGCTVTSGAYANSNFFLEFRPYLEKTELWGINPGGEWRINDTLKFEAQANYTKSNFHRESPTFGPVTALGVGTTVEYTANPTGIPTIKSSVDLNNPANFIWTGGRVNMQDEKRWYETKGARAALTWGDEALNLKVGANYDDISRTIRGYDNSQAWQNATCGNNPSIFLPSPNSQPGCQGLNQPGAAPAGYPTYPGYGTGFTAGQTGTLTYGGSLIPTAGLSGYLKPGPAGFVTVDWDKVKQATKYDQFHDNTPESGGSNTGASGGYINEKNSAAYTELNGVTQVLDSDLRFNVGVRYVRTKQTIGGRVSVADPRNAPASGALPDGARYPNITNFVYTENTYSKWLPAASIAYDVGERAVARAAVSETMTRPDPSAQLPGVSFGAPSADQATIGNSALEPYFSKNIDLGFEFYTGQEGVVAVNAFRKSITGFTQNQVTTQPFSFLAQYGITYDTLNDTQKTAVNSRGGPTQAQVQVQSQINVPNKLTINGLEFQWVQPLDFLTSRFGVEGLGVNANATIVDQTSNGPATALGVAKYTYNLTGYYEHNGISLRVSHVYRKGSQVSGLNQNGIAAAALFSDDYKQTDFSSTYDLGKIFGLNNAPQVTFNVTNLTNESLRSYFQYDNATFTYYKPGRTYVLGLRMSF

SEQ ID NO: 2066 - protein, 1087 aa, Polaribacter sp. MED152
MLLFAAIFCLHAENAISQKITLQGDNLSVKDYLNTIEKQTDYLFIYDAGVNVNKRISVNMVGKSIKEVLDNLSTQLGLNYSQKGSYIVLSSYKAKETSAPVIAQQKKTITGVVTDDLGEPIIGANVIEKGTTNGIITDIDGKFTLEVAPGAVVQVSYIGYNTQEVKVGNQSTLAIQLVEDTQALSEVVVVGYGVQRKVTTTGAVTKLEGDEINKMTVVNATKALQGLSPGITVVDRGGAPGSDDPEIYLRGVGTTGNAKPLVLVDGIEMSLSQIPSSEIENISVLKDAASASIYGSRAAHGVILVTTKRGKEGKVKLSYDGTIGFQDRAVRAEQVSAREYMTMVNEALVNSGGSIKYSEDDILATERGDDPYNHSYLNWANEVYKPTYITQHTLNLTGGSEVGRYLVSFDYLDQPGLVKNTEYQRYSYRVNTDLNIGKMLKVSSDVTYRHVDRLWPESLGSVQYDVWSMQPTSPVRYENGDYRLDKQNRNAISLMDLDVVGEDRYNMDVVYGQVKADFEPIKDLVFTGMASLNGSWDRRKIHYKNYKYYNETGELVTQRNNPNSVKDSRNNSYQMTLRFLANYKKRFGDDHDLALLYGMEQISYRNYYSMAQRKDLISDALPDVSLGSAGSQFAEGYPTKWGINSFFGRVNYGFKDKYLFEANIRTDGSSRFAKGHKWGVFPSFSAAWRISEEGFMKNLGFVDNLKLRASWGQTGNERIDAFMYLPQYNTSNVVMNGSLVSAVYQKKMANPDVTWETVEQTNIGLDFGFLNNTIYGELDWYSKDTKDILLALGIPHFIGLDAPEQNAGVVRNSGVEAMVGFRKTFGEFTFNTSFNLAYNKNEWIDRGGDDKNISGYNIQTIGSPLNAFYIYQADGLIANEQELEEYRAKYKSDPRGMSDLHAGDVKLVDTNNDGTIDPDDRQIFASNIPKFTYGWNISGEYKGFDLSLLFQGSSGANRMMYGEWIEGPSYEAFTGVHFRDRWTEENQNGNAEMPRLEAANNRNASTYNSFFLKKTNYLRLKNAQLGYTFSKDIRDKLRITKLRLYVSGSNLLTFSSLYQGLDPEGKSDRINDFPPLKIVNFGVNIIF

SEQ ID NO: 2067 - protein, 384 aa, Polaribacter sp. MED152
MKFLLTGASALALSATALHAGGIERTQQSAMILYETGNVLEFSLGYANPSLSGKNISPPFPAQDIDDVGDGFWLPSFSIKYDVNDRLALALIYDRPFGADIAYESGNIPLGGTTAEANTNTLTALAKYQFNQNWSAFGGLRFQQAQGDIHLQGAAYGAVSGYEVNLDKTNGIGYVLGAAYEVPEIALRVALTYNSSITHDMDTTESGPLVDPDGPGPIPALPLLNASGETEVKTPESWNLEFQTGIAKDTLLFGGVRYVKHSQFRVDPDSFETVVGNGLIDLEDSTAYTLGVGRRFNEKFSAAISATYEASGDELVSPLAPKTGYTQLRLAGSYNVTEDVTVSGGVSYFWLGDAKPETGTPDVARADFEDNSAWGVGLKVAYRF

SEQ ID NO: 2068 - protein, 755 aa, Polaribacter sp. MED152
MKNHHLALSVLSLCVSQQLYAQTEAGAAANNNPSVDISESIQTQQQAAPQAEFEAIVVKSKAKTGTALAQKISEMPSVTQIIPEKDIQAQAVGSRTTGDILAQLIPSLGTSSGSTSNYATTMHGRPVQFLLNGVPLTGSRNLSRELNSIDPAQLERVEVLSGATSIYGAGAAGGLINLVTKSTQGVGLQHQTRLGLSSARDFDSDSLGYSVGQSLAYGGEQMWGRLDVDYEEKGGEFDSHGHRISPDVNQTDQQDTKSLSVNANIGANIGQSQSVDLAVTYYNDEQETDYGNNLGVLLKGKTPSLRAVKGAHLDQEPMTRKTSVNLNYNNSDFAKSNLSITGYYRDEKGRFYPSGKQVGKAVIVAQSEADIEVAGVRAAMQTEFDIKDMPTLISYGADYEREKSEQTYYGQDLDKFIASNGLIAESNGHTYAGGPDTTTDKIGAFVNADIDLSDKWHTSAGIRYQKLKSDTDSFTPLAEQVLQEYFNQPAGKVAPGKTNHSKTLFNIGTSYQITPNDQIFANFSQGFTTADIQRALRDVPSGFVVNSDNVQPIEVDNYELGWSGIHGNTRAKLSGFYNESDKTVRFNDDYTVEVVDTDERVYGAEASISQKLDDNWQLGGSLAYTRGQYKSQGDWLELGADRLTPIKGTAYAQYNFDKGSNIRLQVLAIDGTDRAHKDQQKDNDTKTNANAISGYATFDLLGQMQLGQGKGRIDYGIYNLLNKEHINVYHQATYGDMNRLPSQGTTYGISYTIDY

SEQ ID NO: 2069 - protein, 790 aa, Polaribacter sp. MED152
MKFLLTSTLFFFGILTCIAQNNINGKIVDEQNQPLPFANVVLYNADKAENPKGTVSKDDGTYILENIADGNYTLEVSMLGFETEKIDKFSLSSNKTFNITLKETSQSLNEVIVKSKRPVIKQTAEKLIVDLEQSEMINTSLQDVMRKVPGVLVTNNGITIAGNSGVRILINGKTTEYMDVETLLRDFPADNISKIEVVEQPGAEYQASGSAAIINIILKKNVKLGTHGSVNSWIGEDQGFEWGSGFSIASYKNKLNWQTSVGYSQPTFREDLFLVRTVGNETYDQTTREPYDPDNFRISGSLDYYINDKNSIGLGTSFNTRNSTRIASSETIISDANNTNTLFSENSFDRERKNYSINPYYEYKTDTDRLLIDFNYLDFVNDNTNTLYDVAGSTIPFTDRRYIQDGTYNIKTYSIDYSKQFTDNFKLSLGSRFADVATNNDLQSLIANNSGGFDFVEDESSQFLIDETIFAIYSKINATSGKWSFSGGLRYEDSNTDGTSIFMDNGNLRTEILERPIKKLFPSASISRKITDVLGASVSYSYRIQRPSYNSLNSFATFLDPFSAGEGNPFLTPSYTNNYQFNLTYEGQPFFTIGYSKTDDVIFQLIRQDNDTAQIRQQEVNVENNTNWNFRLFAPLNLTDGLEGYTGIIVTNTDFQSSTYGVDLNKWNLIWFVQASYELPWDVTFEVNGNYGTGALEGQIEVDWLAELNFSFGKSFLNKKLKANLGFNKMLNRGFVGNIDYGNGTAAVESNGSRQNIQFRLTYSFGDQFGKKKASRNRNRDEENRINADN

SEQ ID NO: 2070 - protein, 411 aa, Polaribacter sp. MED152
MMKNFNKTLLAIAVTLASSQAMAAGFQLNSQSATGLGRAFAGDAVIADNASAMARNPAAMALFDTTSISVGMTYINTDVTLSDAQYSLAPMGSSNPQAIPDVSDIGGASLVPNIFIVHPLNDKWAVGFGTYSNFGTTTEYPDDFAAELFGGTTKVRSVNIQASVSYRINEQFSLGAGIDVIKGSGNLQREFMGNTILDVDAEGYGIGWHVGAIYEVNENHRFGLSYRYSPTIKAEGDFQYLGQSAADDTLHLPLPAMAEFSGFHQLTNQFALHYSAQFIQWSAFETLDTDEFGTIKEYNWRDTWHLSLGGTYTINDTWTARAGYMYDMGAIDQIKSIAIPDSDRQWFSAGLTYSLNKHSDIDLGITYLMGEDVNVTETQYLPPSDMPFVAQINGTTRANAWLYGIQYSYKF

SEQ ID NO: 2071 - protein, 236 aa, Polaribacter sp. MED152
MKLKLITLAVAAAAVSVISFSSVATTIDYRHEMKDTSKSDHKDRLLISNRFANGFGLSLEGKWGQHSSDTTPNKPFNEQVSNGTEMVASYVYKFNNTFQIEPGFSLDSTSDSNNYRPYIRGKVAFTDDFSTSLRYRPYYKRNQPAQTKSTEKGHEFTMLFAYNFLKDYSAEYELNYKKSEDEILANKEKYEWAHDVKIAYKWDKNWKPYMAIGNVPGSKVTDERQTRYRVGIQYSF

SEQ ID NO: 2072 - protein, 722 aa, Polaribacter sp. MED152
MYAPCPSLLSRRPLALALALCITLPALAQQQPDGAAVQLDAVNVRGERADAATTLSGFGATSLLDAPASIAVIERQQLLDRQARVLSEVLRADASAGDAYAPIGYYENFVLRGYSLNAANSYRINGLSAVGEQSIALENKQQVQILKGLAGLQSGVNEPAGLIDYRTKRPEHVRSVTLGTDEQGSRYIAADLGDWFDADRTLGVRVNAAREDFRSYVDHADGYRNFLSLAGDWKPTAQSLLQVDVEYQHRQQRSVPGYQLLGGTQVPRNIDVHRLLGYQPWSRPVEMDSLNAQLRYTYQFNEVWRASVEASRSRSTINDFSAFAWGCYGAASCADIATPNFFSAQGEYDVYDYRSPDDTRVHDQLRASLDGRVTTGALDHQLSIGADWLRRTIDRYGSVNEFVGSGSIDRDPEVFAQTDVALDPKQRRLDSRQRALVVADRIGFGSQWELSLGARYVRLDERAFDRDGVLERRTRKDALLPQAALLFKPQQQVTVYASYAKSLAAGGTAPWFADNADEILTPTNAYQLETGAKWQLQGVRLGAAVFDIRQAYQFTQPQADGGLLYVQQGRLHNRGLELSADGAVTGQLQLFASVAAIRARAEDTGIAAYEGHQAINVPKLRASVQADYRVPGIDGLALLAGVQYSGRKFADRLGSASVPAYAVPNLGTRYATTLGGLATTWRLNVDNVFDKRYWRDAGEYQGDAYLFPGAPRTARLTVQVDF

SEQ ID NO: 2073 - protein, 341 aa, Polaribacter sp. MED152
MKKTIMGLSVIASACAFNSAYAQSSVTLYGVIDNGIEYRNSAAGTVLRAVSGGLFASRYGLKGSEDIGGGLHVNFQLEQGFSGVTGAASNSAAAFNRQAWVGLSGAFGETRFGLQNTPQYIFINPELDPVAVMSIGSPMNNFNSLTVRVNNAISYFTPTVYGLSAQFMVAMRDSTTKPTNGFQFYNAALRYENGPFRIAAGYEQAANAAGTSTLKLFNAGASVAVGAARFYLAYHTEHQTDNSIKRDVYEASGSYAFSPAAQFSVMYGYAHDRTGQGNNAQQVGLTYAYSLSKRTTLYGSAGFIQNRNQARFTLNGTGYTGLAVAPGADTRGAIIGMVHRF

SEQ ID NO: 2074 - protein, 373 aa, Polaribacter sp. MED152
MKQTTRLAVIAGGAALAFASQYAAAQSSVTLWGVADASIRYLTNANAKNDGLLSMTNGAITNSRFGIYGTEDLGGGLKAVFNLESGVNLQNGAFADSGRLFNRAAYVGLQSPYGTVTLGRQKTPLFDLLSDTYDPLTVGNYLENAWLPVALGGGLYADNQIKYTGKFEGLTAKAMYSTGTNYESTGAGGFSGQIPGSLGKGNAWGVSLSYVMGPLSIAAGAQQNSDNSARKQTIYHANVVYAFSKAKIYAGYLRSKDDTGFVDSLLAQQSIPVAKGTGRIDDGPFAGVSWQVSAPLTLTGAFYYDHMRNAMTTNGTLASGNRYAIVGIAEYALSKRTEIYGTVDFNKTNGAANVELPGRSNQTGIAIGLRNIF

SEQ ID NO: 2075 - protein, 348 aa, Polaribacter sp. MED152
MKKILFGSTMLVAVGALTGTAVAADPISLSLGGKQEQYFGGVSTFKDGNREDGFGVDTDTEVYFKGSTTLDNGITVAAMIQLEAEADNAVNADEQYVTVSGAFGKIQAGQKEGAFDQLTVYAPVVGWVSLNDTADWLGYAGTSSFARGSNYYNLDQTLNDDDAKISYFTPKFYGFSAGASYTPQPGGSLVPATKKNRDLAQFGIGYDNKFGDIGVKASATAATQSNFWIYQGGLSANYAGFTLGGTYTEIDDESASSGTVYSTAPSSEGRLWSAGLSYATGPYSVGFAYAQTNHKSGGDNAIYKLGADYKMGPGISLVGNVFYGENDSNTAAGSREGVGAVTGIVLAF

SEQ ID NO: 2076 - protein, 841 aa, Polaribacter sp. MED152
MKNFIYLSLFFSFLAFSSVNAQTTTASKNAPARIVGVAKDNATGEPVPYATAALYKTGTEENIAGAVADDEGKFFITGMKTGDYTLKISFLGFETKAVNVSVASPTGDVNLGEILMTDEGVALEEVTVQGQRELIEERVDRTIYKAENDKTTAGGDGTDVLRRVPMLSVDLDGNVSMRGSSNITVLIDNRPSAIAASSITDALKQIPADEIKAVEVITSPSARFDAEGTSGVINIVTKKNNLQGMSLNIRTGTGLRGSDLGLNASARKGKLGFTLGGFGRSGYNILGGFENKQVVTNPDNSTSTILQSADTERTHLFGRYNFGVDYEIDKYNFLTGAVNFGIRNSKNAQENFLTERYLEGNLVSNLLRKTNSKDNSNSMDLSLNYTRTFEKKGKEISLLTLYTRDNRESSFINSLYSDDFQTIDSRLKNDNPSKNEEYTIQLDFVEPLGKEGNSILEYGAKNILRKAVSDFTYYEAMGEDGEYVESDNPSLTNAFNYDQNVTAGYVSYTTTLFKNYTIKPGFRYEYTTINADFKTEAAADIPSYGTLVPSLNLSRKLKNGNLIKAAYNRRISRPSLRYLNPNLDVSNPTQWSQGNPTLDPEFTDNYELGYSTYFKETMLNFTGFYRNTTGSIQAVRTVQDNGVIFTTFDNIGQEKAIGGSIFTNINISSKFSLNGSIETYYSMLDNGLTDPQYAASNQGFVVSGRMFGNYTLPKDWQIQLFTFARGSRVQLQGTSGGFAAYGLGINKQFNEKRGSIGFGADNFLTKEFKMRNKIVTPTIVQNSTNVMRNMNFKINFSYRIGKLSVDQRQRRKKSVNNDDLKGGDGGDMNQGGGVGVSNNNK

SEQ ID NO: 2077 - protein, 761 aa, Polaribacter sp. MED152
MGAQTIAAALAFGGGAVMAQESVEKCEDATSAECKAASDEAIELIRIHGVQQSIYRYNKSGDPRRLADLVDTPQTISVLTQDQIQESGRTDLKDILQAQAGVTLGTGENGNAFGDRYIIRGHEARSDVFVDGLRDPGMTTRESFATERVEITKGPSSTFAGRGSSGGAVNSITKKASTAYNFGRVDAAVGTDEHMRLTVDLNKTLSETSAVRLNGLYSSEDKPGREGIERDREGVQLSYVNQPTDRLSFTGDLYYLNAEDIPDLGSYYDRDAGYPLEDIPVYAQDEDFQNSEVTTFTLRTEYDISDNVRFYNATRVGKTENEYITTGMRGTNRDATDPTAPGAYTLSLSNHQGWQEVDYVTTQFNLFWDTAFAGVDHRFVFGFEYTDESVDNGVFNMDYTNPSNCLTSGRRGVSESYCLLDGSGNEVENISGLMGKAFTRGDADALFDIETYSLYVMDTFELTDDLNVFAGLRVDSYDYTNATSGRSGDQLYAFEDELYNGHLGLVYDVTENGNIYASYSTATNINGGESDLGANCGYGGICGTPEQASQADPEQVENIELGTKWSLFDEKLVANAALFRITKSDVHESVGDAYSTLGTLNTGENRVEGIEFGLSGDITDKLSIQASAAFMDSEVLKSYSEDNLGLALSNFADESFYIQMRYQPNEKFAFGGDYSYQSEMYGGQPDTAAGYSAETGEYSIVVPDYQVVNLFANYYHSESLTFRVNIGNLFDEEYWTAAYRSGAFMYIGDGRNITGTVSYEF

SEQ ID NO: 2078 - protein, 824 aa, Polaribacter sp. MED152
MKHNILWGIILLVASLSFTAKAQKVVQGQFSVKGILLDSLSNEGEPYSTIRISLKNNPAKPVKLAVTGADGRFDERLAVPGTYLIHFTSVGKSPVQKEFSISTNRKNVDLGKILIAEATEMLKGVEVVAQKPLVKAEIDKVTYSIEDDPDSKTNTTLEMLRKVPLVTVDGEDKIQVNGSSKFKVHVNGKPNNMMSNNPTEVLRSMPANSIKSIEVITEPGAKYDAEGVAGILNIITIGAGMEGYTVTLNGGASNTRVYGGGYGTVQSGKFTVTGNYSYNYQGSQKGFEDSYREDFTSQENKFLESHRRSKSYGNFQFGSLEGSYEIDTLNLISFSMNLMTGNFTNKRIGNTHMTNYAGNPVYGYGSLGNNESGFGEVGGNMDYQHSFKKKGELLTFSYRFSHSPNNSEANTDYEDTLNVPYLLQNQYFKNDASTQEHTAQLDYTNPINSIHSIETGIKYIFRRSKSDGKYYLADKTGEYKYDQDMSTQYDHKQDILAAYLGYQMKYKKLGGKAGIRYEHTFMDADYKNKDEKFDAQFDDLVPSLMFSYQLAPTQSLRASYNMRISRPGIWFLNPFTDTSNPTAISYGNPDLESEKAHSLSVTFGSFSQKFNVNVSANYSFVNNGIEQYSFIKDGVMNSTYDNIGKSKNINLSLFLNWNMSPKTRFNINGRGAYVDYRSSGLDLKNHGWEGNLFGSFQQTLPWDLRLSLNGGGGTPHISLQGKSSSFYYYAIGFSRSFLKEKRLTISLNSSNLFNKYITFKNNINTSTFCSSTSTRIPMRYYGFNISWRFGELKAQVKKAARSINNDDLKSGGGNAGTGGGIPAN

SEQ ID NO: 2079 - protein, 1377 aa, Polaribacter sp. MED152
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLGKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 2080 - protein, 745 aa, Polaribacter sp. MED152
MWIGRKSGRSRLIASVIGIFAPLASVHSQETREVVQAQPPLPALDFSAKPSSDGVTIAGRSAAESIQLDAVDVQGPGAGEGADRDAKGYVATDSAAATKTDTPLIEVPQSVSIVTQQQMQDRNVQTVTEAVNYTAGVETGMFGFDPRFDSFYIRGFDMTYTGVFRDGLREPAGSFSIYRNEPYGLQSIAVVRGPTSALYGLGSPGGLIDLISKRPPSTSLREAEFQIGNFERYQGQFDFGGPLDPQGIYSYRLTGLVRNSGTQLLDAPDNRYFIAPAFSFHPDAATSLTILTAFQNQLTTGNPGFYQTPGGQLTNIYSGDPAFQNFNQTQFRIGYIFEHAFNEAVTFRQNARYSYVFADVRYTQIDFVDPETYNASRSTGRVIDHLNTFGADNQALVKFNTGPVSHFVLFGFEYTNSAFSDKTGFGWAPDLNLAAPQPNYGGQFIPSPLFTYNTYQSQQDMAVYLQDQIKFGPFVLTLSGRNDWVSTRTDDVIGATSTVQNDEASTGRVGLTYLSPIGLAPYVSYATAFTPTLGTGANGAAFGPVTGDQKEVGVKYQPPGINGLITASLFDIHQFNSLSMDPNNQAFQIQTGEIRSRGFELEGVLNPLPALNVTLAYTYLDQKILDGDADTIGKSPSGIPAQSFSVWGDYTLQPDTFAPGLGGGFGMRFIGQSYGNDQNTMINPQTTLFDAALHYDFANLDRSLAGVRLQVNATNLFNTKYQVSQAGFGYWGQDRTIVASLRYRW

SEQ ID NO: 2081 - protein, 827 aa, Polaribacter sp. MED152
MKFRILSATAVAALGVSGQLSAFADAPDAEDSRRLEVVTVTTQKTEQSLIDVPINISVTDQDLIDKLGGDDIEDLANFIPGLQVQAQSLNAPTYSLRGVVADGGAPRVAIFQNGVSIGTPGYATSIAIYDVERVEVVKGPQATLFGQGALIGGINYIQNRASTEGNEGKVTVEGGDYSFLRGEGFYNFALSDTLAVRVAGQIKNMDGYVPNTANSPDLMGQDTTAVRGAIHWEPTPAVTADVFVNYQEDDSTGTQFTSGFFPVNGVVDPYGPTAMNINADQVRSKLGNDREILAGTANLEFVLNDAWTLTSLTDYRELSSNEAWDSDGAAFNLLQFYQTREGDALSQELRVNYDNGGKLTGFFGANYFDYETRDTLTFSTDEAYAQSLFGPQVAASVGGMANARRILALAGAPGAANFGSFETPFQYSVAQILAQYGAQAANNIAEADMVFGPFLALNPAHAERSRTSDGRTSYDLFGDITYDLTDRLTLTGGLRYTINELSASNTGEVLRGNPALGGALNGVTFAPGFLINAATIGNPVNASAEPDGAFTWRLNAAYRVSDNVNTWVSYGRGRRPETLSISGRNVSEIDAETLDNVEAGMFGRFFDDRLQMTTSVYYGQYENFQTSRFDPINGVFIVENSGNATQYGLEFDGQALVTDNIRLLGTYAYNFSEYDDEDSNGNPLQFAGNRFRMSPEQSFSLAADITLPFAEHGTFSLTPSYIWKGQQYFEDDNGYDYAADGNGGFVRRRETYPDGTPVVEETGAYGLVNLRAGFDSADERWGVYVLGENLLDEEYLIDVGNTGGAFGLHTIIRGKPQMLKAGAYVKF

SEQ ID NO: 2082 - protein, 602 aa, Polaribacter sp. MED152
LGDITFDGNKIITTSRSSSTVKRNSISLGSGGKFTKLNAKEGFGIFFYDPIANTGDTNTEIELNKAEGGSTTYTGKIVFSGEKLSDEEKKVADNLKSYFTQPLKIGAGSLVLKDGVTLEAKKVSQTDGSTVVMDLGTTLQTSSSGETITLTNLDINVASLGGGGVAPDPAKVEAQASGKTVTINAVNLVDTDGNAYEYPILATSQPFTAIIAKAGSSGTTTTPTDNLKNYTPPTHYGYQGNWTVTWKLGTSAQEETATLTWEQTDYSPNPERQGPLVPNTLWGSFSDIRAIQNLIDISVNGADYRRGFWVSGLGNFLHKSGSNTKRKFRHHSAGYALGVYAQTSTEDVFSAAFCQLFGKDKDYFVSKNSSNIYAGSIYYQHISYWNAWQNLLQSTIGAEAPLVLNAQLTYCHASNNMKTNMTNTYVPKNVTLSEIKGDWGNDCFGVEFGAMAPIETPSSFLFDRYSPFLQLQLVHAHQDDFKENNSDQGRYFESSNLTNLSMPIGIKFERFAYNDVASYHLTAAYAPDIVRSNPDCTASLLVSPTSAVWVTKANNLARSAFMLQAGNYLALSHNMELFSQFGFEIRGSSRTYNVDLGSKIQF

SEQ ID NO: 2083 - protein, 151 aa, Polaribacter sp. MED152
MKNKLLFMMLTILGAPGIAAAAGYDLANSEYNFAVNELSKSSFNQAAIIGQAGTNNSAQLRQGGSKLLAVVAQEGSSNRAKIDQTGDYNLAYIDQAGSANDASISQGAYGNTAMIIQKGSGNKANITQYGTQKTAIVVQRQSQMAIRVTQR

SEQ ID NO: 2084 - protein, 1161 aa, Polaribacter sp. MED152
MKKFLFPLQCCAVLSSPSLFASDLFVTLEKSYNIINLQKAKEQNPAIDGSNVVVGVVDSLFNPEHPSLQGKAIEIGGYKNFDDIYKNDAGSIGSAQKDNATFRHGTHVAGILLGKNLGRTFSIEGDGDPYGVAPNAKFYGAAFKESSNFNYWGLNLFDFFSKDPKLHIVNHSWGYKVFPYEQNISNYEQALKTVESNDPYNGYNNKNEVERIVKLAKERKVLNVFGSGNDGKNSASLFELLPRYDEDIRSFIAVGMLDADGIDIASDGKIIIKEKRVNQLSSGGERTLTLQGIHKYSNGFLGSQAYSLMAPGSKIDSANALFDVHNKLGRQQQEEFIPLTGTSQAAPMVSGAAALVAQKFPFLNGKQIADVLLSTANQNYTLPKVIIKQKPNYDAFSVIYIDQDIPKDEAQIRQDIAELGYSDTPDKDKVTLNKILTNKTLYSLKREDLMGQGILDVQKALNGVATLDANRLNLGDIQSPTGKTEAYYVIDTQGQNGEFANNIEQKMWDDSLHLATAKNSPAEQMRGLNVGFIKQGLGQLSFRGSNSYKGATLVRGGELRLKSGSALSESSVFVEQDGTLSGSGTIANNLDNKGTVIAGSDDIATLTVGKNYTHHGTAKLVLNFNTQGNSKLVAQNYDIKGGKLLYRPLSGQFYAAGQKVQIDLGSLANSLNRFESVEILSNGSTEFKIADFKLASNRTVINDDTIEEKPVTEPQPSDTAKEESSSEAASTEQPNTEVKPNDTAKEESSSETVSTEQLNNIEKEKEKAEAIPAQEGTLIAEVKVKKEAFHIPNSDVGEAVYTARTSTELSQAYQDFFVKLDNTANRQAVLNSIAEDHLPDMLNDSTIKTTHFAQQNLLFSLTPNYFVQRFNTNGIKKLVGGEDLFLSKLAKNNLAQEKYMFYLTPSYHITQADKFRANSHGLRMGVATNIDNKQQLAMSLNYERGKGTFHSANARSKVFNVALNYVSHFDHFKLLSGINWGGSQNHYEKQIVGERENITGSYQNRFASAQLGVAKSYKRENVTLLPLTYFNYDFVHQNAFNESGRIFTKSYDSVNYHSTAMGAGLLLNYATTLDNAQIQFNSYAIYQHRLSGRNYCNNAKFSDIANSHFTQTYRLNPSLLTLGLSSQVNFSNGFFAQLALESALTPNQKTRNILATLGYQF

SEQ ID NO: 2085 - protein, 374 aa, Polaribacter sp. MED152
MTKKIIAMAIAAIASSAAFAQTNVTIYGNMDMGYMHRSGGSGAVTGANSKKQSALESAASESYIGFKGAEDLGNGMKAVFDLQMLVDPDVSSTFSTGRSYLGLAGGFGTVVAGYLDGLRYGIYGKYNPFGNYSVGNFASMTTQYDRAANALAYISPSFSGFTLILATSTNTQTEEGALNGVHVPAKTPGGNKGDDRLFSANLIYANGPLSVDLDYETTQAVGYSSGRLFVLTTGASYDFGVVKVSGVYDVIKGDKNSLIGGNIDLGGFNLGGLGTDEKYDRRNWFVGVQVPLNERARLLASYGQVKDKTLSDADASKWAIGARYALSKRTELYADYAQIRNESNAAFTINPKGNSQGLSGVGTRGIAVGMKHSF

SEQ ID NO: 2086 - protein, 1809 aa, Polaribacter sp. MED152
MKQLFILAHLFLLVLINRAEAETFYLQAYLHQLVTASGTPIDDVAENIRTPIGFDFQFFGKTVDHFTLTSNGVIGLRKGAIGAPGADIAMVNDYYDNVPLSQLSLTGSGQDSYNLYVFWDDLVSKDAKQHVTSLLVPHDDPSNVFGTDILTIQYSNYGFFGQTLGLGTIQVVLVSQTNEIYYNYVDLPNERSKASQATIGMTGGTEFVQTSHNSSILNRLQNIKYTPNGNNYDAVGPNPGIIYNGVLYVSSPPPGPFSLTAPAADATAQAILPTFSWSASENVATYKLVVASDINLNTIVYQNNAIDGALTSFTLPSGNTLQANQTYHWNLQAINAEGELWSVTRQFTTTQVNQPPVIQNTPATSVLQNNAYSYQTTITDPDAGDTHTFSITNKPSWATFSNTGLLSGTPANAHVGSYNNIEITVTDNNGASTSTGGFTITVVNVNDAPAISGTPVTSILEDNNYQFIPDASDVDSGDTLTFSISNKPAWATFNTANGQLSGTPINNHVGFTDNIIIAVTDGQLSDQLPAFSITVSNTNDAPSIFGQPSTQINEDSYYQFTPSAFDEDVGDSLTFSITNKPNWASFNSLTGELYGTPLNKDVGTYNNIIISANDASSSASLPVFAITVSNVNDAPTISGTPSTSVNEDSGYQFTPSAYDDDIGDVLTFSITNKPNWAQFDSKTGQLFGTPTNEDVATTIDIAISVSDSIETARLPLFSLTVNNVNDKPTSEDLSITVDEDQSVTFTPIGNDVDKDSLTFEVIQQPLYGTLIHTAQQWIYTPNKDFHGLDSIIYHALDNETASDDSTITIKVNPINDAPIATDDTISMQSNALARYELDVVPNDIDVDGDLLTLASVISDIGNVSIEENKIIYRALTGTPNQINIKYSITDTEKQISMANVLLTIEDEQNNTSPILSAPADVIVNATGLLTKVDLGVATATDSEGNPIAVSLIKGNTHFKPGIHSAFWQAIDSQNRQTIVEQKITVNPLISIDKDITITEGTSHQIALHLNGKPSSYPFSVSYKIGGTASSSDHTLFDGEVLFNQSPTAYLTLETFEDAIAEESETVIITLDDNQNVSSNYQQTITIVEQNLPPHIDFKVTQANQQRNLIVNNNDIVNIDSHVTDLNPFDIVTLRWQANSTEIINTSEQGDVFTFNPENLLPGIYSIELIATDNADSPLTSKKTIYLEVTTELAVLTQRDSDGDLIPDNLEGFKDSDQDGVPDYLDAISECNVMQEQALQANSYLVESEPGICMRKGSTIANSKTGGIELLSNELPADMAADNLGGIFDFILEGLPKPGGSYRLVLPQINAIPANATYRKLINSQWTDFVIDEFNSIHSTAGEPGYCPTPGDSEWQEGLIEGAWCVQLTIQDGGKNDADGIVNGTIVDPSGVAVYHSDNKQPIASPDKIEINWNSNVMIDVLANDTDENDDPLILSAASADFGQVTIVDNWLYYQAAKDFYGTATIQYSISDSNGGTSSTTVLVGINANFAPIAHPDVANTDDKTVITIYVLDNDVDPENQTLSITSVSTQQGTAVINSDQSIRYTPKRGFDGIDAISYTISDGQLAATSTVSITIKAYKDVIVTNKSGGGLSALFIVLLTSIIAIRQKAKWLAVPLLLAAFINPINAFANSAPWLIALSIGQSKVETNLNTDTDNSTELKSDNTGTQTGLNLSYKFANNWAFSLGYLDLGQSTTIITSEQLEPEPYIKLMSTSMPLFTQGITLSSSYIMDVHQDWQLNYTVGAYIWQSELKSQSATKTITHTEKAVDPFLSFGISYLITPDWQTGLSVSRYFINANNTNSLSLSLGYRF

SEQ ID NO: 2087 - protein, 381 aa, Polaribacter sp. MED152
MNKKLFAAVSAALAGFAANAHATNGDQMLGVTATQWGMGGAIVAAPQDAATLLYNPAGLATLGIKDVRFDMGVGVLNPPRKVNGQDSDSDYYLMPAGAVAFNVDDKLFLGLNMGGVSGSGVDFADVRPLLAGTQAVVTTKQSYKIAPGFAYRFSDRLALGAALQIGYQSLAIHNNAFTLPQTQVYGVGMNAGVIYKFNEAVQLGASWTSKTSMDEFQWNTTAGPYSMTLDMPQVVALGVAFRPMPGLLIEADVKRIGFQDVLDRVPFETPGGASTMNFGWDDQTVYAIGVQKQINDKTTVRAGFNYGKSPIGEEDVDNNIGSLAITEKHLSLGITREFSDKVSGSLAYTRAFHNEITSNTGSNTTIELEQNIVNLQVSYKY

SEQ ID NO: 2088 - protein, 1013 aa, Polaribacter sp. MED152
MKKQLLIVCLLLLSLCSYAQTLTVKGTVTSASDKEPMIGATVQVKGTGNGSITGLDGDYILTNVSSNAVLVFSSIGFDTQEIPVNGKTVINVELKESTELLEEVVVIGYGTVKKSDLTSSISTVKGEEITQTVTGNAMDALQGKVNGVQVASGGGPGTTPKVLIRGVTTVNGSNPLYVVDGMPVGDNINFLNSNDIESMEVLKDASAAAIYGTRASNGVILITTKKGKAGKANINFTTSVGFQTIAKPNMANASEYKEVYNKRYTNDGATSNWNDTGATTNPGGTDWWDTVVNKTALVQNYALSVAGGTDKLVYNFSLGYYRNNSQFDVGYWDKINIRLNTEYTFNKYVKMGVDIAPRMESWEDTPDQFSSAMGMDPTTPVFKPESEWVDNEYNNYQRSYNNQVWNPAASIARSNSNSREMGAILNAYLQVNPIQKLTLRTQFGTNAHFRRSDSFTPEFSLDPLEKTDLNEISRQSQEWLDWNWTNTITYADTFAEKHNLNVMAGFTAERYAWYNTKALRRDLPSNMDQMQEVNAGNADNAEAYGETTFNSMVSFLGRVMYNYANRYYISASLRADGSSRFPSGNKYALFPSVSASWRVTSEEFMQDQSLFSDLKVRGGWGRVGNQNIDNNATLTLLDQTQYYFGTSPTLANGYYISTVGNDQLKWETVEDWNVGLDMSFLDSRLGVTFEYFQKKSKDMLYEKQNIFAIGYPNWNSTVWMNVGSMKAYGWELGIDWRDQKGDFSYNIGLNLSSVRNKAIKFSGDGPIYTGGFNSDQIICNEDGGLISRFYGYVADGLFQNWEEVYAHTDEHGNLIQPNAQPGDIRFKDLNHDGNLDANDKTYIGNPYPDLMVGLNLGFAYKNIDFAANFYGTIGNDIFNTTKGYYSGANGQNVWAGTLNKAWDGEGTSYDIPRLSYNDLNLNYQRVSSFYVEDGSYLRCKLLQIGYTLPKQWVGGANLRISFSAQNPFTITGYSGMDPERPMLNANGSVIETGIDNIAYPNPRTFLFGIDFKF

SEQ ID NO: 2089 - protein, 274 aa, Polaribacter sp. MED152
MKQLTVALMAACASAGAMAQQAGDNVATVGWFHIMPQDSSNNLTTSVINAPINDPLRLPGSFTSPNSGLRVSNANTLGLTLTHFFTDNIALTTIAGVPPEFKLTGHGVIRAPGPAGALGHVDLDDPSNQPAVRKARQWSPGVILQWYFGHAQSTFRPFVGVGVVYSFFTNIELNPYFAAAVNRELGSVLAAGAGKPGPTYVEGKSSSSWAPIFNLGASYAINKQWALTATVSYLPLKTEAATVIKASDGTTLATTKTTLKANPIITFVGVSYKF

SEQ ID NO: 2090 - protein, 664 aa, Polaribacter sp. MED152
MVIVIKYKDREMTLTKKALVVALSTLLPFAVQANTDIDQQGTNEPVQKLKTIVVSAALKEQDVDKAPASISVITSEDIERSAALSLADVLQKQAGVYNYNSGQDKIVIRGMLNTSGNYTLILLNGKRMSSNGAMWRGNDFDWSAIPLNSIERVEVIRGPMSSLYGADAMGGVINIITKKAEDGQLHGSIFGQYNRADRGDGKNQYRYGFNLYGGLTDNLSFTLAGDAYNRDAWYRKGQPDPDGAYFVEKDTKNVNGTLSWNINDQQTLDLDLGYNNDKRPLTQDAATSIQESEMKRTNVGIAHRGKWAWGKTEAYIGKETAKIYDYDSEYDAPQSRHYKQENLIGRAFANFDWLMNNTTSGFDYKDQKITDVVSYIGTGKNQQKSYGIFVQNDTHINDALTLTLGGRYDDFDDFDGKTTGKAYLAYQLAEGVILKGGVGQAYKVPAPAQLDINYSMISCGGSCHIRGNPNLAPEESTNYEASLIVTRPNWNAGVTVFQNDVKNLIEAITLSDGDPRLVGDFRKIWTNVSRAELKGVELTGGYDFTDNLGVKANATYLDAKNKTTGKDLTERPEWLANGSISWAPVQDFRVNAGVSYVGKQMYSATKELPAYTTYDVTFTSPITPRLTLDYGVKNLTDVDLEDKNKTFNTKLYGRNYFLKATYSF

SEQ ID NO: 2091 - protein, 818 aa, Polaribacter sp. MED152
MKKVATNFEFFSAKLHKKLALACGMVVAATGTQIGMAQNEEPSALAIEEVIVTSRKRAESIQDVPIAVTSITSQLENPAIRNLRDIEGLAPNVQIRQSMGRTAGHAISIRGIGYSNDEKSFDPAVGVVYDGVALTTNSGALIDNFDIEAIEVMRGPQGTLFGKNTIAGVISLTRTDPTGELGGSISGTLGNFGRTDVKAVVNVPVIKDVLAAKFFAASLQDDGYIYNVTLDKDVSKQDYLNYGAKFLWTPSENFSAKLTVEKIDDQSDNGAFRNLTGLGGDRKIALQDGYSGGWQPYSPAIVALTSENATPWRVAAYNDNASYPDIRGDGCLLENDPGSTDSTTSASKENIGDMQTDAITLQMDYEFSNGSTATYIYGYRDTEEYAVWPYSGSACDFITVDNINENDQESHELRWATSSDNYDLVVGVYQMENSYSQDWFTYDFWELVRTPELLVSLYGATPEQVDRLGNDFGQNIYQSQDAKSQAVFGQFDYDITERLEISLGLRYSKDEKDFFARQFCIKADADRHLQNWDTCVHGAQYSDDEKTGNWDESWSKTTGKAGLSYRLTDDIMVYGSYATGFHSGGFYGKNQRLVDYAITYEPEEIESLEMGAKMDFLNNRVRLNVAAFSSNVEALQAITTLPADDGTAVSVPFNVGEVEYQGLEIEGQARITDAFTISGAIGILDAKYKSFDADLSSTQGGNPVDNSYLTPKQAPDLTLGVTASHTASAFGGLILTDLTYSWTDDFYTQEDNDPVSLVESYGKTNLSIAYDRDRYKIAAFVNNIEDNTNWVSRTTSTLITYGQQSKGRTYGVEVMVNF

SEQ ID NO: 2092 - protein, 938 aa, Polaribacter sp. MED152
MKRFLRLVSLTLLIMSTSGNTFAEEKVNVARQGTIRGRIVDTSKQILPGASIYIEKLHTGVTSDVNGYYTFANLTPGTYTVKVSYVGYSPVEMKITIPAGKTLEKDVVLNEGLELQEVVVGGAFQGQRRAINSQKNNLGITNVVSADQVGKFPDSNIGDALKRINGINVQYDQGEARFGQVRGTSADLSSVTINGNRLPSAEGDTRNVQLDLIPADMVQTIEVNKVVTSDMDGDAIGGSINLVTKSTPYKRMFSATAGTGYNWISQKAQLNLGFTYGDRFFNDKLGMMAAISYQNAPSGSDDVEFEYDVNKKGEVVMVEAQKRQYYVTRERQSYSLAFDYDINPNHRLTLQGIYNRRHDWENRYRVTYKDLDKTGLDDEGDMQQSAQIETKGGTPDNRNARLELQQTMDLSLSGEHQFGKLSVNWGASYARASEDRPNERYFSLKQDFLGFTVVDAGDRFPYVTTDVSLHNGEADGERGKWKVKELTESNQEIYEKDLKFKVDFELPLTNGIYGNSLRFGAKYASKTKDRNTLCYDYADTYKDTFDKDYMNNLTSQIRDGYMPGDQYKPTDFVSKEYLGSLDLSSMEGEQVLEESSGNYHARENVTSAFFRFDQNLGKKIKMMAGLRMEATHIKYNGWNWNVADDKDETETLEPTGNHKNSYVNWLPSLLFKYDVNDDLKLRASFTETLSRPKYSALIPCVNINRSDNELVMGNSDLTPTISYNLDLSADYYFKSVGLISAGIFYKKINDFIVDQVIGDYTYQNNEYKKFTQPKNAGDADLLGVELAYQRDFGFIAPALKCIGFYGTYTYTHTQVNNFNFEGRENEKDLSLPGSPEHTANASLYFEKKGFNVRFSYNYASSFIDEMGEVAALDRYYDAVSYMDLNASYTFGKKIKTTFYADATNLLNQPLRYYQGTKDRTMQAEYYGVKINAGVKVNF

SEQ ID NO: 2093 - protein, 897 aa, Polaribacter sp. MED152
MKTKFKLSILTLALATGCGLSTAYAETALEENADGQAMEEVIVKASRLKGTASAVMEERKNQAFIADILGAEQIARTGDSDAAAALRRVTGITLVDGKYIYVRGLGERFSSTQLNGAAVPSPDPTRTVIPLDLFPSSIIESLSVQKSYSAAMPAHFAGGNVDVRLKTIPSDFVFSMQGKLGGNTNNFDDGLSYNGGDDDWYGKDDGTRAAPASLQKLWKSHSPINDLSQQDNREIAAQMNRDYDPKATSINPNTGFDVTLGNRFDFDDFRLGFLTAVSYDNKWEVSEEYEGQDFTYQEGVDGEDSSWALVRGSDDIKSTEHTVRFSGMFNVGLEFQRDHRIDFSSLILHDTRDEIRDKLGNTNNVTISDGLRVRDSDVIYEEREMIANQIRGTHNFSGLWNLGADWFYSDARSNRYAPGNISTRYIIADGSNGQPEDGIFDPINESSLRKATTSSRYSFQNLDDNVENYGFSFSLPVNFSNVELEIKAGGNFIEKTRDAMARRIDVNTLAFDNLDLTGHQMGVILNDDVMLNHPLSGNELIIRDTTASGDDYYSAQLVDAYFIDTDFFIAQKWRVNLGLRYEDFRQVVAPLDPATGKFELPAKPTNEDLAALAFKDDDVFGALAFTYLLDDEMQFRASYAQTTIRPDIREVAPATYIDPLTGFPIGGTPSVTSTAIDNYDLRWEWYLPAGDNLSVGLFYKDMDQPIEAVQSPAQDGPPLIRIANAEDGYVYGLEVEFLKDFGFLGDFAGMNGTDFFLSGNFTVSESEINIDTQNVVEQTGVSTSITNPTRAMTGHSPWVVNMNLGWDAPNGNHSATLAYNVFAERIIIPGIDGKDDAYEQPFHSLDMVYTYYPTYSSTLKFKVQNILNQKKEIEFEDTLMRSETKGVAFEVALKWDF

SEQ ID NO: 2094 - protein, 459 aa, Polaribacter sp. MED152
MKKYLQLVLVPALLLGLFTQSYAEVKPESFSVSPYVAGYSFFGRERLETGPAVGLRGGYNFTSHFGMEAVLTYISTEGKDGSGIGDVDALNYHLDMLYHFMPENTLVPYLAMGYGGHWRDYEGDGEVNRSAFNYGGGVKYFLTDAMALRGDVRHIIMKDRDETFHDLEYGLGVDFIFGGAKAAPAVAAAPVAAPVVQPPAAEAPLEPVPAAEPAPGHYKYCVTLQGEFDIDKAEIRPEYRDEVATVGKFMKQYPTTTAVIEGHTDNVGDPQYNLDLSKRRAQAVVDYLVDNYGIERSRLEARGFGMARPIATNNTDEGRQANRRIEAIIDCAFDVKEVQPPDRLCMTLLLEFDSGKADIKPQYRDEMAKVGEYMNKYPTTTAVIEGHTDNVGGSDYNMKLSQRRAENAVQYLVQNFGIDKSRLSAKGYGYTRRIAYNSTPEGRAKNRRINAVIDCVIKK

SEQ ID NO: 2095 - protein, 229 aa, Polaribacter sp. MED152
MKKYAVAIITAAVLSAPAITATAAPLYVSISGGLCLMDNSNAEITGTSTSIKDAVEYKRGYALEAALGEDKGMYRGELAVEYQSNDVDQILGSDMDAIESATEDILNQWGISDNIDDLKIKASALTVMYNLYADYNMSSLITPYVMGGVGAAFMGMDVSFRDNGVRYEQSYDKTAFAWQLGAGLGIKVMNNVTIDLGYRYFRAGDIDFGSDAKLSFGGSKILLGVRYNL

SEQ ID NO: 2096 - protein, 823 aa, Polaribacter sp. MED152
MKKLLIITVAVLLFPAFTWAQFSISGTITEKSNQALPGASVRIKNKTAGATTDAQGKYSISNLPAGNYTLSISFIGYRTIEKNVSINADQTLNVILTPATLIAEEVIVRATRATEKSATTYKNISKADIEANNFGQDLPFILNNTPGVVVTSDAGAGVGYTGIRIRGSDASRVNVTVNGIPYNDSESQGTFWVNMPDFASSTDNIQIQRGVGTSTNGAGAFGGSLNIQTASAADQPYGELNNTYGSFNTLKNTVKLGTGMIDNKWSFDGRLSRIKSDGFIDRAASDLKSYFLSGAYYGKKDLLRVNVFAGTEKTYQAWNGIPESRLNGDLAGMEAFIGRNFYDDRADQDAANLLNSGSRTYNSFTYKDQTDNYWQNHYQAIYARQFNEKFSFNGALHYTDGKGYFEEFKNDASFSKYGLPDVELNGTTIDQTDLVRRRWLNNDFYGLTYAFNYQAQSNLSFTLGGAYNQYRGKHYGQVIWAEYASTGTADRHYYDGKGNKDDFNIFGKVNYAPLENLNLFADLQYRSVSYAITGTDKNLSSLDFDNQYDFFNPKIGATYTLNEQSNIYGSFSVANKEPNRDDFTNLKAGLAVPKAEHLNNVEAGYRFKNNRLDAGLNVYGMFYKDQLIFTGEINEYSDAYRQNVDKSYRIGVELDAAYVINSKFGINANAALSRNKIKNYIDYITEYDADFNEIGVVPTTYANPDISFSPAAVLFGELVYKPLKGFAAAIQSKYVSKQYMDNTQNAARMLDAYWIQNARLGYDFQMKGLKNVNIGLLVNNLLNEKYESNGYTYSSLSQGVTTTENFYFAQAGTNFLLSLNLKF

SEQ ID NO: 2097 - protein, 653 aa, Shewanella putrefaciens 200
MGTNPTKIALLIGSLCSFSIIAPALAADDTHTARVDEHLVVIGRTDNTPLNIAANVNVIDAAAIEMSGATSLTDVLRGRSGIQISDNNIGTSFAMRGFSASTAVNNTLILLDGRRLNNIDIAAPSLNAIPLNLVERIEILSGSAGVLYGDQAVGGVINIVTKSPENTSGSVQLSGGSFDTYEGRGDISGAINKDWRYFFTGSYNQGDNYRKHNANETGSILGRIQYKTDTDAFFVETSYYDDDRENPGSLTKDQFKQNPRQSSNKSEYVHEMTTAARSGYEHQLNPNWALAADLDYSDTLVTSLNWGAGSHNTRSLLMFSPKALANYTTRQGELNLVAGLDLSRGKADYNTMARSNVQEMQSAYVQATVPLSHSLSYVVGGRYARVTDELVDGNVYPNGIDLDEDATAFEFGLNYRPSAEHRFYLRGDENFRFAKVDEQAYTPKDVYGLKPQTGRSYEAGWDWTVASQSLRVSLYRLDLEDEIVFDPSAEKPVGGSFQGANVNADASRRYGASADWDWQITQALQLGLEYNYIDAEFTDGVNDGKALSWVAKHTGRGYISMDFAEHFQVFAEAIYTGNRFIEGDNANEGDKLASYVLGNLALNYNRDAWLASLRVDNLFDKEYVSSGYYGGGLWDSYYSGRGRDIRLTLGYRF

SEQ ID NO: 2098 - protein, 720 aa, Shewanella putrefaciens 200
MKPTYLAILLAAVLHPQLANAEEVTKPELEKIERMSVVGVRQRLEQAGTLANTIMKTEVIDASIIENKNAVNLSEAIENSPGVKVSNECSMCGVKRIMLNGMKGEQTTILVDGLPVHTMISGYYAVDAIPTTGVERIEVARGAGASLIAPEAIGGTINIVSYEPTENGAELDISAGENGYRKLGFLGKGVTEDGRTRATLVAQYDDRDQVDADNNQVNEAPMQENRSLTGRVSHDLTDADNLVLRVANIQSEIFGGPMLGSTFADGTASSIGNVLSGYDGQPSKAQNLFEDGDVRKRYTGKAWETTEWIKTERNEASLTWLREFSDDWNMHLAASYADHKQDSFYEGFDYSADDKMWFFDARFNYLLSESQLLTFGADLRTEEMRSHSRSGSANPDYVSDSFDYDVKGIYLQDTWQATESLEVAMALRYDTITADFTDPNKPGTELDESILSPRVDIRLRHNDEWTSRLSAGRGYRAPLSFFETDHGILDGSLGFDIDIDELERSNSANYALSYEGERLTSTASIAWTEVEHLAALTTNDHGIPLLTQLDEKARVITSDIAVGYRLTDDMSLSLTAEHFDYDSVFKSSYAIAPVEKRVTLSMDWDVNDWEIFANLVWIGSRDLAEFGYEGYNRLDANGQVDPSSKKTTDAPAYVTVDLKVSYQVNDTLSVYSGVSNLFDYTQAGDEETPLFFDADGAFDVGYIYGPLRGREIYAGIKFSF

SEQ ID NO: 2099 - protein, 814 aa, Shewanella putrefaciens 200
MKSFRLSLTALACLSALSQTSYAEANSVSANSEANIERITVYGRQNSVVKNSGLATKSDMSLMETPAAVVIVDQDLIETQGTDNLQDLIRNISGVTQAGNNYGIGDNIVIRGLGANYTYDGMYGGAGLGNTFNPTRSLTNVESVEVLKGPATGLYGMGSAGGVINLIEKKPQFESKNKFIAEVGQWDTYSLALDSTGGLTNDVAYRLVAKTARSDGYRDIGTDRDEMYGALKWVLTDSQDLMLSGAYIKDAIAVDSIGHPIRIYNADSVGGKTAGEVTWQDLINDPSGKGLQLTDEQRQQLAASLSSGDGLTPYSFGDAGLISPMAKDNEGEELRFKLTHNIYFNDNLFLNQQVQYRDYTSGFARQTGAYNYVYWKQGKNPINTEPRAPLVENGVLYPFAARRQEYRKVDADETSWQYFADLRYDFQIGHIDNELLINANYEDRNIRFKQYSIYDADQVFKDKDGKITYQGSLPYIYDIRHPNWGTGKFEDYDPLKTANYNKTVSAWGLGLQHVGYLGYGFTTRIGFAFNEIKQSYEHLGLDPRYSISQSQATPEADTTDNGMTYNLGLTYMPIEDLSFFINHSKGRTAYSVLDAVKDNATNRDDSESISNDLGMRFKAFEDQLLGSLVLFKSSRTNVAYNNPDYTNGILTPNIPVYFYDGSEDTQGVELDLNAHLNDQWRVNLNGMYQDARDKQNPNDIANYDSRQKGVPYVTASAWVTYGANWFALSSPIELSLGAKYVDDRSTHSSSFGIPDGYVPSYTVMDSAISYTADSWKIQFNINNLFNKDYYNKAMFLGGMPGEERNVKLQYSYSF

SEQ ID NO: 2100 - protein, 246 aa, Shewanella putrefaciens 200
MCYEKLQFYLKPICFNTKKDNKKMKPKIISKVSLVAFLLLSLAASLANAQSEPVYSRGDWVVGLNATRVLTDEDLRSASAGGAPVPNSNLSINNDTTVSFDVSYFLSNQLAFNIFGGIPASADLQGEESLSGLFLGQTDYGPVILSLQYHVLTGSNFSPYFGAGVGRILFLDEKDRALTDFDVEDTWAPAIQAGFRWRIHNNWSANFDVRYAPFKADITGNLGPAPVQAEVEVDPTIVSIGVAYRF

SEQ ID NO: 2101 - protein, 144 aa, Shewanella putrefaciens 200
STDQLRGARIGYRTESTQFSFLDWAGSPQVSLEMGLNHWQDSNDTSDNITALTVSPVFQWQLTESATPLYLEAGIGGSYFDKTRIGDRRLSTQFQFEDRVGFSWQYSAHSKARITVQYSHYSNADIERPNDGLDFYSIYWVLPI

SEQ ID NO: 2102 - protein, 817 aa, Shewanella putrefaciens 200
MVLTFVRSNCCFIYTLLRGCMRLAVIALAVSSTLTMSAAQADSQHAAVEKIEVIGSRIALRTATDSVAPVDIITAEQLESTGMTETAKALQFAAPSYSFPFSSVTDGSDAVRPASLRGLSPDHTLVLVNGKRRHGSALVHLSGTMGKGSSNVDLNAIPMTAIKRIEILRDGASAQYGSDAIAGVINVVLKDSDQGGSISAQAGQTYQGDGEQWRVGVNHGISLSNDGFVNVALEAHHKDSTNRAGLDPRQQYPKLADGSDDPREATFNRKSHQVGDAEYDNVGLFINAAQPISTDGKLYAFGGISQRETKSGAFYRLALDARNLPEVYPDGFLPQINPKIIDSSLTLGYEFNLSDWDIDTSVGYGKNSFNYNIVNTLNASLGPESPTEFDAGTLATRETNINLDISRYFAFVNDSEILFATGISWRQNGYEIEAGEEGSYINGGYNGKAPGSQGFTGFTPESEVNETRDNTGIYAELENQLTNEFYWAAALRYENYSDFGGNTSWKLAGRYDFTDNLALRGTINTGFRAPSVQQLYFSNISTLFNPDPVTGQLVPVESGTFNTLSPVTKALGINELEPEISQSFSLGLVYTNDSGLAVTLDTYQIEIDDRIILSGSLRATDSPAVAAALAGTNADSARFFVNAIDSRTRGVDLVVSQDIDIGTWGDLRANLAYAYNKTEIQDINLPSILGGLEKKLFDGIERTRMTSATPHNTGSIGLTHELGDFKTNVRLNYFGDYSEGYSTGDVNYSDQWVMDLSVRYAATDALSFTAGVQNLFDVYPEKRPDNNNFNGIFVYPLTNTPFGFNGGYYFLEAKYTY

SEQ ID NO: 2103 - protein, 713 aa, Shewanella putrefaciens 200
MEDNKMAANSAYLSHAFNTSILYSSLAIALGIAPITQAMADDSEVANIEHIQVHGQQSEPRNILGSAENRLKEQGVDFSEAGGVSALPILNGMMGDRIKVLVDGADITASCANQMNPPLSYISANQITTAEVIAGVSPVSAGGDNIAGVIKVSSLNPKFGESEAIKWNSGDISTGYRSVSDTLLLGTNATVASKNVSLSYEGAYEDANSYKDGNGDKVIDTLYRAQNHALTAAWRDETQEVAIKLTHQNIPFQGFANQYMDMTDNKSYGALARYQLKLDDDGEFSAQVNWHGVKHEMGFFTPEKTGKMPMNTEGDDYSYQLHWRLPMGDDSTLLVGQEYYSYQLDDVWPAVPGTMMAPNDYININDGERRRAAVYGEWQQDLSQSWWLSAGVRFEYVTTNTGEVQAYSNMPMMGMPNVDAEAAKAFNAMDRKRDDNLIDATLLARYQLSTNQQLEFGLARKNRAPNLYERYSWGRGTMATTMIGWYGDGNGYVGNPDLKPETAHTLSAAYKYNGDSWQVSTTAWYTAVTDYVDAEVIGSFNRTSSPDGKRNILQFTNLDANLYGARFNALYQFAETSTGKWQVLGKVNVTRGERDNGNEPLYQIKPLQTELALQHQLGDWENSLSWQWVATKDHVDDRRLENETDSYSLLNLNSSMKWQDLTVTFAVNNLFDSYYELPLGGVSVAEFKADNTNGFNQVAGAGRSFELSASYAF

SEQ ID NO: 2104 - protein, 716 aa, Shewanella putrefaciens 200
MNSPRLSLLYSAMLLALGTAGLSHADDSATNNKTTDNIEKIEVKGSYIAGYNASTASGASRLDLAISDIPQSVSVITNAQMSDFQLTNINTALDSATGVNVERIETDRTYYTARGFDITNFQVDGIGLPLSSGSNHADEDTAIYDRIEVIRGANGLMTGVGNPSATINFIRKRPTADTQLNINGSYGSFNNTRLELDGSTKLSENIAARAVAVKQTQDSYLDRYEQDKTVLYAFIEANLSDSTSFSISHSYINNDANGGLWGALPLYFTDGSATNYDRSTSTSANWSAWVVEKNNTVVELSHYFNDDWHLRATYSHKSADEDTELFYVFGTPDKTTGLGLTGYGSAYDAKETTDLADIYVKGDFSLFGRDHQLVFGANYSTADKQEHSLYDDTTGNGFPKMPDLNTWDGNTPYPTFADRPSGSDIESTQKAAYFTGRFNLFEDMHLIAGGRFNRWDTKGESYGKSRDAEAEEFIPYIGAVYRFMPELVAYASYTETFLAQTEVDINEQPLDPVTGESKEIGLKSELFEGKLIASLAYFQIDQVNLAKLDPATINLPPNQQKYIAADGISSDGYEIDIAGEIYDGLQVSVGFTDFNIKGDELVANYTPSKLFKLAATYDVAQLEGLSLGVNMRWQDDISREQGTVGAGFANAGDTIITRQDAYAIVDLMARYAFSENISLTFNANNVTDEKYINSLYWAQGFYGAPANYSATLSWKL

SEQ ID NO: 2105 - protein, 342 aa, Shewanella putrefaciens 200
MKNAKYIYLGAVLICSTQTLAEPLDFYGRLWLGVANSSNGLSGNEKVDGFSLENYASYLGVKGEYAAYDNFSLLYKFEAGIESFDNDDSNIFKPRNAYLGFKTNYGSAVFGRNDTVFKSAEGKVDLFNITSSDMNMIIAGNDRLGDSVTLNSAKFVGVTMGISYVFDKDFNQKNPELSDKQNNYAVSFTVGDASLKNKNHYISIAYADGLNLLEATRLVGGLSVASIKFGAMYQHSESSLYDNIKGNSYLLSMSVPVDKYDIKLQYLKDDAGLGKITKNAGADLKTLKESDASQYSLGVDFKAQKDLTFGVGISYFDGDYTDVKGHTEFDDTLIFVSTRYLF

SEQ ID NO: 2106 - protein, 191 aa, Shewanella putrefaciens 200
MKYITNLSLSVWVVLLGLSAGTLSSNATANDATHHLVGASLGYGAQEFETKNGKYDAGDTVTVDLYYRYMLNEHFGVEAGYLAGSGGVASALVEAFSEIKDLSYQGGRIAAYGEYPLSRGNSLYAKLGAAYTQVSYEMDKQDRDSDDIGFYGAVGWQYRFKSGFGLNLEYQYIPMKELELQGINVGISYKF

SEQ ID NO: 2107 - protein, 683 aa, Shewanella putrefaciens 200
MSSRYFILSFCAVAVSVHYSSHLFANPLDSQTINLYEVNDIYHSSDDVIALSRLKTLTILPADHSGNPANISMRSVSQGVAVLQDRVYFSPAPYSAPQLQLLPNLLQQQSVTVTPLSEMTVGGQGAFGVISYQSLAMLDQAQESKITVEGSTDSDMSAEMNWGVKQKEYGTILAVNYEKNKGEGDFFTGRDTDRTSTDILFKINASSLLGARNPQMTEFTYQFLDVDSYRSLLGVTGADWLKNPMMQYSASAEDQAIGRYHKYQLSHQVNLGNSQFITDFYYHSYAQQLSQVNQFNGLVIDRQSLAEIAAFDRQPWNSGAELAALEQDNDYSAFGAQTQSVNQYGEHQIIYSARYHTDKAEMRFAEQQSMWLPDRSIVKAASSSILAYTDDATALTSSVDSLLKWEGLQFKLGVTYEHVDVNREVHSAYAGLDAVDFSDSDWMPQLGVFYDAGNWRFSTDIRRAWTAASAGNLEQEAQVSLHYQVSMQYALEGFNANLKAYMQEFDNLHVDCNAYSLCADARLFTQENIPDVQTYGIEVSLGYLWNVEHLTFPLSLNYQYINSEYQTNTCTEIQGCVFAGDKMAWLPEQQLQFSAGMKYEAYEVNVNAFYQSERELSQFGAELTPIAGQLRVDLAASYQFDRHHRFYFRVENLLDESLVTTASNSGIRVENGRISYLGYQWRF

SEQ ID NO: 2108 - protein, 230 aa, Shewanella putrefaciens 200
MTFKNLLGASLVAVITSTSAYAADAIVAQEPAPIAIAPSFSWAGAYFGGQVGYGWGRAKLENRTNGSTSEFKPNGFIGGLYTGYNFDTGNNFILGLDANVDYNNLKKSRDFITSGNPVQTTGETQLRWSGAVRARAGYAIDRFMPYIAGGVAFGGIKNSLRIGGEESSKSKTQTGWTVGAGIDYAATDNVLLRLEYRYTDYGKKNFGLNDLDTRGSFKTNDIRLGVAYKF

SEQ ID NO: 2109 - protein, 923 aa, Shewanella putrefaciens 200
MIMNKSLYIVAFSLAFATTGIAQNNEGQDKVIDLGTQTTTELRKTQAVSTIYSDELDKNATTSPYNAIYGLLPGLSVMQNTSWGTDKSRLNVRGRGSLNGDTPLFVVDGFARPLEYINLSEIESISVLKDGAATALWGGRGANGVVLITTKRGIYNQKDIKVDYKFGLGLPVNQPEFADAYTYAKARNEALRYDGLQPDMDEASFLSGGNSDLYPNVDWQKEALRNHTTSHQLDITFRGGGKRLRYFSVLNYKNDMGLLNSKYTDYTDRYNSQMKKYFLNLRMNLDVDITDATKLKLSMLGMLRETKRPTTSEATLFEQIFNTPSAAFPVQTQNGFWGSNNVLKTNPIANLADVGYYKLNQRMLQADLRLVQDLSVLTRGLSAELAIAYDNNATYQETAKKSFMYQTIEKGTDGEPIYTNYGNPNDELEISNKGLANQYIHANFEAKVNYHRTWDKHDFTASAMFRQESMTLTGANNSRYRQYIIGTAGYNFDNRYMVDIVANCFGSSVLGKNDKYRAYPAISAAWILSNENFMKEISAFDYLKLRASYGRSGYDIYDYDMDKQYWIGSGAYYFQAGNTSAGSSLKEGVLAMEQLDLEVADKYNIGLDMSLFKGLTFSIDGFYDKRTNILIDGSGLISSAIGVTIPQMNAGKVETKGTELSAMWKKEYKDFNYYIGANFSYAKSKVVENGEGYQPYGYLSKKGYPVGQCFGWEAIGYFRDEADIKSSPVQKFSEVRPGDVKYRDLNGDNVIDNNDQKAIGYSTAIPEIYYGINLGFEYKGFGVDALFQGVAHYSVMLNTASVYWPLRNNTNISSWYLNDRIRWTEETKDIANVPRLTTLDNANNFRNSTQWLENGSYFKLRNLNVYYNLPSSWAKKVKMEKIQVYARANNLFSLDHVKYMNSEDLKINYPDMTSVYFGLNINF

SEQ ID NO: 2110 - protein, 714 aa, Shewanella putrefaciens 200
MTYLAFPKRVALLLGAFVAFNSPMVFAAKELQSNEQITDSDIERLSIHYRQAYRGNVPAEALPQAISVLDEQLIKDAGLTRFQDVLDYSASVARQNNGGGLWDSFSLRGFPGNENMPSGYLINGFNGGRGFSGHRDLSNVAYVEILKGPGSALYGRSEPGGTVNIVTKKPQYESSGYLKASAGSFDQYRLEGDVTSGLTESVAFRINGAWQEYDSFRDYVFSDKKIVTPSVRWQVSDKASLLYELEYLKQEQLFDRGFIVLNNDIKTVPRSRYLGEPNDGATKVNATGHQLTYDYELNDDWSLTAGYNYRDSTLKGFSSDAELAAGRQSLFDDGRTLTRQHRYRDYASEDNSLRLELSGHLDTGFIRHNLLLGADAYHYNLKTGLYRYRGKKGEYAIDIFEPQYGSVQPEVSLLYENEETQKAWGTYLQDQMDLTEKWKLHLGLRFDSYQQDIRETAKETLSEQTDNRVSPKVGLVYLWSDALNFYSSYSEGFLPLSGTDYAGNPFEAEESQSVELGMKFNAAWLNDLAINGSLAVFDAKKSNILTSDPVNVGFSATLGEAKSTGLELDIAADLTESLQGRLSYAYLNTRTANDTLNVDFGVQIPAGSPLVNVPKQTASILLKQDLNDFSIDGHLGLSWRYIDSRLGDSADPSFQLPSYQLVGLFMNTHLSDNLSLGVNLDNLLDEHYIASSYSALWAVPGEPRSIKVSVSYEF

SEQ ID NO: 2111 - protein, 750 aa, Shewanella putrefaciens 200
MIKRTKVASAINVAIVTSISAGTFVASNSFAAEETAKVERIEVTGSRIQRQDMETASPVTVIDAAAIKAEGFTSVDQMLQVQTSMAGAAVGSSTNNGADGVAQVDLRGMGSQRTLVLLNGRRMVNSGSGADSSVDLNSIPVAMIARVEILKDGASAVYGSDAIAGVVNIITKKDFEGFQLDFNGSGTDKGDGRNGDVSALYGFNTDGGNYTFGAAFSDRRDVIQADRDWTATGESWSIPTGALDYMVKDANGNWVDQEEVYDYTQDSYYQTPSERRSLFANMTQELGNDVVLTADAIYTNRRSHQQMAAQPANIGLNVCGNANVPAGAPCITLDSAMTAAGIKANDKGLVNYRRRTNEVGPRIYTQDTDTWRLSGGLAGTLDVHTGMNWDVTYTYGKNKAETAVENSINATDMATSIYANPDAWFSGAPLTQQTINAIGYSEKANGGNEQQTLSAGLNGELFDLKAGAVGFAIGAEYRRESGFYNPDPIVVAGESTAAQQDPTDGNYNVVSIFQEVSVPFTEKLTGEFALRLDDYSTFGKATTWKIGLTYTATDDLMVRTVAATGFRAPSVAELYGGNSGSFDYLKDPWGNIKDAQILVNRTSDPDLQPEESESYTAGLVYSPSYIDGMSVTLDYWRFKLDNAIARMDTQVGLNACHAGDASACETFNIGAGGNLDNLTNALTNVGSQDTSGIDFNLAYSFGLIGLDWKVSNDTTYLVKFEQDGEEYTGTIDGNFPPVSGLLSPLNNHYV

SEQ ID NO: 2112 - protein, 881 aa, Shewanella putrefaciens 200
MRPSTFKKSVLATNIAILLGGAVSVGAVAAEAPVDTANIEKIEVRGIRASNKANINEKRFSNAVVDAVTAEDIGKLPDSDVGQALGRVPGVTVGRAFGQGSSVSIRGTDPLMTLTTLNGQNVASTGWYDQMNIDRSFNYSMLPAELIGGMEVYKTTQANLVEGGIGGTVIVKTRKPLDMEANSIFGSVKGEYGSINEEWAPEVSGLYSWKNEAETFGILVSGAYVDREYLRVGTEADLDWGGRSSIQPSSFLQSQERTALDATLQYRPTDNLEFGAHILSLKLGADSIGANMYINTDTNWGAGDSHCQQFNDAGVCTYSDTPESDPSDVFFQNWARKGEMTSDTFELNMEYDGDGYAIAAVAGKTKAEGGTQMSANFGYGWWGDKFKDIKWAGVVDATGKQIDINGRDMSFGIDNLDTTVGTSQWTGIQGPNTDEESYVQIDLDFDLDLGAINKFETGIRYTEHTFEKKEYRAVYGTLPNVFNSTDLYSGTMKLGYDEWTIPKANLDAMIDATVSLVDEFVYSRPAYGKIDEDNLSLYGMFSFEGEGFRGNFGLRYVQTDVTSSGHVIDNSPADNLGINAGWSEEVQSVSDSYHDVLPSVNVAFDLADDVILRLAAGQAITRPNYDNLFLSSSSGYPDDRRGNEQITYGNPGLEPMKSSQADVSIEYYYGDGNLFAATYFIKDISNFIVATAPETKAIGVINNDLEVPADSWIVDSYMNAGGGSIDGIELQLNHAWDNGFGINANYTFTDGTAPAEVYTDNIGVFTEASKHTTNLVGYWENDTFSARAAYNWRSEYMVREYGKYYGNRMHDDFGTLDVTLGWNVTENIALRLELINLTAEDDVQYGAAGVGTAVKPALQDGYPTWSFKGETTYKLGASFNF

SEQ ID NO: 2113 - protein, 729 aa, Shewanella putrefaciens 200
MFNSKNHISSTSLKRAPLALAIAAALSTSAFAQTDAIDKPDPNTEMEIMVVTADFRSASLEKMPSSITVIDAQQIQDESAQHFEDVLNSIANVNWSGGSSRPKYFQIRGVGEQEQYQGAPNSSVGYIVDDIDLSGIGMVSSMYDLQQVEVLRGPQGTRYGANALAGLIYLKSNDPTDVFEHGAEVSLGNDDLQTFSGFSSGPLTDSGKLLYRVALQQHQQNGYRDNLYLGRDDTNGRDEFTGRAKLRWYATDDLQLDLTLLHANFDNGYDVWSLTNSPTQTTSDQPGVDSQRTTGVGFKATYSGAEQFELTSLTSFANTDHHYSYDGDWANSEYWASKQCEEGGNVSPCQYDYFWDKTGQRKTLSQEFRLSSTDQGRIFAGSTDWLIGVYGMNLKEDNQLDSEYNSWPDEVLDSEYEATNYALFGQIDTDLGSDYTLSVGLRLERRNSHYSDTNNDNFDPSETMWGGHIALSKVLSESHNVYARVARGYKAGGFNMTLPVELNDKKEFDPETLYNYEIGLKSHWFEGIIDTNFALFYMDRQDQQVAASQQDPNKPQRFILYTENAGSSNNYGAELDVTWYATDNLQFYSSLGWLETAYGNYQYQDKYGTDVDLTDRDLAHSPHFTYSLGGTYRANSGWFANLNMSGKSEFYYSDSNDSRSEPYTVVNARLGYEASAWSAYLWGRNLFDEEYGVRGFYFGNEPDNGWAEKQYIRYGDPRQIGVTFNVKFM

SEQ ID NO: 2114 - protein, 951 aa, Shewanella putrefaciens 200
MNSLSLTAKAVRYGIFAAASLTTSTFVYSEEQTEIFERIEVTGSKIKRIGELAPTPVTVISGDGLIDAGVVNVADLLHKMPNTLVGLSPETTNNTVFASGLNNTDLRGLGSDRTLVLVNGRRFVAGAPGSGAVDLNNIPTAMVERIEITTGGASAVYGSDAIAGVVNIITKKSFDGISVDVSTTQPTEDGGEEKYASITFGSEIGKANFVTNLSWARQEQLSFMDRKFLRDAPIVVRNPNATGPDDPQSIVWGHGQQVLASYSKTGTFVSNGTRYSFDENGNVRPMELGQPLPPLTSGRVDYLGGEGYNFAENSFIKTPLDRINFFSVMNYDINDDHKMTMEATLSKTDAYGESSPAFLSFKVHDDNGFLSPEAAALIAAEEARLVNAGKAEPGDGISLGYLASDFGNRKYSQERTTARIALGFEGALSENWSYDTYATVGHVQADTEWYGEMFEQRFYDAVDTIKNDKGEVVCRSESARNNGCLPLNIFGRGIYDKNAYDWVSTDAIRRSSITQSALGASVSGDLFELPAGFVSSAFSLEYRKEQADTLPDPAMREGLLFNNQSQPLKGEFDVTEASAELSIPLLSDITLVQDLTLETAFRYMDYSTSGSDTAWKVGLNWAVFDDLRIRLNRSKSVRAPNIGDLYSPPGQTFRSIKDYCASSYRNQINPEYLDNVLANCAAQGIPTDFEPSQEWYGSTRPGFIVGNEDLKNEVANDITIGFVYTPNFIENLSFTVDYWKFDMENVINSFTGPDVVKYCYQSSTLDNPFCPLLERDPDTHELTNYYEKPVNSATSITSGVDIEANYKFESSFGDWGFRLFSTYLEERSFNSTGFAEDEIKETGEQERPRWRHRFTTDYTYGDFSAVLTANYRSSTVLSNDWSPNQNNYNDIPSYITFDLTSRYNITDALQVRAGILNMFDETPPRQPGVYNQGAYYDILGQRITIGVNYTF

SEQ ID NO: 2115 - protein, 659 aa, Shewanella putrefaciens 200
MFTLLVWGINMCAPVHAQNKLDSLQHLNEVVVTARAVQKEIFPVQELSGRQLYQLSSHNVADALRYFSGIQIKDYGGVGGLKTVNIRSMGTNHVGVFYDGIELGNAQNGTVDLGRFSLDNMESVTLYNGQKSAIFQPAKDFGSSGSIYLQTRTPQFEEGKKYNVKASFKTGSFGVANPSILWEQKLGEQISSSFSAEYLHSSGKYKFTYRMQEGYDTTAVRQNGDLNALRVEGGLFGRINQGYWKAKAYLYNSERGYPGAIVRNKFSHEDRQWDTNFFTQGTFKKDFTQWYSLLANAKYAYDYLHYLADPNKDESLMYVNNHYYQQEVYTSVANRFNLFPWWKASFSADYQFNLLNADLRDFVYPRRHTLLASIATALRFKQVELQASLLETYVHDTSSGTPAPDKQKLTPSFFVSWRPFPQSGLNLRGFYKRIFRMPTLNDLYYTFVGNINLEPEFTTQYDLGFTYSRTFNGTWLRALEVQTDVYYNEVENKIVATPTSNFFRWTMVNLGNVEIRGVDVALQTGWKIGRELTVSNRINYTYQRAQDFTDPKSEFYGGQIPYIPWHSGSAVVNLQWRSWEASYSFIYTGERYSSQANIPYNYQLPWYTSDFSVSKGLKVWKGDLKLTLEVNNLLNQQYEVVTCYPMPGTNFKLIAQYNF

SEQ ID NO: 2116 - protein, 696 aa, Shewanella putrefaciens 200
MQKSLLATLISSLLLAPSSYANEPQSTTDIEVISIKGSRLDKAATATGLPLTLRETPQSVTIIDQEFIQSFSLNSVADLMFLTPGIYAQKAETNRYFFSSRGNPITNFQFDGVPVNYSSFFNDASTDTILFDRVEVVRGATGLLTGAGEPSAAINLIRKRPKAAPGGYVSAKVGAWDSYRVEGDASVDVTESGDVQARFAAAYEKSDSYIDLAEDENLQVYGVITAKLSDNTLFTLGADYSDRDPKGSTWGGLPLFYADGSLANDLSRSTTTAASWSSWQRNGANVFATLEHNFDNNWDVKFDVEHREDEMDGHLLYLYGAPDKTTGLGMGASAMIYQSTRKQDAARLFASGPFELFGREHKLTAGLLYSKQDTTADSYYPLNSISIGNFFEWDGSVAEPSYPSTPIYQEGEETQKGAYLATQINLHDQWMLLLGGRISQYKFESNAAADYNNSDVFTPYAGLIYNLNDSISIYTSYTEIFLPQDARDANNKRLEPMTGNNIELGAKGDFFDEKLTASIAVFKVQKENVAEPDDNALPLPGGNYPMHLVDGTSNQGYEVELNGRPTEDWDLFFSYTHSESEDQDGSAFSTYLPKDLIRLSSLYHFDGALADLTVGGNLSWQSKIYKDKAGPNGERSEQDSYYLVNLMTSYQLTDDAKVQLNINNLFDKKYYSSIDFYNQGFFGEPRNIELSLSYNF

SEQ ID NO: 2117 - protein, 508 aa, Shewanella putrefaciens 200
MFSIFCQKIHLISLIILSILSNIAKVSATNIPVEQNSTLNKIISVSQLAEITHDSWAFQALQALTEQYDCVGLENTDNQIMTRYEFATKLNACILKINNSNFDKVNRETLTTIQKLQTEFSTELATFRNRIDLLENKVATLEIQQFSPQVELEGEVIFAVTGVAGGKKANSRTKPINNNLVLSDRLRLSLEASFNGKDKLQVRLQGRNTPELADFTDTKMANLGFDGDDDNEVEVDQLDYKFRLGKQTRVTLYALGGGLGDFVPSVNPLFSGSGDGSISTFGRENPIRRQGGGTGIGISHNLAKSLNFSLGYVTNDAANPEKGIFASPYGAIAQVTLEPTKNTALSLTYIHSYNNINTGTGSELTNNPFNSQADAITANSFGAEAAWQINPTITLGGRVGLIHATADDLPTNPNATISTWALLLTLNDIGKENSFAGFVIGQPPKVTHNSFGDAFKDQDTSLHLEAFYHLQITDNLAITPGLFVITNPEHNNNNDKIYIGTVRTTFTF

SEQ ID NO: 2118 - protein, 345 aa, Shewanella putrefaciens 200
MIKHYLFMAVSQVFFSFFLVLFFISSIVLLISIASVTLVIKVSFLDLVQLFLYSLPGTIFFILPITFFAACALGLSRLSYDHELLVFFSLGVSPKKMTKVFAPLSLLVSAILLVFSLILIPTSKSTYYGFLRQKKDKIDINIRAGEFGQKLGDWLVYVDKTKNNSYDNLVLFSNKSLSQESFILAQKGNINNQNGVFELNLYNGHAYFTQGDKMRKVDFEELHLRNKLKSFNSNDAAYLQGTDYLGYWKKAFGKNANKNQKRRFSQAILVSLFPLASVFLIPLFGIANPRFKTNWSYFYVLGAVGVYFLMVHVISTDLFLMTFFFPFIWAFASYLLFRKFILKRY

SEQ ID NO: 2119 - protein, 215 aa, Shewanella putrefaciens 200
MMNKNIVSTVIAATLLAAGFTASVSAHQAGDIIVRAGAVVVAPNESSDPVATFGEFKVNNNTQVGLNFGYMLTDNIGVELLAATPFSHDVSLAGVGKIAETKHLPPTLVIQYYFGDAQSKLRPYIGAGVNYTKFFDNKFTNDLNGALTDLDMSDSWGLAAQVGLDYQVNKNWLVNGSVWYAKIDTDVKFKLGGAPVTIETDIDPWVYMVSVGYTF

SEQ ID NO: 2120 - protein, 198 aa, Shewanella putrefaciens 200
MKLASAAVLASTAFAGATYAGSLAEPVVEPVMTAPVPAPDLGGDWTGFYTGLQLGYSDAEVDNGLEGDNGSYGFHAGYNYDFGRFVLGGELDYDKTDIDLNDAAGVTQGSIDSVARAKIKGGYDLGSTLIYATGGYARADTTMGDEDGAFYGVGMDYKITEQYSVGAELLEHKFNDVSGVSGNDADVTTFNIRGSYRF

SEQ ID NO: 2121 - protein, 666 aa, Shewanella putrefaciens 200
MLLSRKKYLAQVISVLCLLPTIPVTNALADTAPDKEKMMERIVVTASGFEQQIRDAPASISVITREDLDNRFYRDLTDAMLEVPGVVITGGADRQDISLRGMGSQYTLILVDGKRQSSRETRTNSDGPGVEGAWTPPLAAIDRIEIVRGPMSSLYGSDAIGGVINIITRKVPNEWQGELRLDTTLQEKSDSGNVYQGNFFVNGGLIKDLLGMQLYGQYTQREEDNIYGGYRGRDATNLTARFALTPNENHDIMFEVGTSNQELDSSLGKTVAPLAPGASCGRNGCPASSTTEYENSTFSLSHTGRWDFGTSDTYIKHEEYDNKSRKMKITNTDAQSSLITTLGQSHTATFGAAFNHQDLTDETGNQVSDLTDISRKQWSVFSEDEWRIVDNFALTMGLRLDDDENFGNHVSPRVYGVWGLTDSTTLKGGVSTGFRAPSLRQTVPDWGQVSRGGNMYGNPDLEPETSVNYELGLYSDLTESITASAGVFYNEFKDKITRVACPATQCTAGPNQFGSDPTTYVNIDEAVTQGIELSIDYRIRSNLSLTGNYTYTDSEQKTGVYKGSPLNQLPKHLIQASFNYEPIDNLSTWLRVNYRGEESQPTTGPSSSSLIAPSYTLLDLGANYQLNDSLKFSAGIYNAFDKEITQEEYGYIEDGRRYWLGMTYSF

SEQ ID NO: 2122 - protein, 320 aa, Shewanella putrefaciens 200
MNITALTDNTQGAAGLELYEVYNNGYPTAYGNIIHLKGMTAVGEGELLIGWSGTSGAHAPAFIRSRRDTTDANWSPWAQLYTSAHPPAEFYPVGAPIPWPSDTVPSGYALMQGQTFDKSAYPKLAVAYPSGVIPDMRGWTIKGKPASGRAVLSQEQDGIKSHTHSASASSTDLGTETTSSFDYGTKSTNNTGAHTHSISGTANSAGAHQHKSSGAFGGTNTSIFPNGYTAISNLSAGIMSTTSGSGQTRNAGKTSSDGAHTHSLSGTAASAGAHAHTVGIGAHTHSVAIGSHGHTITVNAAGNAENTVKNIAFNYIVRLA

SEQ ID NO: 2123 - protein, 1144 aa, Shewanella putrefaciens 200
MNKTALTKTYTKDIQNSCLNSKKIVLSLATISFLASCTHATLTPEIKTYEETNRHAKARSGLQSRNSNNETINNLQTLTKTISDTGNTLVIESSGTITISNDGQQAVNFQPNSSTSTFLNKGTLIGGNNTASVQLGAANGNNGVSIETFNNQGIIGNGSSKFGVTVFGGGSKDNPKSIINNFSNSGTIHSNTGESIYFGNAKISSFVNSGTIKSKQGAGVNISQGTSIENFNNTGTGIIEGKRMGVNVRSTINTFVNDGLIAATNDGIQINANVKTLINKGTIKGDAISIRSLGGTIETLTNEGIMYGKSAGIYMNRSLVKTLTNSGTINQNNSATWSAGIKLENGSIIENIINTGSIRSNAFGISVTGGKFGTLTIKDGGMVYGKYSAIGVGRSQTLGDLYIDGRSNNGTVSGIYSEEHGILLENNSRTQKIELKNGGIIKGNIDGIRLINSASLSGEMILSGEGSRVEGGRGVGILNRSGKIEGSIKVEDGATVTATSNRAIANSGSGSITGGITVSGKNTKLEGNIINTGNASIGSDIKIEGGAKVEGGLVNQGNGSISGSVQVSGGSSIDSITNEGNGAISGSITVYKDSKLDSITNTSTSSTGISGSITNNSDNKLEISNSGNIGGKIESTGSADMVISNSNGGTISGGISSSGSGSTSISNSQGSTINNGITVSGSAQVEISNQGSVGKDENGNTVTNNGSGSVGIKDWLVSTDKNTGKLNTVVIGGSRAFNVKVENITVDQSNVDLEELNDINNIISGVNQNNIGNIGTNGSGEISLSFDPITGKLTTDFNLNASISGATFRSLISTTSRRSTFIDNVMGNSMQSFALASSSKSQSIAMSEKGNLYADASDYIKSDLNNGSYGSNKEHSLFILPYTSSQNVELSLNEESKGHTKGTIIGYSTLKDSGIYGVYAGYEDTKMGSTYFDINNRTYYAGLKYFNTLFTTEKGQEVYIKAQGKAALIKNDLTEKIGNNEAKAEPNSYAYGVNTALGMNFISNKDIFSPEIGLAYEGGYTEAFSMKDTIGQATVKGGERTYANYLNLFSTKTSLTWFRDWLPNLKTSVELGAKFNINPKVEAEARFGNIKVSDEFDLPRVQKFVSTSFIVPVNEAFYFSLNYNGMFDKDGNTHTGFAQFNYLW

SEQ ID NO: 2124 - protein, 452 aa, Shewanella putrefaciens 200
MMITLRKLPLAVAVAAGVMSAQAMAVDFHGYARSGIGWTGSGGEQQCFQVTGAQSKYRLGNECETYAELKLGQEVWKEGDKSFYFDTNVAYSVNQQNDWESTDPAFREANVQGKNLIEWLPGSTIWAGKRFYQRHDVHMIDFYYWDISGPGAGIENIDLGFGKLSLAATRSTEAGGSYTFSSQNIYDEVKDTANDVFDVRLAGLQTNPDGVLELGVDYGRANTTDGYKLADGASKDGWMFTAEHTQSMLKGYNKFVVQYATDAMTTQGKGQARGSDGSSSFTEELPDGTKINYANKVINNNGDMWRILDHGAISLGDKWDLMYVGMYQNIDWDNNLGTEWWTVGVRPMYKWTPIMSTLLEVGYDNVKSQQTGDRNNQYKITLAQQWQAGDSIWSRPAIRIFATYAKWDEKWGYIKDGDNISRYAAATNSGISTNSRGDSDEWTFGAQMEIWW

SEQ ID NO: 2125 - protein, 685 aa, Shewanella putrefaciens 200
MEHRAFKKNIIAAIISSLGVSSAYAAVEAESTEPIEKITVYGEKIERSLKDTTSSVSVIDKDSLDSGQYQSVSDALSEIPNVVVLTGSVPDIRGVSGNGSASGFNSFTGGARARVSTLVDGVAEPFVADLTGDTGLWDIQQVEVFRGPQSTINGRNSIGGTVFIKTEDPTFDWRGAARLGYRDQNNYVDSAVMVSGPILDDELAFRLSGQNVTGETYNKGLVYETNPAPFDLNELITNRWRGKFLWQPSAVEELKVLYSFSYNDEKGDSGRNYFSGDDPWAYRPILQRYIETESTTHSVKVDYDLGSGRALDLVVAYMDYDWGSKSYEALVTAQQYVDMKDESYTVDGKYSFGLNDRDFNGFIGLAYYERSQDFGSTGSSVYTGDDSSSSVSIYGELTYGLAESLWLTVGGRVMRDEQKRNFSMLYRGTQLEEKLDNDSTITLPKLVLQYAITDNTTLAASARRGYNSGGGALSLAESEYYYYDEEFVDTYELSARSMFLGGNVNLSANLFYNDFDGYQASNQARKITNVDKAVTYGIETELSAMLTANWQVIAGVGLLDSEIKKVDSSYGDIVGNQLNSAPHVTANLGVKYWLNDAFSVGVSGNYVGEYFADIDNTESRIAGDYVVARLSVDYQKDNWRISGFINNMFDEQAMTVNEPPSANYVNGYAAIIDPRNLGVSVMYSF

SEQ ID NO: 2126 - protein, 813 aa, Shewanella putrefaciens 200
MGSASFTQKTLTQPDVCALPLRDERGLRIAALAYSLLRPAPLGKDFRAAAQTAGYKMNKKLPLSLAMLINLGMYGAALPAWAQESTAPVDGNATDGDDTIVVTAAQQNLQAPGVSTITADEIRKNPPARDVSEIIRTMPGVNLTGNSTSGQRGNNRQIDIRGMGPENTLILIDGKPVSSRNSVRQGWRGERDSRGDTAWVPPEMIERIEVLRGPAAARYGNGAAGGVVNIITKRSSNDWHGSWNSYFDVPEHKAEGATKRTNFSLTGPLGDSVSFRLYGNLAKTQADAQDINAGHESLRTGSYADTLPAGREGVVNKDINGQVRWEFAPMQALEFEAGYSRQGNLYAGDTQNTNNDNSTNGLVKKYYGKETNRLYRQNYAVTWTGGWDNGVTTNTYAQYEHTRNSRLGEGLTGGLEGLFNSEKFSDINLSDVLLHSEVSIPFDWLVNQNLTLGTEWNQQRMKDGTSTAQALTGSTSGGAIPGVDSTNRSPYAKAEIFSLFAEDNMQLTDSTTLTPSLRFDHHTIVGNNWSPALNLTQALTDAVTLKMGIARAYKAPSLYQTNENYILYSRGQGCYASATNTGCYLMGNEDLKAETSVNKEIGLEYKQDGYQAGLTWFRNDYHDKIEAGYTRVTAISNKTDLYQWENVPKAVVEGLEGTLNLPVTDTVQWSNNLTWMLQSKNKTTGDRLSIIPEFTLNSTLSWQVRDDLSLQSTLTWYGRQKPKMYNYKGERVTDSGTNEVSPYSIVGLSGTWDVTKNVSLTAGVDNVFDKRHWRAGNAQTTGNAKTNAWMYGAGAETYNESGRTWFMGINTHF

SEQ ID NO: 2127 - protein, 705 aa, Shewanella putrefaciens 200
MPRFGKFYPQSKWVIGSLALGLSAISGSTIADSGTAPDKQSKQQDAAGNIEVITVYGQKIERTLKETASSVTVITEEQLRKNADQSTISEILGGTPNLIYAGNTDAPIIRGTDTKGPVAAGNAYLSKPVPGATISVDGKYLSPAELDLGAAGVWDVSSIEVYRGPQTTSQGANSIAGAVVIHTHNPTYTPEFAAQALYGSRNKQRFSVMASGALSNDFAARISADYSARDTFVDYVNPDFTAHDLDFEFKNQNLRAKLLWEPEKYSNFSAMLTYSSTEAKRPRNEVVSEPYDDLENRSIFQDNQEVSNHVGIFDLEYVFYNGMKLHNQLQYSEGQFDYRFAAPYQGIAKRDNENFSNDIRLNFGDKSSEFSGVAGVFYWDDKTNNKLNNVFGHADADLRHTSFAPYGEVIWRFSPKWAFTSALRYQSDEISHDGIASYIPNVRHQYEETFTALLPKVALSYDLTDHVLIGAMISEGNIPGGTGINFRGGEYYTFDAESAWNYELFTRIDLLEQRLIINSNLFYTRFKDSQRSVTDYLDGRPFGSVIINADEAQSYGIELDWNFKVADSFSLYGGLGLLETEISEFNDYRGEEFVGNEFSKAPGYMFNIGFDYSITDTIKVSGDVRHTDGYFSTDTNEPELRVGSYTTVNLNSSYQINQYFEAFVYARNLLDERAPVAKMADRSTGGVDAYLLEPREIGVGVRAKF

SEQ ID NO: 2128 - protein, 966 aa, Shewanella putrefaciens 200
MRANSTLAKAVRFALISGATTAVLSTSVAIAAEDGAKVERIEVTGSRIIREGAIAPTPVTVITGDELLSTGVTNIGEALNQLPALGNTYSLANSGRFIGTSGLNLLDLRSMGTDRTLVLVNGKRHVASSAGTSSVDVNTIPSVWIEKVEVITGGASAIYGADAVTGVVNFILKKDVEGLDVSATKGWAGDNPLSKDRVALSYGTNFDQNRGNVAFAVEYSAQNQLKAFDRDETSTSFTNLKNTNRPIGPDGKPIDSNHPSDPDKYYTPNGGHYTISNAGTFFLDGWKTFNPDGSLRDVYSGPKVDGIYCVDCDYTNLNQFVELQPEFERYNINFKTNYQLNDNMNAYFEAKYVNSQASNEGQPAFFFGRDSVNILKNTDVKIDNAFISPELVALMKANKDAQGNPAPLDTINIRRFMTDLGQRIEDDTRETQRYVLGLEGLVFEDWDYDVYGVYGQTDLERVNKNNLVLANYQHALDSINVDGIAVCRDEDARAAGCVPLDIFGFGKPSQAAIDYVNTTSTGTSVIKQTVLGGSLTNSALFDMPAGVVGFSTGVEYRKEESEIFEPANAAGTFFNALGEDKGDFDVKEVFAEVSVPLLADLPMIRQLDMELAVRFADYSTIGNATTWKAGLSWEVNDDLRIRSTYSEAIRAPNISELYGAESQTFFSIEDACRTKYLNDLSNPDIRKANCAALGVPSDFNSDYDSKRVEGVSSGNRALDPEESKSYTVGLAYQPNFIDGLSITTDYWNITIDDAISAVSAQNIIDRCVDSASGINNEYCALITRNPTTNEITSIRQSSLNIASLEAAGIDFDIGYNFDAFGGDFRTNLIATRLLKRKDYSFQDDPNDFEELAGTLGYAKWQANWSLNYSIAQWSANWRTRFIDGVSLYTDKELARNANPSSNMEYGVYFISDISVAYAFDSGVTLKFGIDNVLDRDLPYGTTGTSAGAAAYDNVGRFFHTTASFKF

SEQ ID NO: 2129 - protein, 764 aa, Shewanella putrefaciens 200
MMYLGRSPHIPYPLSVLALTLFLATTGMQAQASTTKETDEMEIIVVSATRTAQDIKSSPSAINVITEEDIQGMTLFTIDEALGKTAGVMDRRTKGFMETTPSLTIRGLSNARDTLVLVDGVPQNDSRNGQVNWTMIDSENVQQIEVVRGPFSSLYGGNAIGGVVNIFTKVPEENSFSMKMGIGGPADSIAPENFSDQALQGTLKILDSVTLGANYRKRETDGYPTTHVNASDAVIDKLPEGVTGWVPYTTNVGGKSNLIGDMGDNWFNDETYGLRLTYTPSDDTRLNLSYANSDSVYGYDQPHSLLRTTEVTASGKVDSIPTYSNIPMTTWLNGALFARGGSTTQTNTGLNLSTSWDQINLHISAGHISKETTTIIAGLTTANAGHAPINPVTFEGGDGRLAPATESTRKSIDVQLDMPLSDNHTLVLGVAANEGDVTEERWSLSNWTDPTSKVFMSADTTAKDQIRSFYVQDAWQLNDKFTAYIGARQDWWKMRGGESHSYTQAGGTGSITYDKVTDSPISPKISMVYKPSTNTSYRASLGKAFRAPNLYEFFGTANLGGNIYVGNPDLKPETLVSWELGVDHSFQNNINAIATIYRSEIDDRIATQTVDGISMPQNVAEAKIQGVELELKGTWHYGLGWSANYTYTDSEVTQDPNPNVVGKALPHTPKNMYNLNLNWRQGDWYITANHSYQSKRFTNVTNTDVVTHVPGSTDSFMLTDVKTTYFVSDNITASLGINNLFNEQYNQFYLSPGRFWFAELRLSY

SEQ ID NO: 2130 - protein, 737 aa, Shewanella putrefaciens 200
MKTFPLSCIALVCRQALVNPKLLLCSVMLATVPHATADTVDADSKTKKHQKEIEVINVIGAKDLHDNRYKTQAMNTATGLDLSYLETPQSVTSITRQMMNDQQLNSVIDAMTSVAGINARPMDNDRYSISARGIAVTSILYDSVPTTYDTRFNYGDNLIDTAIYERVEVVRGATGLMTGAGNPSAAINLIRKRPTQEFMGNTSLSVGSWNNVRGMVDVSSGLNDSGSVRGRVVAAYQDKDSFQDRYEQQRTTLYGIVETDIGDSTLFTLGVDYQDATPSGTMSGGLPLFYSDGSRTNYDRATSTAPDWGSAHTQGLNTFASLEHRLDNGWNLKGTYTYGDNSLEFDVLWATGYPDPVTNIGATAGSIAYVDGSRTQHNVDLRAEGQYQLFGLEHQLMFGWNGQRQEFANPYYYPTAAVPPLGDFRDPNFQYPKPQWKETYTTGSFGETKQSAAYVATQLNLSDALAVLVGLRLNEWETDQDNFGSRYDFSISNELTTYFGLTYALTEQYSLYASYTDIFAPQTLQRIDASYIDPVKGKNYEAGIKASLMDESLDMSLSVFEIRQDNVGERTGDVLPGTTIPVYREVNGTQTQGFEFESTGKITDDWNIYFGYTQFSTEDPKGKRINTTSPRQQVKVFTTYRFSGDWHKLQVGAGINWQSRIYMTLKTPPPTPIEVEVGQEAYALVNLMASYAFTEQLKLSANLNNALDKTYYSQVGQYSQFQYGTPRSASLTLDYRF

SEQ ID NO: 2131 - protein, 353 aa, Shewanella putrefaciens 200
MKKTFISASVASVLALASFGALAEGPSFYGRLDLAVTNTDSSTTLQGSTKGATIGESGTYLENNFSWLGVKGSEKVADGVDIVYQMEFGVDNTTNSGNTFNARNTFLGFKTVAGTVLAGRNDTVFKQAEGNVDVFGNTNADIDRLVSAQAGAGRSGDGVWYYSPKIADLVTLNATYLFDDNYGTSESMYAVSATLGDKAFKEQNYYLAAAYNKAIDGVDAYRGVAQAKFGDFTVGGLFQHAESIVNDNRDGNSYFVNVVYKLQNGVNLKAEYGKDEAGFGSYFKNASGLNNNMTVDLDDVNVDQITIGADYRLVKSTLLFAHYAHYEGDFKQNGVKQDLIEDDVVSIGVRYDF

SEQ ID NO: 2132 - protein, 402 aa, Shewanella putrefaciens 200
MNKTLVATALAAIFLAPSVSAIEIYKDDKNAVEIGGFIDVRVINTQGETEVVNGASRINFGFSRELTNGWNAFAKLEWGVNPVGSSDIVYNNRFESVQDEFFYNRLGYAGLSHDQYGTITIGKQWGAWYDVVYSTNYGFVWDGNTAGVYTFNKDDGAVNGVGRGDKTVQYRNAFGDFSFAVQAQLKNSSFFTCDIENITENECEARWIEGGADAQQVTYDYTYGGALTYKVTEMLSVSAGVNRGEFDIDYGNGDQKTAVDLIYGAGITWGNFDNNGLYIAANVNKQENHDTDNIGRLIKDAQGAETLVSYKFDNGLRPFISYNVLDAGKDYVIQPNFNADPNDVFKRQFVVVGLHFVWDPNTVLYVEARKDYSDFTSADKVQEARMSLSEDDGIAIGIRYTL

SEQ ID NO: 2133 - protein, 737 aa, Shewanella putrefaciens 200
MKSRFAYSLIALALAQHSWVFATEKPIKNDIEPSSDTVQSDVIPAADASEPDAKLVTPERIAVHGRAMQMYVDKETTIGTKTAINVMELPQSVQVLTEQLIVDQAARNITDLYRSIAGVSEFSYSGVTFRGFRDDANVFYDGVRGDPYSGFSVPQLFNVQRVEVLKGPASALYGGGEPGGMINYVTKKPTFVESKELTLSTGSEDMIGGSLDFTGGLTQNLAYRFGAYYQQEDSFRNNADSQNAEVAGGLLYEISDDTKLTTTFDIIKQDLGGNRLRGVPVDDAGNFLVAPSYNANEKSDFQKMDALVLQAILDHQFTDNFSVKTQVRYLNNDSDQQYHESRGWATLDANKKPIMGDGTIKREYRVQARANDEISLTNDFVYAFDALGFEHEFLFGGDYHYVETEYHYKLATSNEGVGNLNIFDLNYGETNPSTYNLKDKNTDGIRANRYGVYVQEHLHFNEQWSLIAGLRFSQFDEYDKATGFSFSDNAITPRAGLNYRPIDSMSFYLNYSESFNPTSLTNQAENIGDGFLDPETGNQIELGMKNEWLDGQFMTTLAVYRIEKQNVAQANPLDTGDDDGIPAMLNFGEVRSEGIEWTLVGDLTDNLTVTANYAYNETEVIKGVTDDSLTNTFDSKHFANAPRHQAGIWTRYDINTLNSAIAFGMDYVGEQFSLDGQTVKPHTIFDMSWTTQWDQTQVRLNLKNIFDKEYAVSGFSERNGHFPGEPRNITLELSHKF

SEQ ID NO: 2134 - protein, 227 aa, Shewanella putrefaciens 200
MFKQSLVLASLIGASFAAQAVTVDLRHEYIDSGSNADRVSVSHRFANGLGFSVEAKWKSGGDKADRPFTDMVGNGHEDQISWRWKATDNIALTPAFTIESNDSRTIYKPNLHLQYSFDSGFYVAARYRYEYTRYPSSANKEDDKVNRGDAWVGWVLGDWRTELNYVYAKSSEGMVRNNNKDYSNEYNAKLAYKWDKNWAPYVEVGNVGVKETDERQTRFRLGVAYSF

SEQ ID NO: 2135 - protein, 426 aa, Shewanella putrefaciens 200
RSQSPNWLRPAPFVSDQAEAKGIVEDSTLNLLVGNYYFNRDNMDGGNDQYDWTQGICGNFSSGYTQGLIGVGVDAFGYLAIKLDGGDGTGGTGNMGRDADGEVNDSQGKAGGAVKFRVSKTELKVSDMQPSTAPVFPVGGSRILPQTASGIQLESSAIIDLDLEAGHFYSATSQDRNARDGGLFATYAGEEANYFDYFGGKYGFTDNLSASLYGAKLEDTWNQYSANLNYTIPLGGDESLNLDGNIFNTKDTGDAKAADISNTTYSVAAAFSFMKAHTITLGFQKVNGDTPFDYIGVGKNNRGGDSIFLAISIQYSDFNAPNEKSAKLRYDLQMAEDGVPGLSFMTRYVKGWDIDGTNTPANSAYAGLYGADGKHNETNFEAKYVVQSGPAKDLSFRIRQAWHFANADEGEGDTKEFRLIVDYPLS

SEQ ID NO: 2136 - protein, 183 aa, Wolbachia endosymbiont of Eurema hecabe
VRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKEFGFAYQAKAGVSYDVTPEIKLYAGARYFGSYGASFNKEAVSATKEINVLYSAVGAEA

SEQ ID NO: 2137 - protein, 162 aa, Wolbachia endosymbiont of Eurema hecabe
YSPLKASFLAGSGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAV

SEQ ID NO: 2138 - protein, 139 aa, Pseudomonas fluorescens
SGDSTMVYRLGAQWDWDSSWLQSSYGRLTGYWDLGYTYWDGDETASNHSLSFSPVFVYEFAGQNVRPYIEAGIGVAAFSSTELESNKLGSSFQFEDRIGVGLRFAGQEIGLRAVHYSNAGLKNPNDGAEAYTLHYRTSF

SEQ ID NO: 2139 - protein, 98 aa, Pseudomonas fluorescens
  misc_feature (20)..(20): Xaa can be any naturally occurring amino acid
  misc_feature (92)..(92): Xaa can be any naturally occurring amino acid
IEMGGRAEARLALKDGKAEXKSRVRLNFLGTAQITDSLYGVGFYEGEFTTNDNGGATDGNNSSSDLTNRYLYGGIGGAFGEVTYGKNDGALXVITDFT

SEQ ID NO: 2140 - protein, 907 aa, Burkholderia cenocepacia PC184
MHKSNLLAKSVRLALISGVAVTTLNAPAVFAADEDGAKVERIEVTGSRIKRTDLETASPISVFSSEDIAASGAVTLEDFVQNIPAINGGAEGSSVNNGSRGYATASLRGLGSGRTLVLINGRRFASGDLNSIPTAYVERIEVLRDGASTVYGSDAIAGVINFITKKNFEGAEFNVQYDITGEGDGDKTLFSLTTGTSSERGNVVLSLQYTDRKAIGQGDRDFSSCPISENANGKYCGGSGTIPQGQFFYADGTPTSDGYVKDKTTGQVRLFDPTKDAYNFSPASYMVTPQEVFSINGAGRYEITDTLSTFIEGGFTNRQSDQLMAPEGTFWGPLMPASNPYNVTGEDIYVVRRLSETGGRGFSQDFSDYRMVFGFEGSLGNYDWDLAYNFARYVDTRLDTGRVNPTRVDTMLDPDLCAADSDCPGVWNILEENTLTDAMLAYMLVPNSPVVRGETRQLQGNISGGVGIELPGGEIMFAAGFEKRWEEYSNTPDGAASIGQIYSVAGEPTSGKYSVNELYTELDLPILEGVAFAESLRATAAVRYSDFDFLDDSSTNTKFGLEWVPVDGLMLRTTIASGFRAPGIGELFSPQSETNLAYTEPCKQYATGSQSAIVKANCAAEGLPGNFTLSSDQSSTVVGGNPDLKPEESDSFTAGFVYSHDVGITMSVDYFNIEITNGIGTAGTDNVINGCWSSENFSSPLCQFVKGPSLTGDAPHATSPYRSALGTVAGVLLTNANLSTFETAGYDFDFTYKTDLMSGSFSATLNGTYLEKYDYTPFDGADKVEAAGKVAADQWETTLAVFSKLRTNLNLTYTMDNWSVGWQTRYQSEGEDLYASASNLDNIADAVWYHDVQGTYYVFENTALTVGVRNLFDQEAPYITNNQDMNTIPVSYDTAGQYWYAKVNVKF

SEQ ID NO: 2141 - protein, 900 aa, Burkholderia cenocepacia PC184
MKQRALALAIKRILWAELALSAAIAAPAFAQSQPATTGGTAATTTSEVAPAATDAGNVTRMERVEVTGSLIRTSDKVGNTEVQTITPREIEQSGYTTVADFLRGTSANSGSSWGQTTMNSSAQGGGGIALRGLSEKYTLVLVDGQRVANYGKAVNFTDTFFDVNSIPLNMVDHIDIVKTGAVSVYGSDAIAGVVNIITKKNFQGLQIDGQLGKAQHPGDAQGSFSVLGGIGDLNSDRFNVTAAASYYRDSGSSLADRSLTANQDFSQFPGGLAGPLGPNQQSYWTAPDGTKVALSPCPPGSVSANGGSTCKSNPASTTSLVPGITRLNAKVRGTFKINDDVQAYADLWVSRNETVQNEGPAALSSATNAFNPATGSALPLSRTVSASNPYNPFGVATPISYTFPNTVSADTVSTFWRASTGVKGSFTTKKFGDWDWSADYGHSQSTVDTTYRNMLNVAGVESILQNGSFNFSNPSATPNGLNGVFQNDYEQAISKLDSVTAKTSTGNLFNLPGGPVGVGFGTEFRHESSLINSRTYTSQGITAPANIQTVNGSRNVAAVYYQVDIPIIRNLTFTQAGRYDHYSDFGGAFSPSFALRFQPVQALTTYASYSRGFRAPTLVENSQAVYLGHQNLVDPNDPSGVPTKHFTTEQTNGNPNLQPEHTKNYNIGFQLSPDSSTDIGAAFYKIHIDGVIGVNDPNAVMDANNPATVIRNPDGSVAYIKQQFVNLGSLDTDGFDMNFRKSVGTKYGTFTLAGDWAYVWHFKLNSPGAPTQDFAGNNLALLQPFGASNPRWKGNTSLSWDYRKFTTTLTWQYTGPYTNAVAAEFGDGGTLSVASYSQFNLMATYRGFKHWTIYGGINNIFDRKPPFDVEWQATPDITGYDQSLYTNIGRFFQVGATYRF

SEQ ID NO: 2142 - protein, 836 aa, Burkholderia cenocepacia PC184
MRQSFPDSRAKTGLGMRISLALLASTALVSGNGLSRPAAAQEESTLYAVPAGPLGLAITRFGERSGLQILYPADLVRGKQSPGVSGALTAPEALSRLLAGSGLTYRYTATDTVTIVALGATGASNTGPDGSILLDTISVSGGGAATEGSGSYATGAASVARGADSLKEVPQSVTVMTDKVLEDQNLTMMSEAMAKAPGVVAATDGSGNPQFFSRGFTIANYQVDNLGTAYESTFRPDFDLSIYDRVEVLRGAEGLFSAAGEPGGTVNLARKRPTDERQSSVSLAYGSWNNRRLEADLSGPLTEDGRLRGRMIGAWQDREYFYSPADEEKQVAYGILEYDLTPDTTIHAGATYQHQNGIRWAKGLPTYTDGTQLGLDRGIALNTDWSTRETTTWDMFIGAEHRFSEDWTLKFSAMRQRFDYRYTELSVGGPVDPATGVIGDPGAFSEDAGNHSDAVDLSISGRFEAWGREHKLVAGADWRRSDGKQIRNLYETSFPDGSLTIGDFPGLDLPPATLTGATTGWPAYGAKQQGVYARLDMAVSDRAHVIVGGRYGNYTHREIAENRDEDGNVTYRDSSFRWRETGIFTPYVGVTYDLTPDWTTYASLTEIYKPQGNTYAGPPENPTQLDPITGRNFELGAKGELMEGRLNVAAALYRIERNGEAVEDTRYGDEDGTFYLPLGKIVSQGVELEASGEIAPGWQVFAGYTYNQNKNENADAPYHALTPKHMFKLWTEYNLPGDLSKWTVGSGVTVKSKHANTGTYWLMGENGWTQPDFEIRQGGYAVWDAHVNYRVDDRWSVALNVNNLLDKTYYATLGVPNGGNWYGEPRNATLTLRGRF

SEQ ID NO: 2143 - protein, 754 aa, Burkholderia cenocepacia PC184
MKKVEQKKMEWATGTRLRAIAAAASVAFGTAAAGHAYAQTAPAVNAGATASASSAQTGATATTSTSAQNGTLPAITVNAASAGDGTVGLVAKRSTTGTKTDTPLNEIPQTINVVTAQQIEMTGATDVNAALRYVPGFSSYGSDNRSDWYAALRGFTPTAYVNGLQVPNTINLASWRVDPYMIDSISVLRGPTSVLYGAGDPGAIIDVHTKLADGERVREAGVQIGNYARKQFMIDVGDKLDPDGKYAYRFVGVARDGNALTGPNNDQRVALAPSFRWRPDADTSLTLSATYLQDWGDISSNFLPAQGTVLPNPNGQINKDIYEGDGNFNYYRKKQWSVGYQFERNLTPAWTFRQNTRLMHLSLDNGSVFGNGFVEGSTTDVSRWAGVFQMNYSRFDIDNNLEGRFATGPLQHTLLLGFQYNRQTATDSEWLAAAPPLNIYNPVYQPVTTAVFTPDATIRTNTYTTINTFGLYAQDQIKWNRWTLTLGGREDWVNMRMDDRAAGTSTKADVTAFTGRVGLTYQGDYGLSPYVSYATSFNPLIGVNLVGGGLPQPTRGKQIEAGLRWQPPGKNLMLNAAIYQINQTNVLTSALPSQDPTGTKSVQTGEVRSRGIELSATGKVTRNLSVIASYVYQDVKNVQANDVSLNNWPVDIPRPRQMASLWTDWTWYTGPLAGFGLGGGIRYQSASAGAADNSLTVSSVTLFDAGLHYDVRNWRFAVNGTNLFNRHYISGCQSNNVCIFGTDRTVIATAKYNW

SEQ ID NO: 2144 - protein, 858 aa, Burkholderia cenocepacia PC184
MGSESSTGPSSTDLPIMVSIRLTYRRRPAPARHLPRASRPAAPAAPGRLARRLAGAVLVSALLPLPALADTDTDAAPAAQRAPRRAFDIPAGPLEAALNRFGRDAGILLAFPAELTAGLTSGGVQGRFDIDGAFDRLLAGTGLVALRQPAGGYTLKRADGSLARPAAAGVAAGAELPAINVRTSALRAESYRAPKEAGVLRSDIPLLDTAQAVNIVPAQVLRDQRPRNLDDALGNVSGITQGNTLAGTQDTIMKRGFGGNRDGSIMQNGMPLVQGRAFNAAVDSVEVLKGPTSLLYGLMDPGGVVNVVTKQPQLKRYNAISLGASTFGHGKNGGSATFDSTGPVGDSRLAYRLIVDQSNEQYWRNFGEYRQTFVAPSLAWYGRDTQVAVSYQYRKFHSPFDRGTALDPRTNAPLDIPARRRIDEPFNNMDGESHLAQVSVDHQFNADWSAHFGYSYNRETYDANQLRTTGVDPVKGTMTRSNDATHGSLSTDSYGIGYVNGKLMLGGMQHDVQVGFDTEYRRIYRKDMLRQAVKTPFNYLNPVYGLLPPSSTVSASDSDQTDTLHDASAFVQDTIHLTDKWIVSGGLRYITYNQVAGRGRPFVANTDLSGSKWLPRAGVVYKWTDTFSLYGSYSQSLKPSSSIAPMTGYIIDGATPPEEATAWEVGGKLDLPGGVTGTLALFNIDKKNVLVSQYNDATKLTDWRTSGKARSRGIELDVSGKIGERVNVIASYAYIDAKTTEDPLYAGNQLWNVARHTASLAAVYDFGTVVGGDDLRIGADVRYVGARPGDSANSFTLPSYVLADAFATYDTRIGKQKLSFQLNVKNLFNRTYYPSSANRYFVAIGDARQVSLLTTLQF

SEQ ID NO: 2145 - protein, 386 aa, Burkholderia cenocepacia PC184
MKRTTLSLISLASFAAIPAAHAQSSVTLYGVIDTSITYVNHAQGKDNAWMLGNSSAGNLAGSRWGVKGTEDLGGALKALFQLENGFDPSNGRQGQGGRLFGRQAFVGLTSERYGTLTFGRQYDPLVDLVQGITADNYLGSVFATPGDVDNYDNSFRVDNAVKYTSAVYSGLQFSAMYSFGGIAGSTGAAQSYSAAVSYNNGPFSVAGGYFHATNSPASNGPRNGWTSSSDGTFDGPINNGYASAHSIGIARIAGQYVAGPFTFGLGYSNAQYRRDASSAFDSNEHYNTGQGFVNYQATDALLVGVGYSYTRSGGDTSATYHQVSAGADYNLSKRTDVYLSAAYQHASGQTGDGNGGSMAAQASIASYGYAGTSSQTMVNLGLRHRF

SEQ ID NO: 2146 - protein, 701 aa, Burkholderia cenocepacia PC184
MLGCAMATTGALAAEAAASASDDRHALPAINVTASSAPADPLTQPLETGSRLGLASLDTPASVETVTADTIDARGDRTVLDAVTRTAGFASAIAPGTGGTALSVRGFSGQESVMTLLDGVRLMPAAGTITFPFDTWSVARIEVLRGPASVLYGEGAIGGVVNVVPKRPQRTRETTLQAGVGPDGAKRFAFDTTGGLGPQLSYRFYASDARANGLAERADTHTTAIGGALTFDVSPQLTLTLDYDYGRQMPATYYGVPAPNGVLDPSLRKLNYTVGDATISYYDQWTRLSARYRPAPGVTIDNQLYYLTSNRHWRNAESYVLDPATARVTRGDYLDIGHHQRQIGDRLSARFDGMLFGRANRFVVGTEFSQITFSGINNSPYGGETTVPAQGFDPGVFTSPDPTVPQFSTRARQAAVFVENRLEVLPRLAWVSGLRYDHIAFSREQAATAAGLDKRFANVGWRTGVVFDIAPTFSAYAQYTTGAEGVGSLVTLSASQMNYRLATGEQWEAGLKQTLLDGRAYWTFAVYDITKRNLLSTDPFNPALRQQVGRQSSRGIELTGGARLPHGWTIDANVALLRARYDAFNQTVGGATVSRAGNVPSGVPQQTANLWLGWAFAERWQANAGVRYVGATYGDDANRVQVPSYTVFDASLRWQPTSRTELALYLRNLANRTYAVTTSNGGEQWLLGPSRSAELVATMRF

SEQ ID NO: 2147 - protein, 724 aa, Burkholderia cenocepacia PC184
MTTRIDHPRARRAATGRCSGAPLAFSALCLASSWANAQGTPAPVGDMLPVLTVVGTRDADATTEGSGNYASKWATIGGKVAQSIKETPNSVSVLTRERMDDQNITTIQQALRSVTGVSSIDYGDGTAYFRARGSQLGIEFDGVPTLSGLQYQLQFDLAMYDRVEILRGPAGSIDGMGEPGGVVNLVRKRPQDQFHVATETQVDSFGSVRQMIDVTGPLNKDGTLRGRAVLVGSTGTQSIERTRSKEMMAYAALDWDLAPRTTLSLSGGYQVSPISGIDYGAGGVLNSTRTALTGRVPSDYTRNFSPSWNYAYTSLQEVNANLVHRFDSAWQASTTLFYRHELSKAYYAYSGPGATANGLARFGDQRQRTSYDWFGADTNVSGPVRLWGQTHTLTIGANYAVMTSGAQSGYRALSGPYGGAYSLYDPNAVPAVDVPYTFGTNHRTVQYGVYAQARIKLATPLTLVLGGREAFLQDRTQSTLPSVADWTTNAQINHRFLPSAGLLWDIVPSLTAYANYARFLDAQTQGTYSGPGLPPRSGEQYEVGIKSSLLDGRLNANAALFRINDDNRAVADPAHQFYYVSAGKARNQGIELELTGQPTPDWNLYAGYTYLNAHYENDSPDLTDGTDPKHLFKLWTRYTLSQGPLRGFSIGGGMLAQTRISRGVEQGGYAVFDAQAGYRFNKHVMASLQLNNVFNRRYYIRPPSTYYSVFGDARNVMLTVRSDF

SEQ ID NO: 2148 - protein, 918 aa, Burkholderia cenocepacia PC184
MRRSNMPTGKLRLLAGCATASLVLGTALGSAAQAQDNDVIVVQGFRSSLAQALDVKRDSNGVVDAIVAEDIAAFPDLNLAESIQRIPGISINRVAGEGRQITVRGLGADFTRVRINGMEALSTTGGSDASGGSNRGRGFDFNTFASDLFNQIRVTKTTSASMEEGSLGATVDLRTARPFDYGEGLTAAFSGQLGYNSLSEETSPRMAGLMSWVNPDETFGANLSIAFSDRTIIEEGFSTVRWQDGNFRSVNGATCPAGPDCASIDTNSRVYHPRIPRYGRLTNEQERLGITGGLQFRPSESTTVSLDALYSSFDATRTENFLEVFFRSQEGQIDVNTVTLDTGLNIMDSGTFDISANANGTHPIRSEGRYDELSTEFTQLTLNVDHDFSDRLRGNFLAGTVTSDFNNPVQTTILFDAVGDVTGYSYDFRDNINTPAIDFGSLDVTDPSQFAFTEVRDRPQSVSNSFDTFSASLEFDANETWTLSGGLNFKQYDFESREARRESTNGSIVCALPGVSCPAGATGLPITSGLFTTLTGFGNDLGMPVGNDTAWIVPNVQAAATAAGIYNIPGTVRSGNQRAVSEEDLGAFFQADFNAQLGDIPVRGDVGIRYVETTTSATGLVSGTEVTVERSYEDTLPSLNLTFEMSEDFLVRFGVAKVMARPSLGNLTPGGSLDSFNGPPFRYNAGNPGLDPYRATTYDASFEWYFDNEALFAVSLFYKDVSSFFTSSQSVEVAYSQSGLPANLPPASSPLFNLIQAGGDPLVEISQVSNGGSASVQGFEVAYQQPFTFLPEPFHNFGFQGNYTYVDSDEIIGFSPNAYNATLYYENERFSARISSAYRDAYVTRRASSSTGRDERGVDSSFNLDFASSYMVNDMIDLTFEAINLTDEFEQQIYDVGSLPNVYHHTGTEFLFGIRATF

SEQ ID NO: 2149 - protein, 786 aa, Burkholderia cenocepacia PC184
MSFTFAARSSRGRFALACAAAFAWPAAYAASTDDVRAEAARGGGVDRPAAAPAAADVAAASAQAGDTLTAVSVTAQRQPVDPDTPAVVTSITREQIDAHTNVTTEDALKYAPNLMVRKRYIGDRNSIFAGRDFNELQSARGLVYADGVLLSNLLGSSYAYPPRWSLIPPDDIARVDVLYGPFSALYPGNAIGSTVLLTTRRPEQLEASLSTQFFTQRYHDGYGFADSFGGNHQAARIANRVGRFWFALSLDRLENNGQPMQYASPNSTYNPKLGAAVPVTGAATDIGPNGKPRPIVGAQTIERTEQLNETVRMGYAFTDHVDATLTLGHWENHYRQHGETFLRDAAGNPVYGGNVSIGGQNMTVAPNAFAPQRGDQENWLYALGLNGRLDSGWRLSGVVSAYDVSRDVLRAASTVQGGAGTLFQGDGTGWRTLDLKAEAPAVKGHTFTFGYHYDNYFLRNVTYNTADWLAGPTTSLASVYRGDTRTQALFGQDAWRFAPRWLATLGLRYERWDAYGGALGNARGTLGYADRGANALSPKVALQWDATEVWRFRLSFATGTRFPTVGELFQGTISNNAIVNNNPNLRPEKAIDWDFTAERDVGVGVVRASVFQSDLRDSIYSQTTVSGATTVTNISNVDRVRVRGVELAFSGENVGVRGLDLDANVSASNAQILADAANPAYVGSRFPRIPRMRANLLASYRFDEHWLTSVGVRYSGRQFNTLDNSDVNPDVYGGTSSFTVVDLKARYRFDRHWTASAGIDNVTDRRYYTFHPYPGRTFYGELKWSL

SEQ ID NO: 2150 - protein, 841 aa, Burkholderia cenocepacia PC184
MPRPLPHQPQDGLAAARGWPASMGMAGVAAVLGVAMLVATAADCVHAAPSAQAGQAAQRSFSIAAGPLTHVIAQYANQAGVALSFDAAQLGRLQSPGLQGSYGVEDGFARLLQGTALQAVRESSGVYTLRPLPAAASGTGGQTLGTVTVRATAPASATTEASDSYAASLVTGYKGLQSVRDIPQPVTVLTRQWLDEQALPDLHAVLQHTPGVTVEYIDSERIAYYSRGYQIDSLQVDGLNVNQVASASTFIQPDTAMLDRVEVLRGATGLLRGAGSPSAMVNMVRKRPTAQWQGSAALTLGSWDRQRMEADLSGPLNAAGTLRGRLVALADDKASFQTARKEKRLGLYGVLEADLGPRTTLTAGLQHTDLQATGSWGGLPAAADGSQLGLPRSTYLGTPWNTWDRHNQQAFAELEHRLDSGWQLKAQAAHTRFRSDGFKQTSFSRASDSNPYLFDVSTSIYGGDGSTQNALSLLASGPFEALGRRHELSLGADLQRIRSTGATGYWGVSPLRNVDIRGWNPYTSYPEPFYSEGNGNAYSSPVSHIHQYGGFARARLSLTDSLTAIAGARLSWWSYLEPGNAQSGHSVRRELTPYAGLVHALSDTLDAYASYSEIFSPQDKKAADGSILAPARGEDLEAGLKGSFMDGRLQASVSVFRIQRVGSAMQDTASAMPCLPYYPTSHCFMAGGKSRSQGWELELSGEPAPGWQVLAGYTYTQARYLRDASEANVGQPLRPVEPRHALRLFASHRFKGPLQGWTAGAGVRLQSDAYASVGDVTTRQGGYALFDALLAYRLDDTYSLQLNVSNLLDKRYYAKFSPNSTYFNNYYGDPRNVTVSLRARF

SEQ ID NO: 2151 - protein, 392 aa, Burkholderia cenocepacia PC184
MILGDPLMKKSLLALVALGAFAGAAHAQSSVTLYGIIDEGFIFNNNAKGQHLYGLSSGVMQGSRFGLRGTEDLGGGLKAIFTLENGFDVNSGRLGQGGLMFGRQAYVGLSSQYGTVTLGRQYDSVVDFVGPLEAGDQWGGYIAAHPGDLDNFNNAYRVNNAVKYTSPTYGGFSFGGLYSFGGQAGQFSKNQVWSLGAGYNNGPLVLGVGYLNARTPANFGGMFNNGSTAATTAVSSPVYGAYANSANTYQVIGAGGAYTFGAATIGATYSNTKFKGFSAGPFVNQTATFNNGEINFKYQLTPALILGAAYDYTQGSKIDGNSAAKYHQGSLGVDYFLSKRTDVYVIGVYQHASGNTLDASGNVVQAHASINGLDPSSTSNQVAARVGIRHKF

SEQ ID NO: 2152 - protein, 243 aa, Burkholderia cenocepacia PC184
MKRKLAITGAAALAFTFAGGTAHAQSAGDFYVSTGWLHLSPQDSSDPLFVYRVGGTPINQSIPNTGAGINDADTLGLAAGYFVTDHISTELVMGIPPKFDITGKGQFDRFGVLGRAYQWSPAVLLRYHFNDANAKFRPYVGVGATYVWFTGAKITNSAFENGVLGGPTSATTSNQWAPVLNAGFTYNFTKHWFAGLSLSYIPVSVTATFTTARRTPVGTLTETSKAHISLNPIVTYLNLGYRF

SEQ ID NO: 2153 - protein, 264 aa, Burkholderia cenocepacia PC184
MFSPFPLAPGRRVTGLFLLCAGVNVQAAGFLEDGSAKVEARNVYFNRDFRDGYSSSSQGASKREEWAQGFILNVQSGYTQGPVGVGVDALGMFGFKLDSSPADSNSGLLPSSGHDPRHSADQYAKMGLAAKIKVSNTVLKYGSMMPDVPLLKYNDGRLLPTLFQGAMLTSEELHDLKFTLARLDKYTARDSTDRKDIRVHCKNKRYACDTERDHFDLAGVDYRFNERFSAQYQVAKLENIYRQHFLGLVASQPLPVGACRLTCA

SEQ ID NO: 2154 - protein, 743 aa, Burkholderia cenocepacia PC184
MTVSKTTARRTPRHRANAGLCAGVGITLFAAQAVAAPGDAPAAAATAAPDATLPAITVSGARGHTYRAREASVAGLDDAPLLDTPASVNVVTRAQLDDQQAKRLSDVVRNDASVVNDYAPVGYYEGFAIRGFPVDLASAIRIDGLTVSGEQNVPLENKERVEILKGLAGIDSGVVAPGGVINFVTKRSANVASVTAGVDSRGSTSAVVDVGRRFGPDNQFGFRVNAAKENMHSYIDGTNGRRTFGSIAADWDISPRASLQLNAEFQQWIQRSAPGYQLLGGTVVPSVHTTSKALGTQPWAKPVTTDALNLNARFDYQFNDDWKAYIAAGRSRTVIDDNSAFAYGCYYAASCAAGTTSPFFFGANGDYDVYDFRSPGEYRRNDDVRAVTTGKFATGPLRHELTLGVSVQRRVVHMAEAVYKDVGSENIYGPDTTFSPSPDVPGPSYPQLDAWQYGLFGLDRISIGEHWQVLAGGKEVLLRQRSWDSIDGPATRTDRSVFLPQVALVYKPVRALSLYASYSKALSLGDQAPVRATNAYAFLPPVESHQVEVGAKYDWLDRLSLTAALFTISKPFQFADPDASGSSYTFVQRGTQRHQGIELGAAGRLTERLSLSASVAAIRARAYDSGSAAYEGHQIINVPALRASLYADYAVPGVAGLDVLGGVEYSASRNANEEGTARVPSWFVFNLGARYTTKIAGHRTVLRVSVDNLFNKFYWRDAGEQQGDAYLFPGAPRTARVSLTYDF

SEQ ID NO: 2155 - protein, 735 aa, Burkholderia cenocepacia PC184
RTDMEAASPVLVMNRDEIEATGMISIGDILQTIPAAGSALNTAFNNGGNGSTNMDLRNLGSQRLLVLVNGKRWISSLGSTVDLNTIPTSAIDRIEVLKDGASAVYGSDAIAGVVNIITRKNFEGVEVSVYGGENAKYNDGRQYTADITFGSVSEKGGILFNMSHVTQQPIWAGDRDISDTGYSSTTDNTRLQIKGSQLNQTNQDALALIATPSDKGIYNLMTKEGTGTNLGPEQFRPRTGADVYNYAPDNYLSTPQNRNSFYIQGFYDISDNLRVVSDFMMTNRKSSQELAPMPLTLGASFGAAASRVDIGANNIYNPFGEALYGDSARAIANGEADGYVPYALQRRMVEAGSRRYEQNDTTYRAMVGLEGNLNDNWTWTANYIYGQNSQDELTTGLLNLTRINQALGDNCNASNGCVALNLFGGPGTVTQDMVDYISFDSVSRSGLTMKDYAFSISGDLFDLPAGPVGIAIGLERREETGFDTPDPLTVTGESSGNQRDATSGGFRLDEAFVELSIPVLESLLVTPAIRFSDHDAYGNNTTGKVGVEFRPMDDMLLRGTWAEGYRAPSISDLYAGSADSYPTWQDPCNNPNGQLDLSKNPGCAAVPVGYNQANTQIRISQVSSPDLKPETSESYTFGTVYNPRWLEGAEFTLDYYNIKVEDAIGRYGHTRIARECATLSNPASCDKIDRDSLGNIVDLRNFLQNAGEYNVEGIDFFTSYRFPETSFGSFKASLE

SEQ ID NO: 2156 - protein, 706 aa, Burkholderia cenocepacia PC184
MNVAISRKRPRLLYALVVALPLTAQAEETVVVTASPPASASAPTEGYSASTSLGATKTDQPLITTAQSVSVVTRQQMADQGANTISQALEYTPGVYSSFGGGATRFDAISLRGYHGGDVDNLFLDGMRLMSDGGSHNVVQIDPWFIERVDVIRGPSSALYGQSVPGGVVNLTSKRPQFSQQGHVRLTGGTQNTKGAAFDYTDAINEQWAWRLIGMTRSSDTQYDHTREERYAISPSLLWQPDSDTSLLLRAYLQKDPSGGYHGSLPLDGTRYAHNGRKLSPSTNEGDPGDGYQRRQQIYSYEFDHQFTDVWSVYSAGSYTHTNVSLDQVYQVGWIDDSDMLARGYSGSRGSLDGWSTDNRLRADFNTGDLAHTLILGAEYHRFRNDLWTGAGGAAPLNPFTGYTAQTGHTVTYSDDNHRRYYQTGLYLQDEMVWNRWHVDISARYDRIVSQQVSDTFGTSNRRSDDHISGRASLLYALDNGLSPYLSYSQAITPAMLPGADGKPLKPTTAEQVEAGLKFQPPGSRDLYSIAIYDLTQKDVATRDPNIATATYIPAGKVHSQGVELEAHHQITPQLSTIASYTWNRLRFQDTRDGTDNNTPQLTPDQMASFWARYQFPAGISVGAGVRYIGKQWADDANTARLPSVTLMDAMMRADLGVWSPTLKGAYVQVNANNIGDREYISGCYGTGNCYWGAERSVMATVGYDF

SEQ ID NO: 2157 - protein, 358 aa, Burkholderia cenocepacia PC184
MKAFARRASRTSVKLIAAAACVAAAAPVHAQSSVSLYGQVDEWVGATKFPGGDRAWNVSGGGMSTSYWGLHGAEDLGDGYKAIFTLESFFRAQNGQYGRFQGDTFFARNAYVGISSPYGTVTAGRLTTHLFLSTILFNPFYDSYTFSPMVYHVFLGLGTFPTYPSDQGAVGDSGWNNAVGYTSPSFGGLNFGAMYALGNQAGDNRSKKWSAQFNYANGPFAATAVYQYVNFNNGPQDLSALVTGMKSQGIALVGATYDLKLVKLFGQYMYTKNDQVAGSWHVNTAQGGVSVPIGVGNAMASYAYSRDAGGLDQTRQTWAVGYDYPLSKRTDVYAAYMNDHISGLSTGNTFGAGIRAKF

SEQ ID NO: 2158 - protein, 344 aa, Burkholderia cenocepacia PC184
MEELDPIQQLKAHKTNRKWSKKTMKKLLLAIAVSSVAAGSASAATIYEKDGFTYKLNGDFQVQMRQAIGNDERTEVEYDDLELKNYVSYDVGNNLTAFGRLDFGFKDAAEDDKNGSNLEEAYVGLKYNLVSFSFGKQNYASDEFGIEEAYEIKTIDDDRFDDTGTDGDDTLRVDVELDNVYIAVSHEMDARDDNDGIDGEYYDVFVATDIAGLNLAAAYQVNNSAGTADSRDTYGVSASYDFGFMNLAADYSVTDDNNTDFETKQYNIAAVFGVASTTDVAVGMGNKNSDENGFKDITEWYANVTYKFPQAKNVSVFAEVANSDLEKNGKEVDMGMLAGLRLKF

SEQ ID NO: 2159 - protein, 698 aa, Burkholderia cenocepacia PC184
MPPTSHAGRGLSFNVPSRRPIAPFPRGGRRALLAAGTLLSTGLTAQAQTAAEPIALDQITVTAGGFEQNVADAPASVSIITREDLERGNVTSLSDALREAQGVVTTGVAGEQDIFIRGLPGAYTLILVDGKRQGTRESRTNGNAGWEQSFIPPVAAIERIEVVRGPMSSLYGSDAMGGVINIITRKVADRWSGSVTAETVLPEASEDSGNRQLSFYLSGPVVQDRLGLQIWGRVLDQDKAELLSGQPGQEDRDLTARLTWALTEDQELRLEAGRTGLDRDLTPGRTLDETANPSRQKNIREHWSVSHSGRWGDVTTDLSFQQEKGRRTTWSTVEGRLVEDERAPEIVNSVLDAKVTVPLTWAGSHTLVGGGQYKRADLTDQNPGIGDGRDYDWQLDEWALFLEDEWRLHPDFALTLGARYTQNEDFGGHVTPRLYGVWNVTPDLTIKGGASAGYRTPEIRQTAAGYYYTTERGAGVIVANSDLDPESSTSYEIGALWQSGRFELGATAYRTDFADKIESRKTDRRITVGGTDYNRWEWYNVQDATLTGVELTARAEITDSLSLRGSYTWTHSEQESGDYEGLPLARTPEHMASLRLDWLTPVDGLEAWSAATYHGSEINAGARIGSNGRPYAENDAGQVIAYKYGSYATVDVGASYRVSEAMMLNAAVYNLFDEGISVEEQNASGSDRRLWVGLTANF

SEQ ID NO: 2160 - protein, 390 aa, Burkholderia cenocepacia PC184
MPGTAGFPHRSSGRLFDGFPAADTASRQHQRQTDAARYGEPDVTTPRFIRTAAAAATLAACGAAAHAQSALTLYGALDAGVQYLTHADGHRSTVRLQNYGILPSQVGIKGHEDLGGSWRALFKLEQGLNLNDGTATVPGYAFFRGAYVGIAGPVGTVTLGRQFSVLFDKTLFYDPLWYGSYSGQGVLVPMNANFIDHSVKYQSPTFAGFDVEALAATAGVAGNTRAGRVLELGGQYTSNGLSVGAVLHQAHGDVSAADDVSARRRELGTLAARYAFATLPLTVYAGVERLTGDLDAARTIVWGGARYLTSNGIGLNAGVYHTDSHAPAIGHPTLFIASTTYALSKRTVAYVNLGYARNSGQSSQTVYEYDPTPLAGASQFGAMVGMYHLF

SEQ ID NO: 2161 - protein, 382 aa, Burkholderia cenocepacia PC184
MNKRWGIVAPAVVLAAAAHAQSSVMLYGKIEDGINYTSNARGHGTVQLQSGYDYGSRWGLKGTEDLGGGYKAIFQLENGFDVNNGRLGQGNREFGRQAFVGIASERYGTLTFGRQYDPSVDMFSPLTANGNWTGYLFAHPYDNDNTDYSFRVNNAVKYVSPTWNGVTAEGMYAVSNQAGGFANHRLCGAALQYRHGGLTLGASYVKMNNARSTDAAGAVTGDNTFDASSQQNIGIGATYEFSNALIGFAYSHVDVYDPTANAYFTGTTQPAGGRWKSWKFDNFEINGLYHVTPAFYVGAAYTYTQARVDSTVGAFNPKWHQLSMKLDYDLSKRSSVFVEGVYQHAMNAHTGTDFDYAYIPGAADIASGPNQYVVRLALLHQF

SEQ ID NO: 2162 - protein, 389 aa, Burkholderia cenocepacia PC184
MKRRSKKLPWYVFAPALLLAGTAHAQQSITLYGLIDEGLNFTSNAGGHRAWQMSSGDTFGSRWGLKGSEDLGGGDKAIFQLENGFNVNSGKLGQDSSMFGRQAFVGLSSSRYGTLTLGRQYDTSVDALGFGGITAAGNWAGDIATHPFDNDNTDWDFRVNNAVKYVTPTYRGLTAEAMYGFSNQPGGFSNNRVWGATLNYQSGNLTAAASYLKLNNPGLAAGGAVNSGDLFNGSSQQDIGVAASYQFTHVLVGAAWSHVDVYNPAGNAWIDNTALQNGATWNAWKFDNFELNAQYYFTHALWLGASYTFTIAHLYTSDTKYVPKWHQIGMMLDYDLSKRTSLYLQGAWQHVVSARTGTSFDDAQIVDASAGASSGPNQMVYRMGMVHRF

SEQ ID NO: 2163 - protein, 596 aa, Burkholderia cenocepacia PC184
MHGNLFIGSTLIGNATLTGGGSLFLDGALFGNMNVLQGLLGGNGTIFGNLYNSSVVSPGHSPGQIHMTGNFAQSPSGLLQIQIGGRDLTQHDLLSVDGTASLAGALQLIRLDGFKLKRNKPVTFLTANGGVDGRFAMVENGFTSDTILEPTVVYHTNSVALEAVQGSFAAYAENAGLTPNQRSVARALDSAANDRHANALFDYLDYRKLSDLPRAFDKIAPDELTSMFTIGVSLANVQSGNIQRRNDDIRSGSAGFNAAGLALNGAGPSYSGSFSGVAGPSGDDGKQSKEVQQVAPADTRWGAFLSGTGEWVSVGNTDNARGYTIDSGGFTLGLDYKVTPNLAIGVAAGYTGTTADLTEGGRVYVNGGKIGLYATYYEYQQVKAAPTMSKDAAKEGLTPTYAEARGFYADAAVFGGYNSYHTHRAALQDDATGDTDGGELNVLFGGGYDFRQGNFTFGPTASFSYTYLGTNAFTEHGSLAPLDIHGGKGESLRTAFGIKASYDWKVGGVLIKPEIRAAWQHEYGDTAYSLDSSFANGAGDSFRVAGPQLGRDSALLGAGFAIQCSERCSTYFYYDGELGRRNFQSTSVTGGFRLAF

SEQ ID NO: 2164 - protein, 766 aa, Burkholderia cenocepacia PC184
MRIVAVLLASTSLVAAPAFAAEEAAPAPVAPEAISDAAAAEIVVMGQGQTRQVQELSTQELTILASGTSPLKAIEKLPSVNFQSADAFGTYEWSTRVTIRGFSQNQLGFNIDGIPLGDMSYGNANGLHISRAISPENIGVTRVSQGSGSITAQSTNNLGGTLEFFSIDPKDALGVTASASYGSENTWRGFARIGLGTTDGARAFASVQYQDGEKWKGDGKQRTLMVNAKGVLPLGGGTELDGYVSYSDRAEQDYQDLSLAMIQRLGYDWDNFGPSRYAEAVRVADIAANRGDTGTAPLNAAAGTTYPSPIASADDAYYDASGLRKDTLASLGLTTPLGDALTFKVKGYYHENDGQGTWGSPYVNSPTGVPMALRTTEYDIKRKGVFAALSGTFGINELTVGGWYEKNDFIQSRKFYAYESRTNPGRDHLKFQHNPFYTQWSIAFETDTLQYYVSDDVDLGDLKVNLGWKGYSVDTNAFALVNVSGLATGDIKVEDWFQPHVGLNYKLGDGLEAFAGFTQVTRAYQASATSGPFSTTQAGFNAIKDKLKPESSDTWEAGLRYNTGVINASLAGYYVNFRDRLLVIPTSVGVVGSANVLQNVGSVRALGIEAAVDVKLPGGFGAFASYSYNDTTYRDDVTITAGGTTVVRATAGKTVVDTPKHLLRGELSYDSQTVFGRVGVNYMSKRYFTYLNDQSVPGRALVDATIGYRLDIGQRQPVELQLNAVNLFDKRYVATIGSNGFGFSGDNQTLLAGAPRQVFVTLKAGF

SEQ ID NO: 2165 - protein, 383 aa, Burkholderia cenocepacia PC184
MHGACVGRSRLRGGITLRFKYFASLIAAVVPAAAFAQTSVTLYGRIDGGVEYLNHIATPNGSATRWSAESGDWGTSMFGLKGIEDLGGGMSTVFNLETAFQVMNGRTGGGRLWSRRAYVGLKSDAWGQLQAGRNLFIDSDGVWEFDPFVQQAFSSASLVRGRNWQQTSNNIEYHSPVIGGFDVQAQYAFGNQSRGFNYGAADDFGRSDGIMISYHSPVLDVRGIYDELRDNNGKFSNIFTASREYFVGANVKVSKFKIQGAYTHYQAPDSPAGVADRADHYWLGATYAANPQWAVTAGGYYVKVGDGGGDASHDPSGHAIMYVLGTTYNLSKRTFLYGTVAYVRNGGNSNFSLLATPRDATPNTSPMAGESQTGAYVGMMHTF

SEQ ID NO: 2166 - protein, 993 aa, Burkholderia cenocepacia PC184
MKVFYLLKPCLLLLILLTAITVQAQTSSIAGTVLDETGQPLPGASVQIKSVNKSTFTDAVGKFRITGMTNGPVIITVSYIGYQTLEQPATISGNTVISISVKPDAQNLNEIVVIGYGAVQKKDLTGSITTVGSKDFQKGSITTPEQLIQGKVAGVNITSNSGQPGGGSVIRIRGGASLNASNDPLIVIDGVPFSGNTIGNAPSPLALVNPDDIETMTVLKDANATAIYGSRASNGVILITTKKGKSGAPVINFSSNNSYETVARKVNVLSAGQIRDYVNQNGNRSYDDDPAHTYISLLGGANTDWQNEIYRNTFSTDNNLSISGDFKGVPYRISGGYLDKQGLLITDGFNRATGGISLSPKLFNDHLKIDLNLKGSLTEAHFANGGSIGAAIQFDPTQSVNASNQFGNYFEWIQGAVPNPNAPRNPVALIRLQDNNGNTERSFGNLKMDYSFHFLPELHANLNLGYDVSKGYGMIRVPEYAAQSASTQGSISRSLGTQNNKVSEFYLNYVKDVKGIKSKFDVTTGYGYYDNSSTTFNIPTFRGNGVDLITTPVFPFGLEREKLLSYYGRFIYTLADNYILSATMRADASSRFSEDNRWGYFPSIGFTWRAIGESFLRDSKVVSDLKIRLSYGETGNKDGIGNYNYLSKYYANSNQGQYQIGNTFYNYYTPAAYDPDLKWETTTTYNAGLDYGFFNGRIYGSVDAYYKKTKDLLSTVDIPSGTNFNNRLLTNVGNMEVKGLEASINFSAIRTENVNWDFGFNMAYNNREVTNLSLNPDPNFIIDAGGITGGTGINIKYNAINHVPGSFYVYKQVYNENGMPLEGVYEDLDGNGIINTGDQYFYKAPDPKFTFGFNTSFNVKKWTISTVLRANLGNYVYDNVSSNFGVRSNILSPSGIINNANSDIYNTNFTNNQYLSDYYIKNASFLKMDNAGIAYNAGQLFKDRATTLRISANVQNVFVISKYKGLDPELPTGIDFNLYPRPRTYTLGLNVGF

SEQ ID NO: 2167 - protein, 642 aa, Burkholderia cenocepacia PC184
MNIRHLLATSAATALLSPLAHAAGDMAQAQPAAPASGADLPTISVTDTRHLPESFDRRYASTQVLTREDLDRLSPADPSITQALATLPGVTVAQNGGPGSSASVSIRGSSASQVAVFIDGIRIGSPTTGIAPWADLPTEAFERVEVISGPAAASFGNNAMGGVVQLFTRRAAHQPNQTTVSFGGGSNKTFDTQFRTSGTVPSTGPMAALGGLTYSLGLHDYNTAGIDATRPFFYGHEDGRNPYHAQDLDARLGYARDNWSISTFALYHRSDLSYDNSGYANRELDHQLTTGVAFHLDITPDTQFDQSFGYANDRQFIYADNPALATDQINSQRISTSTSLTHQEHGFHLFGLPLSGESKLAYDFTREQAFLPVDIPGGVPTRNDSAFSLHQSATLGRVTMFVAGRHEIIAGQAVNTGNAALSWAITPVYTARVSYGNAFRLPTFNDLYYPGYGNPNLSPERSTSVEAALDANTAYGTFTAAIYDTRVSNLIAYNPATFSPMNIGRSHIRGIDLSYKGTIGRSTPVSVAVGILNPQDETNQTWLSRRPRQTVSLNVDHTWDELKLHALSTGASLLYGGSTFDDPANRQYLASYLTVSLRASYRINAHLTVSASLSNLFDRQYMTAYGYNTLGRTAFGKVSYTF

SEQ ID NO: 2168 - protein, 418 aa, Burkholderia cenocepacia PC184
MLVGSGTVRSRPGRPCACRAFLYLRRTLVSSPTRRSFPMKKTLIAGAGAAALLTPLAHAQSSVTLYGLIDAGIAYTNNVNGASQWRMTTGTINGSRFGLRGTEDLGGGLKALFVLENGFNANNGGLGQDGKLFGRHAYVGLSRAGYGTLTLGRQYDTMVDFVAPLSATSGDFGDTGFAHPFDNDNLNHSLRINNAVKYTSDTIAGFKVGALYAFSNSANFSANRAYSVAASYTNGPLKLAGAYLQMNGTKGSTSASPGATDSAEAKSLNQGGWSIGSDRMRTYGGGVSYVFGPATVGFVYTRSQYDNTGAFGSSGQIAFNNYDVNVRYAVTPAVSVGAAYVYTDASVSNPDSKHGTDPKWHQANLQAVYKLSRRTDLYAEAMFQHASGRGYQAFINTSGGASSTANQVVGTIGMRTRF

SEQ ID NO: 2169 - protein, 894 aa, Burkholderia cenocepacia PC184
MHSAPIPLPLKLLPALLLLAALPTLADTPSAESLESVTVTGSRIARSAKEGPTSVTVITGADIEKQGYTNVYDALNNLTQNTGFTQGADFGNTFTPAANAISLRGLGPNHTLTLINGRRMADYPIAYEGQVNFVNLANIPSALIDRIEILNGGASAIYGSDAIAGVVNIILKKKTDGASINVKIGGAEHHGGENARLQLTGGKSWDQLSAIYGLEISQRNPIWSRQRGFMSDSTAQGEAPSPILARRIAGGGYLDAGSACGNFSGMFAGSVSTVGNSQKGYCASGLLKPSYWTIQTANQSQSGFLSLSYLANPHVELFSDAMIGLNHTENNTRGPNWTAAAGQGNYFRNQNTGNYEIWNKRFAPEELGGTSNYNRKWDDLAANLTLGARGELTGSWNYEAAYNASLYTSRATTPMLLSGVNAYFLGPQLGADGSGIPIYAPNLARFYQPLTPAQASGLIGDSNSHNKSWLQVLSLSASGEAFQLPAGPAKLAGLLEWGSQGFSNDPDQRLNQGVFYNANPAIGASGSRSREAAGAELLLPLAKPLNLTLSGRYDRYQITGNNEGKFTYGAGLEYRPIGSLLLRGNYATSFRAPDMSYLFQTQTRGYYSSTTDYWRCAQSGQPLASCQYAGVSPGSNYVSNGNPGLKPESGKSYGFGFVWSPSRDADLSLDYWNITIDDLVTTLSADKLLQDEARCRAGGYDGGSALCRDALSRIVRNPANALVDPGAINTIIVNPINAASERTSGIDLSGKYRLRTARLGDFLFKAAYTKVLTHTYQQFASDPAQNELTDMSNTDWPDKLDFTTTWNIGDWSSTLLLTRYGKIPNGAGTGYLTPTVLANLSVTYQASKKTSIGVIVNNLQDFIKKDYTGGWPYYPVGSYTPYGRQAWLELNHKF

SEQ ID NO: 2170 - protein, 1198 aa, Burkholderia cenocepacia PC184
MLVGLGDSRQFQKWEIEDTMKVFSILATLALLTSAAAWSQDTRGTISGRVLDPSGSVIPGASVTVTNPEMGIKAALTTNADGIYRAPLLSPGMYQIEVTAQGFKKALRSAVEVRVADRLVVDIPLEIGASEQQVTVTSEVPLLNTETASVGTVIDSKRVADLPLSYGNPFLLIGLTAGVTFNGSVRLDRPFEPTHIVNFSMGGTSGLLNDVTIDGAPTTSRANANQVTASYVPPTDIVQEFKVQTATFDAQFGQTQGGVTNISIKSGTNQFHGTANYSFQRPSFWANDFFLNKTGTPRPNFSFDTWGGSFSGPVRIPKLYNGKNKTFFLFGYEGIHDSRPRHDDTTNTVPTPAMHNGDFSALLAAGPSYTIYDPATRVAVAGGRFQETAFPNNKIPTNRFDKVGAAILGYYPTTEKSQGDITGVGNYQDAGTAEKAKYWNGTWRVDQNLGDRQRFFVRYSTYTRNSTYNNYFDNPFVGTQFWFYSKTAVFDHVYTVSPTIVVNSRYSYNRFIRGSDEPASAVGFDIGSLGFSQQFVNQVGKDQARFPRINLTGYISNGSTNENRPTVNHTVASTLTKSAGKQSIRTGFEYRVYQQADRFASNQQSGQFTFGSTWTKGPLDNSAASSNSIGQSVAELLLGLPDSGSITRQSDYIEQSGAWGFFVQDDWKVSPKLTVNLGVRYELETPLHERYNRSTLGFDTNYVQPISAAAQAAYASIYPTISGGFPQLTPSQLVLRGGMTFAGQNGNDGSLYNTPKNNFMPRAGIAYQLDSKTVLRAGSGMFAGFLGQRRGDVLQNGFTQNTNLTLTNDNGLHFLTTLANPFPNGVADAVGSAAGLQTYLGQGFTYFNQNPKLPITIRWEAGLQRQFKNFVFEANYVGSKSNHLEVTRNINTLPAQYLSTLRTRDDTYNNLLTASIPNPMYNLVPGNSQGIYTGTTTSRQTLLSPFPAFGSNAINTTEYTGYSWYHSAQFTATKRFAKGYTLIGSYTFSKWQQAVNLLNASDPAPVREISDSDAPHRINISGVWSLPFGRNRALLNNTNGFVSRLVGGWEISSIWSIQSGFALPWGNMIYYGNPSDIVLPLDQRTPEHWFNVANFETASAKQLLGNQVRTWPFRFSTIRGPRQNNIDFALIKDTRISEGKDIQFRLEALNAGNHPYFPNPNMTVTTAQSIKDTGFGQISASTQSNYARRLQMALRFVF

SEQ ID NO: 2171 - protein, 363 aa, Burkholderia cenocepacia PC184
MKSRAERSIRTVVLTGSAAAACLAAPAAHAQSSVTMYGIMDAGIEFTNHAAPQGGNSVKLKSGNKNTSRWGLRGVEDLGGGLKAVFRLESGIDLANGASDDGPDSIFARRATVGLKGKWGELSLGRNFTVTYDYMLPFDPMGYAQNYSWATSSMATGGRKDGLFTRSSNAVRYDGEFSGFKFGALYGFGNVPGSMKTSSKYDFAVGYETGPFAAVVTFDRQNGAADSVTPADTVNYIQGIHAGLSYDFGNLKTMAGYRNYRRTFHTTAANQLSDMYWLGGSYQFTPTFSLIAAVYHQNIKGGTDTDPTLVSVRAQYALSKRTVLYAAGAFAIAKHDQKVGVSRDFNGYGTTQVGVTAGIQQRF

SEQ ID NO: 2172 - protein, 822 aa, Burkholderia cenocepacia PC184
MRGSDMKGLRTAFLIGTALCAVAARPALADEAEQPQASATPGPEEIIVTAQRRAESLNDVGMAIQAVTADTLQALRVTDVRDLTTVAPSFTVSQSYQGVPTYTLRGIGFNTINLSATSTVGTYVDEVAYAYPIMNTGPVMDLERVEVLKGPQGTLYGRNTTAGLINFITAKPTDTFEGAVSADVGNYRTWNLGGHVSGPLGEGIAARIAVRSEQSDKGWQVSNTRGDRLGKIDKLGVRGAVAIDPSDKTHIDLSVFWWRNRSDTVAGQGIGFTPATDPVTGTSLSHLFNAPGLADYIANNFPTSATQADWAPEASRSADVGTGLGLDGPLRENNRFWGLKLRWDQYIGDTMKFVSLTSYNDFKRDALSDWSGAPFEVLLQNTVGRIKSFAQEVHLEGETDKMNWLVGGYYANDRIIDSNRTMLGQNANVGLIRAVGSTLLGTPFNSNGYTLTEMLQAFRSYEDFGRIRTRTWSLFANADWQFTEQLKLTAGVRYTEDRQRYNGCSRDFNGNMLPNVNVVNRALYFQSYGVLAAPITQGQCNTFDPDSGTFGEVRSVLSENNVAWRVALDWSPNDDTLLYGSVSRGYKSGTTPINAANLARQNAPVTQEKLTAYELGIKASLADRRVQANLSAFYYDYRDKQISTYFADPIYTALSRLDNVPDSEAYGVEAELVVRPVQGLTMTGNALWLKTRINGYNGTNAAGEAQNFDGAEFIYSPHFQGSATIAYDAPVGSGLSATGAVSLRYQSESNTIFEDLALYKINSYATVNASIGLKSESGWSASIWAKNLFDKYYWSAVASNANVVVRFPNPPRTFGVTLGYNF

SEQ ID NO: 2173 - protein, 1024 aa, Burkholderia cenocepacia PC184
MKASFRKFLVSTTLTLPCSFQAFSLEIVVPNGTYNGDLREMFPYTITSNPEGTTAILSGNLNILNLDNSMAATPSSCFFNSAGSMTIIGKGHDVTFTNLRTSVNGAALSSLITSSPESFSYTITGVKTFSCSNCSALLGRNNSNSILSPKGGAVYSKSPIFFKNIQNLIFKDNCAADNGGALWGQVVDISNVTKSLKFLSNVGANGGAIGASTSLNVTRCPSILFRSNSASRLGGAIHSVNPQTPPPPPPPGNGVINTVVNFSDNGSVQFDSNNAKSGGAIYSKGNINFSNNVQLLMQNNTASPEIGDSNEVLGQGGAIYCTQATATKKAAPVFTGLTITNQHDIFFANNFAANAGGAIYGEKVSITSSGRTVFTNNTAKTGGAIYIADNGELSLSADYGNMTFYDNLNTNGGSPKRNAVTLGKGATIKLLAASGDHKLCFYDPIVTTLPEKAPNGSNTLTINPDRGNSAPFTNYIGTVLFSGAHANAESAPNASTIYQKVILGGGKLVLADKASLSVVSFDQQSDSILLMDNGTSLTITEHSYATSSEAVAAAASVVTAAEVSSVTSSTAATAASVTNQANSDGVVSIKDLHINLGSLTQDGEGAKIETKNTSGTITISEHISLDDVSGNAYENHDIFNRNTVTLKVLSLSTAGDNKITESDLQLTPRGDADPQYGYQGSWKLSWENGTNGDAQKKKVLKATWTKTGFVPSPERQASLVPNSLWGAFIDLRSMNALATASCDGFGYGKGLWVAGISNVFHHDRNCVSHGFRRISGGYVIGANSQTLSDSVFGVAFSQVFGKSKDYVVSTTKSQAIAGSAYLSIKRPLSNTIFTTFAARINYSHTNEDMKTRYTFIPEASGNWDNNCWLGEVGGSLPIVLQTTKLHLNQFVPFVNVQIGYAEHGSFREQLAEARSFCSSRLINLAIPCGFKIDRRSHSYPDFYSLAVSYVPDVWRRNPGCTTLLLANGARWKTPATNLDRQGLLIEGSSHTAVNNNIEIFSHGSCELRESSRNYNINVGSKFRF

SEQ ID NO: 2174 - protein, 385 aa, Burkholderia cenocepacia PC184
MKKLALSTLSLALLGAAGAAQAQSSVTLYGVIDTSITYVHGNDGQGNNSWSMGSGNLQGSRFGLKGSEDLGGGLKAIFQLENGFNSASGALGQGGRMFGRQAFVGLQSDQYGTLTLGRQYDPLVDLVQAVTADNYFGSVFATPGDVDNNDNSLRVSNAIKYTSPVWAGLQVEALYALGGVAGSTGKGQTWAAAAAYNNGPLGLAAGYFHANNSAPLSAVGQRTGWAGTSDAIFDGSGNFINNAYTSASSIGIAQVAGQYAFGPVTFGLGYSNAQYKADANSGFGTNQKYNTGRAFVTYQASAPLLLGVGYIYTKGSGQTDAKYHQVSLGADYSLSKRTDIYLVGAYQHASGKNADGTDAQASVGSYGIAGKSSQEIVALGLRHKF

SEQ ID NO: 2175 - protein, 692 aa, Burkholderia cenocepacia PC184
MRPTVCFPLSLLYLALQSHAVQANQVSAEEIKNNTPVEHIEVRHRRSSIMSEITEDAQKLVSMPGAMGDPLQAAFALPGVVAAGGSMSAPAVRGSSPQDNIFEVDFMPAGYIFHDFGMSIFNRNLIQDFKLYSAGYGTSYSNATGAVFDVNLRTPKYQKIKTTLDFSMFNAGLFVEGQITENTAFYFSARKSTLPLFFDEGDELEDEDGELTGVTVNEAPDDNDYQGKFIWDVNSENSIIFSFTGAQDKAGANFSQRSEFALKNPDYQGDAVFDRKFNSQSLIWDHASNKLSAKVGIGILNETERLEYGQVATLSEGFYQQAKDKQISYKARVNYLINKTNSLVFDTAYFDSESDFSYDMFHYICTELDPDCDLNQGERIADRSVFDTDSYFVALSHIWQFHADWQSEIGVQWQGNKYTDEAFLMPRIALSYYVNSDSTITAKFGQYNRMQDLEVIAPVIGNPELDSQLSNHATLGFSQHLADEWSWSIEGYYKSMENLPLALQGSEQFYSNEVEGRAYGVDLLVNKNKTDKWYGWVAISYAKSERTDLRQNITRDYYADTPLVVNIVFNYQINELWNGGFNFTARSGQAYTPIVGVRENPDYEGRFLPVYGEPFSERFANYHRLDIRFERELKFYDLDAQLILELMNVYGQDNVSHIDLDYQEINSVNDLIIKEQTDDFSMRPSIGFSVSF

SEQ ID NO: 2176 - protein, 649 aa, Burkholderia cenocepacia PC184
MSARPPSAGRTAIALACAAGPALAPALASAQEPALPAVVLDEQVIRLPRAEAEGRPPATITVVDRSTFEGEAKDVGQLVSAAPGVVVEEHGGMGQLTTVSIRGSTPDGVKVLLDGLPLNTAFGGGVDLSTIPRAWVDAVEVVRGPEGARYGAGALGGALNVVTRRPSAGSWSLETGGGSYDTARVAAELAAAVGPGSLMVAASADTTGGRFPFRLDPGLPGGPTVAAMRENAEARRAGLLAKLARPLSRGRLDALVEVSGGHRGLPGFAASPTPWAWQDDARLLAMGRVARFGAIGPATLATRGHLRLDRLDARVTGPRDPPVRQRGSAAGLALDATGSHAHGVLSASLEASGELIDADGLGRRRELLGVAAAVSEDLALAGGRFRLAPAVRAERAGRFGGVSGTLGLGARLGPALRARASVGRTFRPPGVAELHLQQGLLVPNPDLRPETAVAVDAGLVADGRAGLVAVTGHLTRYDDLVVYEPSDAFGRLKPFNSGRAMASGLEVEGATAPVGGPLRASARGSYTFLATELLRGAPAEVGHWIPYRPRHRAVLRAALAPGPATAHVELHHLGRRYRDRRGVNPIPPSTVWNAGLSARVARHPDVRIQLEVLNLADDRTLTDGLGDPLPPRTVMITLRAGSTPQENAP

SEQ ID NO: 2177 - protein, 386 aa, Burkholderia cenocepacia PC184
MKTPVRIVMMSGALLTAAHAAHATEVTLYGLFDTSLTVVWNADAQGRNLVGLGNGNLLGNRFGVKGAEDLGGGLKAIFTLENGFNPNTGALGQGNRMFGRQAFVGLESARWGTLTLGRQYDALADVAWPITGDFYFGSVYATPGDVDNYDTSSRTDNAVKYTSPVVGGFQFVGMYALGGVAGKSGAGQTWSAGLSYNHGPFDAAGGYYYAANRASLANGVRTGWNGTSDGTFDGSLVNGGYLSAKSIGIARGALRYTFAPFTIGIDYSNAQYKADAMTAFRSTQKYDTARGFFNYQATASLLVGVGYSYTKARGDTSATYHQVSAGADYVLSKRTDLYAVGAWQRANGEQRTLDGGTQAAQASIGSYGYGGTRTQGILNLGLRHRF

SEQ ID NO: 2178 - protein, 451 aa, Burkholderia cenocepacia PC184
MASFHSSLLTALCTLCTYGILTMPAYGLDPNHPKHHYHKYSERLKRSNAEDSAFYLSSASESSEDLRQEPRRHILTPVRNVLKDDPCDEGLSISKLLHSIEKETNSQISVDFTILPQWFYPKKSALATSEEKQPTWQFYVSPNISWQLYNSPTAGVGSIDFSYTLIRYWNNSAQNANNAIGIAGEINDYSSRTNTLSLLTFSQTFPGEMLTVSFGQYSLYSIDGTLYDNDQQCGFLSYALSQNASATYSSGSVGAYVQFTPIPSINIQAGFQDAYSIVGSSFDVYNLTKNRYNFYGYFSWAPQSCLGAGQYSALIYSTRNVPQQPVQTTGWSLNFGQYLGEKLYVFGRWNGSTGTAVNLNRSHVLGLASANPINRNPKDLLGAACSMSKVNPKVVTDKKIRKYETVIETFATVGFGPHLSLSPDLQVYIHPARRPDRRSATVYSIRANFFV

SEQ ID NO: 2179 - protein, 372 aa, Burkholderia cenocepacia PC184
MNHPNGRADRLAVPLAALLACIALPAVAQSSVTLYGRIDTAIEYANAGPNHVARMGSGNLWASQWGLKGVEDLGGGYATIFKLEDGFNAASGALSNSSALFGREAWVGITGPFGGVQFGELYTILHTTLVTYSLPGLGAGLAWGNATNNFVGPAFLRVRNSMRYTSPRYAGFMLRAMAARGANGAAGQPATLGDTYGAGINYVRGGLSVDVDYMQQKFSPVAASTLGSTSPAANGNYTLGAISYDFSVVKVAALYLRHRGGPDVATAIDGQSAYPHSDIMELSATVPIGRASLLLSIGHYRKVADSDGNADSYGIRFDYPLSKRTVLYTGAAMVRNGAHARFVVNGAAGGGVAVAKPGATASSLVAGILTSF

SEQ ID NO: 2180 - protein, 681 aa, Burkholderia cenocepacia PC184
MRRNTFIKKMSVLLCCQALSLSLFAQQQKVDTAHIYSIPEIMVSDPYQTREVRSASPLQVFNKEELKNLQALQVSDAVKHFAGVTVKDYGGIGGLKTVSIRSLGAQHTAVSYDGITVSDCQTGQVDIGRFSLNNVDRLSLNNGQSDNIFQPARFFASAGILNIQTLTPHFKEDKPTNIAAEFKTGSWGLVNPSLFLEQQLNKKWSMTANGEWMSSDGHYPFTLRYGNDADVQVSKEKRRNTDVENLRAEISAFANLSDKEQWRLKAYYYQSSRGLPNATTLYYDFSRQNLRDKNTFIQSQYKKEFSRKWVFQTSAKWNWSYQNYQDPDALTSVGGTDNSYYQQEYYLSASALYRIWNNLSFSLSTDGSINTMNANLQNFVSPTRYSWLTAFAGKYVNEWVTLSASALATVINEKAKNGGNAGNHRKLSPNVSISLKPFHNEELRFRFFYKDIFRLPSFNDLYYDKAGNINLKPESATQYNIGITYSKAINNFIPYLSATVDAYHNKVTDKIVATPTKNLFIWSMVNLGKVDIKGIDATASLSLQPLDKLRINLSGNYTYQRALDVTNSNPNSPEGKVYKHQIAYTPRVSASGQAGIETPWLNLSYSFLFSGKRYMLGQNISDNRLDSYSDHSISAYRDFKIQKVTASLNLEVLNLMNRNYEIVKNFPMPGRSVRVTIGVRY

SEQ ID NO: 2181 - protein, 774 aa, Burkholderia cenocepacia PC184
MVAAPVAAQEVEETDGDSQVIIVTATKRDQAIQDVPFSINAQTQEDIQKSGANTLEDLSRNVAGLSVQNLGPGQSQVSVRGVSAGQVVRDQPGVKEQVGVYLDESVISLSLFTPDLDLFDLNRVETLRGPQGTLFGSGSVGGTIRYITNQPVIGVTEGQVEGNVNLVDGDDLGWHLKGAVNVPVGDKVAARAVGYYTQYGGFINAIGPAGGEDVNDGERYGGRLAFRVDTGEGFSITPRVIYQKVSANGFNRQEIFNLYANPFTTPATAFDEREQYLKLRESFEDETLILDLVAEADLGPIIFTSVSSYTDRAILVSRDASALSGSVSVDLGFPDEGGIDLPSNLRDATDVSAITQELRFSSDTGGPFQWVLGGFYSQTDRFYRQRLPTPGYAAVTDATLGAGTSAAVANGFDNLDSPYNADLPYDLSQIAIFGEGTYALTEAFDVTIGARWYDYEEEREFNSGGLFANGDNAFDRTESDGVSPRILLSYDLSDMVTLNAQASKGFRLGGVNDPLNVTLCSPADEALFGNFQSYEDETLWNYEVGAKATGNGFFANVAGFYNDISDLQVTLDAGSCSSRVVFNVPEAHSMGIEAEVGFEPVPGFDLMLSGSWIEAEFDSTISDDAALVTATGIREGNRLPSVPELQFTASGSYEWQLGAGSDAYIAASWSHVGNRYTQPADQENNPRTFVHGLPYRGAPADASTTVDLLLPSYNIVNLSAGIDFDSGLSLIAYVNNVTDENALLSFDRERGGRARLAYRTNTPRTFGLTVRQSW

SEQ ID NO: 2182 - protein, 976 aa, Burkholderia cenocepacia PC184
MTDSRCHRPRVLSQALLLAMLSPFPALAQQADPQQLDAVTVTGSRIKRVQAEGPAPVQIIGSEEIRAQGFTTVYDMLGTLNQAIGTVEADVSWGSHTPNASPLNLRNLGPTRSLLLVNGRRVADYPLPYNGQSNVSNYSNIPAAAVDRVEVLTGGASAIYGSDAIAGVVNVILKQNYSGDQFRMRGGTSTEGGRDTADVSWAGGRTGDNWSVTYALQYTSRDPLFGRDRPQMDDASDAPYSAWTTEQRRVGFRPSSGIALIDNATGTRQAPPPGACEQFGGAYYRADRLLYNRNTDTTTNTGQLCGLSADYGDWLLRSGSKDLSGYLYGTWEFGNGVQAWTNLAVFDSEAQWGTSPPYVQLPAGLDYPAFHDVTSGQQLIGVRQFTANEVGSQAGLRNRNRERSWDISAGLRGTLADGRFDWDASLGRSYYRVQERISTVDWQRANDYFLGPQLGTVDGLPAYALDRARWWTPLTPGQYAQIGAHSVNRAASWVNQGALSLSGTLFDGWAGPIEFAAVVEAAQQGYRLNPDPRANLDYEVQNVDRGGGERTRYSGGLEFSVPLTTTLTATLAGRYDRYGDYEAFNDDANLLDIGTQKESTWSAGLQWRPIDSLLLRGSYATSFRAPDMHYLLGQPSSAQVRTLDQYRCIASGAYQTNNCTGDNTAVTYPFAINRRGTPDLESELGDSWTVGFVWDAFENFSFTADYWRIHLDEEIRDIDETTILRDEAGCRTGLTITPGQAWSNPGGADYCASILARVQRDGSGAITAIERGPINLAQRDVSGIDLSARYQLKTGFGDFQMGLDYTNLRSMREQTYRTDPNPERRDRDIRSKLRGSVSWLYGNWNATVYGDRVGAVPSVRSHWGLDRLDNPGGCVPFADGGVPDDRANCTDTDPNSPTFGQSTRKYFGRVGPAITWNVNVGYRITPAMKLNLYINNVFNSTGYNHKDPYKLDYEFYNSRLFSPVGREIAAEYVFDF

SEQ ID NO: 2183 - protein, 1028 aa, Burkholderia cenocepacia PC184
MTASLSPLPKACTARRRAGPGGNTAAGMPDMPPVRRSLCSALIAAILGPLPAAAQVVNNPQYAIGEHVEIAAGDYATVNHDPVLNVSKGGLMTVAGPVRVFSKGIGAMGLSVHGAGSRIELQDSQVHTTGNSAYGLYLFNGSGAPNGASALLDNTTLNTLDDNAAGVRMYGAGNRLDMAGGSIDTLGREAYGIYVGPGPGASIAVGDTRIRTVGAFAPAIALGSDGNHAKLERIDVTTEGQESAALSQIGENTMTVADSTLRTNGVLAPAVDVREGAMTMARTDVITTGESSHGLYASRELALDAQTAQLDVADSRVTTQGLGAAGAIARDGAEVTVTGTAVETHGDKAIGALSVRDDSIASLVDSTVVTHGELARGVQASYGGLVDLVDTTVRTEGERAAGAGIFGGELHLDGGSIVSAQGSAIEATTGLVRASRGAHIEGGNGTLLAVAAKAGEPVHLLLDNATARGNIVNVPAEDGSPTPAVTNLALSRGAAWEGATQAVRALSMQGGSQWTVTGDSAVQGVRLDGSTIAFAAPAGGAHKTLVVHGDYAAKDGKVVLNTVYGDDLAPSDKLVIDGGRASGNTALVVKRTSGDGATTKVGIPLVETRNGGTTDAAAFALDAASDGYRKDFGTVSAGGYDYMLTRGGASGRADDWYLVSAAKPAPPEPPAPPQPPEPPAPPQPIDPETVPPKPEVVPPPVRAVAPEPDAYLANADAAILMPIHTLHERSDQTLRAETDENARDGAVWLRAQGLSTSLGGGNGSGGRSVSGNGRLLHVGADMFRLEDGRGGSFRIGAMGLYASATSWSTRTLWNPVAQRYMPATARGSIDGYNAGLYATWYGNRDILTGPHVDTWLMFGAYSNRIGGSLPSDSYRSRTLTASIEGGYSLGVYDDGRSRFFVEPAAQIVYANYQAKGHDSPGGYIGVQRSNDVLARIGVRVHGVTPISALQALRPFIEANWWHGPGSHQLSVDGNPFELRMPRDRAEFKLGATGQLTRNLSVSASVGVDSNFSNYATVKGQLAAKYRWR

SEQ ID NO: 2184 - protein, 3088 aa, Burkholderia cenocepacia PC184
MRSTISGDGGLIKDGKGFLRLGGGKPQTYEGETIIEAGELRFAETTSTPETTDVSVNQDATLRLMGGLDTSGGLNTVGSIQGKGRIVLNTDQAHLSVNAPSSKKNHEFEGSILGGPGANALQGTFIKDGDAKLTLSGKNAYGSLIVEKGQLDIKDEAINTKGMEPSEASVSLRLGHDLSVKAGSALRVTGRDLDPMYGPRTPGEETSSEGTIAKIANHASPIIEFDDSINELTVENGSLLVASFTGALPTEYDAYKDNCKKGADPKTCYSIRPQISFEGGDDTLTNNGLIVGPGEADTGNHLQLRFQGGDDTLVNGLSEGKDRRSGSWLGCVTAGADDQGFNGYKFGNTCDVANEETGGNLSDADSKDAKRNYTVNVFMGAGNDAFTNHQGSYLRGNFYGEGGDDILGNQGVIRGNIVMGKGSDTVTFQGGGASNNGKSRGIGVLDDRLVLGTSSKIENDNSLDTDVNKLNLFGNVVVAYRNSLGWGVKEDLENCGGRKSTTGRSDYGCRWDDGGYGYAAIVGSKGKDSIWVKKKSDGTQPVAIWGSVELGASNDALRLGNTQDKFGGDLHLIGDLDLGSGNSQIISIDKNSDFSVRAIRGDNIDFQIYGLATLGGDSELGVFAADRDVDLKQGNTLSSYTGTTTINEGGTLRAGQAWSLSSESIHQVDGKLILGDNDNRREDQEIGELTGKGLVSLQNQSYLFYGGLNGDVEFSGTSKGDGALVKKGSGTTTFSGTFGHTGFTKVHDGTLLLQEDESLSEKSTVLISSSTKQPTLDLGDTTQRAPKYNLHGGTLKNGTLGGAQINVERRTNNAIDSIEGELVSVNVSSRNDFDEEVGLTFSGSNQFQSLKIDRATVLIDESASVELSGDILGGDFVSRGAAFELSDKLDIQGSLTVGGSIDLDAGNDLIRIGNQASVSSGVIDGGSGDFDVFWNQNGSLDFDTSNVKGFEIISYKGEGLAYLGDKASLIVTAADRDIDDSLYTEYGLIASTPSNNTLNFSSNSNAKNIESGLTVGLLQLDGDSTIHLRQGSLDIAALQSNSKGKTNKFILGEPLEVSAEAPLQSLRESLVRPGSGVDLDQVASGRLSVGASDQSIATIQQRGGLWSYEGDFSSTDLSGQGVVVAGNGSNEPDSQSSATFESITADGSRRLLVGARKDGVLSVTNGIHDSWSPVSKSDGAKKASLISNGEVVLGVSGGNNPSTYKGLTVAMKGGSITTLEDDAIGPQSPTLVRGLLQIGESEGSGVSQNFARRLIVGQTGSIQNGDLSITSLANAGEVHIDSLTINNGMKRLLDVLADRKQLDEDAPIRKVKAQGSLKNLGGNIEIAGELKYQDNDDSTDGHALINSRNLRDVISYEKNERNGAVPQPGTLTAQKITMGKNRDIISNSGIIATTTRDADETSINLGGGNDLILNRGSFDIGQSIIDGGEPLEITDSILNRDTRTVKGLNIFRQGYDRLSIFSKNPTSNSSGLVESQLVNFAAIKLEAGGDWIFPQGNDCRVTGVGRIFSADKTDCVGIVGQRNADQFLKITNGANVETGVMELGRSSSNSIEVLDGSLEVGLIDGVVGSERINVNSGDIIFDRTVNNSFNSLVVGDNSSSASVNAKAIQNIASIHVVNGSLDVDLLHATDLEDLGQDPELRIGASIDPSSFTLDGPTSLVEQISSNVVKGSLRVDETEGYSKALQLGGMWGYEGDFGDIDLDAQGIVTTTRSADDVSIQDDDEQDDIDAVTFKSITAAGDRRLLVGARQDGKLTILEGLHDSSLTEISNKAAILNNGEMVLGDLKGESDQTASTYRGATVVLKDGSLQTLYADAISPESPTFVRGLLSIGATGEIKQNFAKRLLVGNTGRIENGALSVTSLTNAGDVQIDSLTVNNGMKRLLDVLDDRGVLDEDSPLRKIKAQGSLKNLGGNFEIAGDLIYQDNADATAGHALINTRNLRDVINYEKNERNGAVPRPGTFAASRIMMGSNNDVILNSGIISTTTRDKGKTSITLRGGNDLILNRGTFDIGKSIIDGGEALILERTKPVQGLNVFRQGFDPRSDSSNNSSGLEESQLVNFAAIKLDAGGDWIFPQGQDCQVRGDQKVFSAELTPCVGITGGKEKDQEIVITDGARVEAGVVALGRDSTNTIRVEEGSLRAVLIEGGNELRQRFRDSRGLASNDLPVQKETIVLGENNSDADGELIVGGIVDVEAIHQLGGTWSYAVNASSDDFGVFPDTTAAGTIKVKTTDLNHDLKGTTSVSRATFQRIDGESNDLSIEVDSNAFLGVIDGIHGAKTSLTTKGEVSLSGESSYGGVTNIQDGAILYAENNSALSEKSSVVIEKDGLLDLQGFDNTILSISGSGDLVLNPRTSTMQNSDDEVKGADLVIKAGDFAGTIDDGSLSGLGSVTKISDADLTLSGVNTYSSPTFVEGGTLIAASSTALSPNSDFVLSNNGVLDLSIYPRQARFKAEDDNGYSAYLKSLTVNDESQLRVSSLAPLRVKEKLEFDQGEIAAFLDSGANSTAPIQIDEAGKFVFRKGRKLGPASLYMVVSNEEARQQEGTWNVIDGEVENADELAKNTYLLIPALPSEKNRENQADFVEIDGVDYRIAQFDGVDQPLADAALSDVRLEEGSLKLVVEQKSFAEIQEDLNGDDGDVDELPGCEDDDELCDVISDIDGEEDEASNVEEDSAVEIIEAVMDGLKDQEIEISFGFDYGQLAKLVTSGLAPRNVDAAGRGMALFNNQLVASVFDRQPMRQFEELIHESSVSRLDADLSSDIAAVESDSVEDLSSDIGIVEMDGVAYVDRDDDELDLANRDGVSAWMKGFGGNSRADDSSILYNDYDLSSYGTSFGVDIALSESFQIGAYANYGDVRIQHSSDDTGGGSWDSDGYGGGLTAQYSTRNFYIQGLVGASEFSGEQTRNILQINQDFGANTAKGDKKVTSYLGALRMGAPFKAGGVVLEPQAQAVWTQNREDGFSETSGTEKNLRLKYKDRTTNFLETELGMKLSVPIRTGERSLLVPSVRAAWLADWNQNNEAQRIGYKFTNQTVDFDSQLETQNGALIEAGLDYTIQNFNRTSVKVYARGGAEVWGGDRGTTWRGSGGVTFQF

SEQ ID NO: 2185 - protein, 793 aa, Burkholderia cenocepacia PC184
MMMKKIRGLFLSFLLLLISISAFSQHKTMISGKVLSTEKTTVDFATVYLKGTNYGGTTNEEGIYHLQAPAGEYTLVVSAIGYKTVEKPVKLMRGERTKMNVVISPQATELDEVVVVSNGVTRLKRSAFNAVALDTKALQNSTQNLSEALAQAPGMKIRESGGVGSDMQLMMDGFTGKHIKIFIDGVPQEGVGSSFGLNNIPVNYAERIEVYKGVVPVGFGTDAIGGVINIITKKNRNKWFLDASYSYGSFNTHKSYVNFGQTFRSGLTYEINVFQNYSDNNYYVDTPVKDFTTGAINKKKIEHVKRFHDTYHNEAVIGKIGFVDKKWADRLMFGFTYSHMYKDIQTGVRQEVVFGGKYRKGYSIMPSLDYRKRDFFVRGLDVVLTANYNKNMTNNVDTSSYEYNWRGEMRPLRMPGEQSYQNTRSDNNNWNGTLTANYRIGKAHTFTFNHVINAFRRSNQSLLNEDSEANAIPKETRKNISGLSYRLMPTEHWNLSVFGKYYNQFIAGPVATSSAQDDYIRTTNSVSAMGYGAAGTYFILKSLQAKLSYEKAYRLPTNEEMFGDEDLETGDISLRPENSDNVNLNLSYNETFGKHSVYVEGGLIYRNTKDYIQRNISDLSGGKYGATYVNHGRVETKGYNISVRYGFANWVSVGGNFTQMNVRDNVKTVTSGTNQESLTYGARMPNLPYQFANSDVTFYWRNLWKKGNTLSVTYDNLYMHSFPLYSEAVGSESEFVVPTQFSHNLTLSYGIQNGRYNISFECRNLTNEKLYDNFSLQKAGRAFYGKVRVYFGN

SEQ ID NO: 2186 - protein, 801 aa, Burkholderia cenocepacia PC184
MDGDGRPPPSRPAAPHAGLICWDGRTLPSKFPVRMRHVRVAVLLGLCAVALRLAPPALAQERAALNGYVRDAETGETLLQANVVVEGTGRGAATNNDGYYTLQGLSPGTQTIVFSYLGYQTRTETITLTAGETTRLDVELAPADLQTEEVVVTGEQDDASEQRMGVDKLPVATITELPSVLTPDVFRSLALLPGVTTASDYSSNLYIRGGGPAQTLIQLDRTTVYNPTHFFGFFSTFNPDAIKDVQLYKGTYPAEYGGRLGSVVDIYNKDGNRRETTGGLSLSTLATRGYIEGPYGGSDDDPAGSYMVAVRRSTLEPLLAALDDVDGLPDTFYFYDVNAKATYDAGPDDDLSLAVYGGQDQLFLRPGDGQEFDVDYGNRTLSADWTHLFSDRLFSTLTVAGSRYASTPVFELGGTRFTQTNEVSDASLKAGVEYVPGDQHTVEAGLHASRLTFQLRSTFDGDETFNQRLQGEQAALYLKDTYTPTSDWTIRGGLRATYFSEGDYLRLAPRLSVEHDLTSSVQLQAAYGRYHQFLTLETSQLFTAFDSWLMTDEGLLPSYGDQIALGVNAQLGDAWRLEVEGYARTMRDLFELDPFLPDPAGVPYADRFQVGDGRAYGTEVLIRRPEGRLNGFLSYTLSRTERRFPNINRSEGGPPQYYPPNFDRTHELTLALNYHLTDQWRVSGTFNYATGQAYTRPEQRYELVDSPFSFSPGVGGAQNVLVSPFNNARLPPYHRLDVGVARTGQFFGIAEYELQLQAINAYARRNVWFYQFENESDGTLDRNVTPQIPIPVPNVSFSLTF

SEQ ID NO: 2187 - protein, 370 aa, Burkholderia cenocepacia PC184
MKTLYKLAPLAMLGAFATHAGAQSSITLYGLISAGVGFATNQGGKNAWQALSGTNQNPRWGLKGKEDLGQGLSAVFQLENGFNVMTGTAAQNGREFGRMAYVGLADRTYGALTLGRQYDAIHDYIGPVIIASNGVNIGDNDNGYNDIRVQHSVKYVSPVYYGLKFTALYGFSNTTGFANNSAYSFGLGYERGPLRWSVVYAQYNHPYSATNQDGAIANDYASPLLIFSKSAMSPAAYASRQRIAGTGGFYTIGRAQFAAMFTDVRYDYLDNSHLHLQNLGVNVVYTMTPQLFLGAAYAFTNGKYDVIDKRPKWHQVNLQADYFLSKRTDVALTVIAQQAAGDADHAQIFAYARSTGTRQMMATLGVRHVF

SEQ ID NO: 2188 - protein, 430 aa, Burkholderia cenocepacia PC184
MPAARARNHIHRRINWFSVRFPVRIVQRFERQVDHEENHHMKQTKHLAALAVPAGFLLSAGAHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAVIDAQASVGSYGANSGTDSQELAIVGIRHKF

SEQ ID NO: 2189 - protein, 457 aa, Burkholderia cenocepacia PC184
MMRILIGAISTAVLAVTSQEVLATSDVFRFVGHGPVSTAMGGAATAFDVGAAGMMTNPATLSLMPPGSEIQLGLDFVLADIEVKNQATGETAPSRDHSKNRGPYAAPQLAYTYHSGSWGLGFGVFAQGGVGTEYGRNSFLSRATGGLDTGLENSSRLLTLNIPFAVSYEINEKLAVGASVDAVWQGLNLEMLMGADQVGSLIGAGRARGSLVPVLGGLPDFRGAHLSFTKNEPVASGVDAWGIGGRLGMIYKVTQDTVLGAAYSMESRIADMEGNATLTAVDAIIGQVALAGKVKISDFQTPAQLNLGISHQLNEQWLFAADVSRIFWKHAMKDIDVGFVQNNGGNIDILMPQNYKDQTALSLGVAYQTGKWTLRGGARIATQALRSDTMLAVIPAIPNRFGSAGFSYQFSPENRVDFAWPHSFKKKMDNNSQPNTSEPIKVEHAQDSFSIAYVNRF

SEQ ID NO: 2190 - protein, 274 aa, Burkholderia cenocepacia PC184
MKKLIVAGVVAGVSTLASAQQAGDNVATLGWLHIMPQDSTNGLTTNLASMPINGPLRLPGSFTSPGTSLTVNNADTVGLTLTHFFTDHIAVTSVLGVPPEFTLTGHGVIRPPGPAGALGNVDMDKSANQPAVKNARQWSPTIILQYYFNSSTAKFRPFVGIGVAYSWFSNIELNGNFAKDINENLGSVLAAGAGKPGATSVEGKASSSFTPVYNIGASYAIDKHWGLTATLTYMPLKTYSSLVIKAADGSTLATTRTRLKADPLITFVGISYKF

SEQ ID NO: 2191 - protein, 379 aa, Burkholderia cenocepacia PC184
MKHTKVAVAAALACAACIPAVGHAQSSVTLYGILDAGITYVNNTGGSHVVKFDDGVAYGNRFGLKGTEDLGGGLKAVFTLESGFHLGNGQLGFGGAEFGRQAYVGLQNDWGTLSFGNQLDITNELVSIYNISAWGSGYAIHQGDFDRFNGDRLPNSVKFLSNDLSGFKFGAMYSFGNVAGNFHRNSAWSAGASFTKGDFSIGAAYTRLNNPNGIYAFDPYAMIGTHTFLGQQTVTVDPATGARTDLFANTPMDVDSQGTFGIGTSYTIGKLTLDANYSYTTIKGFGQSSHMQVYEGGGLYQFTPALSFIAGYQHTRFEGHHWNQGTAGLHYLLSKRTDIYISGDYLRASQGVDAVVGYSFTPSTTQTQADVRIGMRHSF

SEQ ID NO: 2192 - protein, 414 aa, Burkholderia cenocepacia PC184
MRYEVLSIVIARTLPIMIVLPFCAISAEDSNGNSSSVKEDVYAVISTLMDVGADIRGDKFTHQNVGNRSSSINKSKILQQKNLNTADLTERASSVRNSTKNPSPKKNVTPKLTEVTFYQDGFLGTDNSSRLGAYVRFEQDKNTIEQQTLAAESNPEREGYSVTLGGDYLLNEKYLFGVALGLPFYDSGLENAESEIDGLVASGYFSYFQDQWYMDFTASYALVDTDIERKISHYSDNVINNSDDADSDIWVFSFGGGYVINQGYWNIALESTIQHTLSDSDRYTERPSRGNSNYLISKVDDVDNLESTMLISGASFSHSFRSSLGIFQPYLRSYVHYDFDSSSEKVISQLKADNSGMILPIIINSDDQLYGRAHLGVSSVFNNGWHGFAEASTLIGLDDLDAYTFTLGVGIPFN

SEQ ID NO: 2193 - protein, 795 aa, Burkholderia cenocepacia PC184
MRPAFSLALVLALPMDNAFSQSVNPSLQEVEVTGNIEKNDTSEAPALGSTIKTSGDTLETKKIQSLSELSQQVPGFYGFGSTPRLAGFSIRGLGNNQFNDGLDSSVGLYVDGVYLARQSYSAFGLYDLDTVDVYRGPQGSRYGLDSTAGEVQIQSRQPSHTRESNITLGLGNQGYRELSAASTGSLIEGELAGRISVFKQQRDGFLFNQFDGTLLNDQNRFGVRGQLLWTPSDELVIRFIGEYGELDQQCCAIALFGPVSRTIQASDEYMGYNRPGTNPADRVTDNNIQPLSKLTKESAAVVAEWGPPGRHKFVSITGLNRLAYNPTRNDDGTSMNLLEGSTTSESQQISQELRWHTDFKRLKTTVGVFALNQKLRGEEVGILGDEIALWALGGALRQQVPTLNRQNSGFLVNALLPPDALNGLRLSTPYSQSSNTLSAFSTADWRINAITTATAGIRYTESKRRGSISRSRSGGNLQSSPLAFTNTLTTVGNLIGQDLSAVTYDGLIDMLVGESFDRTDSRKDHGTSGQLALHRQLTKTLSGHASLTRGYKSGGLNLAGLSPSVRAQFDPEIADSFQVGLKRIEPTGRSLSSLTLYNTRVKNFQALTYEENMGLIPNPRQNNVLNIPEVRLQGVELEMAREVTRRLTVGAGVAYNRAISTEFANAPNEDTRKNDKNLSGKQLYNAPRWSGFVSLEQKLPNQGELQPYVGLDHTFRSATFGAVDQSRNSFIDAYQLTNLRLGVRNLKQKWHAQAWVKNLFDEDYKAAVSALYSLGEYGGYAGDPRTFGVSLDLSY

SEQ ID NO: 2194 - protein, 400 aa, Burkholderia cenocepacia PC184
MHIRTWIAAGVAGAAVVPACAQSGVTLYGTVDTGVIYSTNQQVTHADGSTSGGHAWQMDGGNLVPSRWGLQGTEALGGGLKAVFALEQQFLSASGQALQGGVAFSRQAWVGLRHDRYGTLGVGRQYDSYTDTLGAYVSSNSWATPYGSHLGDVDNLNAAFNFNNAIRFTSADFHGLTFGGTFGFGGQAGDFSARRGYALAVAYNRAPVSFGIGYLNLRQPLDAALGGANGYIGDFACGNAGAMYCLLQDAVSMKAFGVGGSIAFGEATVALTYTHTRLGDSAYFAAAARAQSASIAFDIAELNATYAFTPMLRGGIAYVFNRAKADSRGVTRFHQLNVGVNYSLSKRTALYAVAIGQIASGRGLGSDANGDPVNYAQIPVLANSNSNRQLAMMAGVKVDF

SEQ ID NO: 2195 - protein, 861 aa, Burkholderia cenocepacia PC184
MITEDISKENLFWSKVIMNANNLSCLIYCRCSLLLFAALGLTVTNHSFAAEEAEFDSEFLHLDKGINAIDIRRFSHGNPVPEGRYYSDIYVNNVWKGKADLQYLRTANTGAPTLCLTPELLSLIDLVKDTMSGNTSCFPASTGLSSASINFDLSTLRLNIEIPQALLNTRPRGYISPSQWQSGVPAAFINYDANYYQYSSSGTSNEQTYLGLKAGFNLWGWALRHRGSESWNNSYPAGYQNIETSIMHDLAPLRAQFTLGDFYTNGELMDSLSLRGVRLASDERMLPGSLRGYAPAVRGIANSNAKVTIYQNAHILYETTVPAGPFVINDLYPSGYAGDLIVKITESNGQTRMFTVPFAAVAQLIRPGFSRWQMSVGKYRYANKTYNDLIAQGTYQYGLTNDITLNSGLTTASGYTAGLAGLAFNTPLGAIASDITLSRTAFRYSGVTRKGYSLHSSYSINIPASNTNITLAAYRYSSKDFYHLKDALSANHNAFIDDVSVKSTAFYRPRNQFQISINQELGEKWGGMYLTGTTYNYWGHKGSRNEYQMGYSNFWKQLGYQIGLSQSRDNEQQRRDDRFYINFTLPLGESVQSPVFSTVLNYSKEEKNSIQTSISGTGGEDNQFSYGLSGNSQENGPSGYAMNGGYRSPYVNITTTVGHDTQNNNQRSFGASGAVVAHPYGVTLSNDLSDTFAIIHAEGAQGAAINNASGSRLDFWGNGIVPYVTPYEKNQISIDPSNLDLNVELSATEQEIIPRANSATLVKFDTKTGRSLLFDIRMSTGNPPPMASEVLDEHGQLAGYVAQAGKVFTRGLPEKGHLSVVWGPDNKDRCSFVYHVAHNKDDMQSQLVPVLCIQHPNQEKT

SEQ ID NO: 2196 - protein, 1197 aa, Burkholderia cenocepacia PC184
MKKRLSLIMLLVVLGAARAESADWTVSDPAASGSNTLSEAIDDLNSSGNDGDRIVFTNTVGPNISLGLNILDPITKSVEFVNDYTELDLTSSSLTGSHLLATESSDVELTFPANFNLHGYGLNNVTGLFGYQGVMIDGNLPNDISAESTEGDNAYGILGRGDVIDPIGYALPAPMSYDAVYDGDITISGSLNGSISAVSAANGAYGLKAGGNDSYTVDVLRKKYWVAGPWIHWYDADGVNISFAGDIDIEDDFSGDVTATAAGSDAYGFYAQGDPPLSLYTLSDDSEGDITIGGVLSGDVTATASGGENAYGFRAYNDISIGSVGRRSDVVATADTDNAYGFRAVTGSITIDGDFGGDVWAQAINGEDAYALRAGGLLTDSDITIGGSIGTRSDITALAGTDNAYGLSASRMISIGEDLDGDIWAQTGSGDNAYGLRAGTDITITGSVGERSDITAIAGGNIALGMFAGDDISMSSLDGQVTATAQNDWAIGLAALGDIAITDQDACLAGDVTATATDGKASAGLVALGMINGGDDGDGGYNPMHISGTVTATSGDGSAVGIMAWDAMNLRITGDISGIDSDNDVSGNDEGFAIRSGRFNLLFDGGDFNGSTSSAEDMIEVADGGSLTGKVFLGDGNDAMRVIGEDADPLNDAIISTVPVLDGGEGAEDLLTFDDWTGTLGNEVVNWETINLDGESVVNLGGSKTAENLYAAPGDDYAAIKTFADGQFVTMTIGEDARLVAQGAVPGSSAGEYVLVGNLNNNGVLDLLDDEVNDVFRIVSNDAGGGNYTAASELWIDADLSVSGVPSDEYVEIEGDATGTTTVLLNNVVSHVAVTDGDGIEIVSVGGTSDDDAFVLGNPNDFGPFAVDIARGTTDTESWFAVSPGYREEAAVLQAVTPFIERLGYDSVMKFHERRAYGWFRNDGGEQESWWVRMTGSKYRLGLEGDAATELDGYTGWFQVGADLIAEGDKDTRFDFGLFAGVGYGQADVDGLRSDTAGELSLTAYGIGTYLTLHDRGNWYLDAVAQAMYSDLAIDYLTEDRQKPDAWSYIASLETGGCIPVGSSFRFEPQAQLIYQHTEGISLSTLVGEVNIEDHDGLQGRLSLTGIAGACKDDLNPFFEVTLVRDFSDDNQVKYLDDSVELNSNPEKWFLGGAIGLSREVSEKNDLGYYLKAGALYGMDDLDSYSYSVMAGLKKSF

SEQ ID NO: 2197 - protein, 390 aa, Burkholderia cenocepacia PC184
MKQIRSFALLALPAALFVAGAHAQSSVTLYGIADAGIAYVHNAQNANGSNASNLVKFGSGNLSGSRWGLRGIEDLGSGLSALFQLENGFNIGTGALGQGQREFGRKAVVGLASSTYGTVTLGRQYDPIVDLVQGLTEDNYFGGVFATPGDLDNYDNSLRVSNSVKYTSPLISGFQFAALYGFGGVAGATGSGRTYSFGASYANGPLSLGAGYFYANGGTTLANGVRTWSSSSDTLFNTVINQGFSSAKSIQIVRVAGQYVAGPATFGLAYSNTQYGADTLSAFNRNAKFNNGSAFFNWQFTPALRAGVGYNYTSLTGPASAHYNQVNLGADYALSKRTDLYALFGYQKASGNTLDASGATVKAAASVGAYGMNSGTDTQELAIVGIRHKF

SEQ ID NO: 2198 - protein, 825 aa, Burkholderia cenocepacia PC184
MRHTRGEGVSPKTRRTVISVAVAAGVFHGAAWAQDAGAGAAAAAAATPASSAAAPASSASAAPDGEVQVQDRVVITGSRTETRASKSLTPIDVIGGDQLRATGQTNLRDALVKLSPSITRTSNSGDTGVLTDTLSLHGLTPDHVLVLVNGKRRHTTANITLDPGLNQGSTGVDIDTIPVGLIDHIEVLRDGASAQYGSDAIAGVINIILKRNTRGGELSTTNGQTYSGDGFKTSESATIGLNIADKGFLDLSAGFDRQNHTIRTGPDDYFGRFPQGQGYYNPILGDPSSSRETVGFNAGYYLGDDVELYGFGTYAHRNGDAYQNFRPPSVLPQVYPNGFVPVETINENDYSVTAGVKGKSLFGWAWDLSTTYGADYSVFGMRNSANTGLYAATGFTPSTFHLSTVSNTQLTNNLDLSRAFSVPLLPAPLNVAVGVEQRRETYTIRNGEQASWIDGGSAALPGLAPVSASDISRNVIGTYVDLSTYLTPKWQVNLAGRYERYNDVGDTTNGKISTRYQFSPAIAVRGSVSSGFRAPSLAQESYTSVTTSPASVGGILATTSPGARLIGAQALKPEQSTSYNFGLVLNPVRNLQLTIDAYQINIRNRIVLGGTASGAAAIAALEGAGLSVPGSVPASAVSASYFTNGANTRTRGIDLAGTYHTGFGRYGQVDWDFGVNLNTTSVTHVANGSNGKPSLNGQQIASLSTTTPKNKIIIGGTWRLDKWAVTLHETRYGKTSGEGTYFVGPNSFSTSQFVHYEEAARYVTDLEVRYDVTKQFQIAAGAQNLFDARPSKLPFETQLEGIQYSGGSTIGVNGGFYYLRARYLF

SEQ ID NO: 2199 - protein, 402 aa, Burkholderia cenocepacia PC184
MIPMMKKTLSILTLLAAGTGHAAGFSFDTHSARATSMGFAAVANMQDSSAIAYNAANILGVEKLDITAGDLITLPRINFTAEGTDRTQAFDTLLAPPPHAFGVYRLNEKMAVGLGLFVPFAAGSKWPDDFDFRTRGYKAQLATYHLNPTFAYQAHPRLRVGVGVSVIRGTVDIERKLNFVSSEGTVELGGGAWGLAYNAGIQLTILDKLLQFGGQFRSPSSLTFKGDVDFRDIPPAFQTQLRDQSVQSTVQFPGSASAGLLFTPSERLSIAFDLKLMLWSTFEEFTIEFDDPSLTNPLPKFWENTWNFHLGAEFKVTENFLVRLGTAFDRAPSPENTLSPDLPDADRYRLAAGVGYALNPVRVDLGYQYIFLGNTKSTIPGISGAYDGDGHIFGLTLGYSLK

SEQ ID NO: 2200 - protein, 341 aa, Burkholderia cenocepacia PC184
MVMGAALAAGNAVAGTMQLFGVVDASIEYARGSESVVRMREGQQAASRWGIRGIEDLGGGLKANFLVESGFNIDNGTEFFGNNRLFGRQAYLGLSGNWGEFRLGRQYTPSFYALLRLDPFLLNGAVSPFNLLSATASQGTGHVAYGARFDNAVQYFSPKWGGFSFGAAVAPGEVPGSARSGLNFGMNATYEAGNVYAFYSYQGMYSGANVPVEPTLTSNHFVGGSYRFKPVEIGLLYSAASSDRPETRSARHYGVTFSWNVTQRDTFKAAALKRQILGGGQRPLAVTLGWDHDLSKRTTAYVRAVLVHNSPGGSVSNNSIVIDPGSGDDAKSVSVGLRHRF

SEQ ID NO: 2201 - protein, 642 aa, Burkholderia cenocepacia PC184
METGAYLDANGKATTDPGEYIYDYEGTRLSNNGRDAIAETEFNQRELVRVNQTGHTYLTLTPVEGLNLTANYSINNIDYRRKVYENPYVGDGTAGPGRLNQMSTRTLTQTFNQLITYSKSIGNHNFDVLLGHENYSYKYEYLYGMKTQETVSGMYEFGNFVNISSLSSYTNTYKKEGYFGRINYDYAHKYYASLSYRHDGSSRFAKENRWGNFWSFGVGWRISEEAFMKDVKWVNNLKLRASYGETGNDNILDSDGDPDYYPYQTLYGLGYKNGSEAGAYFTVIANPSLKWETQISTDIALEFGLFDRLTGTIEYFKKDSKDLLFDVSQPASVGVTSIIQNIGKVTNSGVEIELDYNAFKNKDWSVSVGANATFVKNKIKNLPATMKENGYISGSKKWLEGKSIYEFWLRQWHGVDPQTGDGLYVADVSKYNQGNIGTGDGNITQSQFDEYKKTVVTIDGKELTNSYTYAKYDFSGSSIPDVYGGFNVRVSYKNFDLAAVFSYQLGGQILDTNYATMMSMTEFGYAQSPDLLKAWKQAGDITEVPRIDNSAAHTTNIGQSYSTRWLTSSDYLNLRSVTIGYQLPKTWLSKVMLKSARLNLTAENLFMLKARQGLNPMANYSGVTYNEYMPSRNITLGLNVSF

SEQ ID NO: 2202 - protein, 285 aa, Burkholderia cenocepacia PC184
MPPGAATPVQDKPRSGWLRAVGKWEGSRSKDGNFRTRTDSFLLHGGAELARWRVASETDRLHVGVTGSYGNASTDADAAGNPTRARGKVEGWAAGVYGAWYQNDENKLGAYVDAWFQYGWFTNRVEGDQLPTVRYHAQGLGLSGEVGYAIPLPRDWVIEPQAQLIYVNYSEDDIAEPNGTRVSGADSSGIIARLGVRTHRTFVREDGRKLQPYATVNWWYSDTDTNISFNQLPIGGLYPHNRFELKLGLNADLGKRWTGWTNVSGSWGQQSFYQYALRAGVKYTW

SEQ ID NO: 2203 - protein, 936 aa, Burkholderia cenocepacia PC184
MKSSVSWLFFSSIPLFSSLSIVAAEVTLDSSNNSYDGSNGTTFTVFSTTDAAAGTTYSLLSDVSFQNAGALGIPLASGCFLEAGGDLTFQGNQHALKFAFINAGSSAGTVASTSAADKNLLFNDFSRLSIISCPSLLLSPTGQCALKSVGNLSLTGNSQIIFTQNFSSDNGGVINTKNFLLSGTSQFASFSRNQAFTGKQGGVVYATGTITIENSPGIVSFSQNLAKGSGGALYSTDNCSITDNFQVIFDGNSAWEAAQAQGGAICCTTTDKTVTLTGNKNLSFTNNTALTYGGAISGLKVSISAGGPTLFQSNISGSSAGQGGGGAINIASAGELALSATSGDITFNNNQVTNGSTSTRNAINIIDTAKVTSIRAATGQSIYFYDPITNPGTAASTDTLNLNLADANSEIEYGGAIVFSGEKLSPTEKAIAANVTSTIRQPAVLARGDLVLRDGVTVTFKDLTQSPGSRILMDGGTTLSAKEANLSLNGLAVNLSSLDGTNKAALKTEAADKNISLSGTIALIDTEGSFYENHNLKSASTYPLLELTTAGANGTITLGALSTLTLQEPETHYGYQGNWQLSWANATSSKIGSINWTRTGYIPSPERKSNLPLNSLWGNFIDIRSINQLIETKSSGEPFERELWLSGIANFFYRDSMPTRHGFRHISGGYALGITATTPAEDQLTFAFCQLFARDRNHITGKNHGDTYGASLYFHHTEGLFDIANFLWGKATRAPWVLSEISQIIPLSFDAKFSYLHTDNHMKTYYTDNSIIKGSWRNDAFCADLGASLPFVISVPYLLKEVEPFVKVQYIYAHQQDFYERYAEGRAFNKSELINVEIPIGVTFERDSKSEKGTYDLTLMYILDAYRRNPKCQTSLIASDANWMAYGTNLARQGFSVRAANHFQVNPHMEIFGQFAFEVRSSSRNYNTNLGSKFCF

SEQ ID NO: 2204 - protein, 277 aa, Burkholderia dolosa AUO158
MNKTLLCAAAGALALAPLAAQAQSAGSNVVTLGWFHVMPQQSSTPMTTNVAPTPINTPLRLPPTFTSPGTGLRTSGADTVGLTVSHFLTDHIAVTSVAGVPPVFKVSGQGTIRPPGPAGALGTQNIGLASVNPIVKSVRQWSPAVLLQYYFGAATAKFRPFLGLGVSYNWFSDLQLNTNFIKQTQDNLGAILAAGAGKPGTTSVEAKASSSWQPVFNAGLQYNLTEHFGLIASVTYIPLKTTSTVTIKAADGTVLAESKSELKADPIISYVGMTYKF

SEQ ID NO: 2205 - protein, 234 aa, Burkholderia dolosa AUO158
MIVRKRRGRRTLRCLAGLMACSFFINTTYAWQQEYIAEAAPGHTTERYTWDSDHQPNYNDILAERIQSTQNTVGPVLSLADETPLDATSGISMGWNFSLSRRVTTGPVAALHYDGSTSSMYNEYGDSATTLALTDPLWHASVSTLGWRVNSQFGDVRPWAQISYNQQFGENIWKAQSGLSRMTAGNQAGNWLDVTVGADVLLNPHLAAYAAFSQAENSATDSDYLYTLGVSARF

SEQ ID NO: 2206 - protein, 112 aa, Burkholderia dolosa AUO158
MKQTICGLAVLAALSSAPVFAHQEGDFIVRAGIASVVPNDSSDKVLNTQSELAVNSNTQLGLTLGYMFTDNISFEVLAATPFSHKISTSGGELGSLGDITFATYLYGPILLW

SEQ ID NO: 2207 - protein, 191 aa, Burkholderia dolosa AUO158
MKAIALTLLSLSAISAAHADTKVNGFYLGAGAGSTEFDSDQSVTGKADGNALKLIAGYQFNRIVGIEAQYSKYGDVKFSTPQNTWTPTALSLNANLGYTFANGLRPYGIVGLSALDLSESTKTLESDSGAAIHFGLGLEYAPPALNGLAFRVGYDAEIFGISTEYDLNGTKVTEDVAYSLGAFYAGATYKF

SEQ ID NO: 2208 - protein, 634 aa, Burkholderia dolosa AUO158
DQQLNSVIDAMTSVAGINARPMDNDRYSISARGIAVTSILYDGVPTTYDTRFNYGDNLIDTAIYERVEVVRGATGLMTGAGNPSAAINLIRKRPTQEFMGSTSVSVGSWNNVRGMVDVSSGLNDSGSVRGRVVAAYQDKDSFQDRYEQQRTTLYGIVETDIGDSTLFTLGVDYQDATPSGTMSGGLPLFYSDGSRTNYDRATSTAPDWGSAHTQGLNTFASLEHRFDNGWNLKGTYTYGDNSLEFDVLWATGYPDPMTNIGATAGSIAYVDGSRTQHNVDLRAEGQFQLFGQEHQLMFGWNGQRQEFANPYYYPTAAVPPLGDFRDPNFQYPKPQWKEAYTTGSFGETKQSAAYVATQLNLSDALAVLVGLRLNEWETDQDNFGSLYDFNISNELTTYFGLTYALTEQYSLYASYTDIFAPQTKQRIDKSYLEPVKGKNYEGGIKASLFDEALDMSLSVFEIRQDNVGVSTGDVIPGTTTQVYEGVNGTKTQGFEFESTGKITDDWNVYLGYTQFTSEDPKGKRISTISPRQQLKLFTTYTFGGDLHKLQIGAGVNWQSRVYQTVNSPLGKVEVEQGSYALASLMASYAFTEQLKLSANLHNALDKTYYSQVGQYSQFQYGTPRSASLTLDYRF

SEQ ID NO: 2209 - protein, 380 aa, Burkholderia dolosa AUO158
MQTTTTRLLISSALCALSTTAFAQSSVTFYGIVDTGIEYVSHANAAGGHVFRMPAVTGELPSRWGLRGVEDLGGGYSAVFTLESGFNVRDGSSGQGGRLFGRQAFVGLKGPYGTLAFGRQYTMTYLALQGADIIGPDIYGMGSLDAYVPNARADNSVTYMGTYKGFTLGAGYSFGRDSAGTGNSPGQGTCAGSVAGHPTECRDWSVMLKYDAQYFGVAASYEEQRGGASGQANFFDGVPPTVLSNGADKDARTHVSAYAQYAGAKVGAGWLGRRVVTDSPAVPNVRSDLFFVGASYFVTPAFVVDGEVFRIINSAHDSRATMGTLRTTYLLSKRSSVYAQAAYLANSAKARYSVSGGGGGTTPAAGIGQTGVMLGIKHAF

SEQ ID NO: 2210 - protein, 362 aa, Burkholderia dolosa AUO158
MEEMMKKALVAAALMAAGVVTAHAQSSVTLYGRLDAGIEYMNGLQNGHQVRAESGDWGTSLWGLKGSEDIGGGNKILFHLEGAFNTMTGGFSGSIWDRFATVGISNDRYGTLLLGRELAIANGVWDFDPFGQSAWSTASLVRGRNWNKTSNNVSYQSPSLYGLDFYGQFSFSNSTSFNGNTTAGQPGRAMGGQVTYTNSLFQLRGIYDETRDSNGRFSDVFNYSREYFAGVNVFLGQFKVQAAYQASRADGSGGPAVNAGVTGTQQVWGGVTWQATPAAALIAAVYHVNANHGGGNANIYTVGGSYNISKRTLFDLQVATVRNSSSANFGLNANGAGTAVSTGNPHQGGSQTGVYAGIQHLF

SEQ ID NO: 2211 - protein, 451 aa, Burkholderia dolosa AUO158
MKTASKLSVIAAAMSCTIATPVFAQDATAAPTAEDELAAMRAQLQALVSRIDQLETELEQTQAAQTDQDAVIAANAEAVAQPGPEAKPSAELRKSGWSFKPRGRLMFDAGTVNAPESVDADTGFGNEVRRARLGASGDLPGGFGYKFELDFAGNEVEAADAILTYEDGDFEVTVGHHNNFQSLEELTSSLHTSFIERAAFTDAFGFERRIGLSASYEAGIVLAQAGVFTDNFDDTGTDNRGVDGRLVIMPKLGNTQLHFGGSLHYNELGEDDATVRYRQRPLVHFTSTRFVNTGNLGADSEFGAGLEAAAIAGPFHAVAEGFWQNVDIPLSENPTFFGGYAEIGYFLTGGDTRAYKGGKFDRTKPANPVGESGFGSLQFNLRYDHLDLNDAGILGGVQDGYQASLVWKPTDYTLFSVNYGRMDYKDAAIPTADGDTDYGVDAFGVRAQVDF

SEQ ID NO: 2212 - protein, 718 aa, Burkholderia dolosa AUO158
MRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 2213 - protein, 974 aa, Burkholderia dolosa AUO158
MHRTAVAARRLLAASALSTLIVAPAFAQDAAPADAGDTIVVTGSRIQRSDYNLANPLVTVTAEALEQAGNIQLVDTLAQNPALINSLNGARTSGSNADFGAVGVQLLDLRGLGENRTLVLVNGRRHVASLAGSAAVDISTIPNDLVEAVDVLTGGASAIYGADGVSGVVNFRLKRDFDGFKASGQVGISSRGDAGQRYGSLTYGRNFSDGRGNIALSYEFREQDRLSSFNRARTGNPLDTYGIVRNPLDFPDDPNIPDRVPTNNLRYADSSLGGAIDVDFDGIPDYTGEGKVYDRGTLLPSSGGLTQGGDSTPLAGYQGDLQAYNRVHNINLLSHYDFSDAVKFFFEAKYVKNKTKTLAQPSFDFFTYLSPDNAYLQDQFGALAPDGALISRDNFDMGVRGEENERETMRFVGGFEGAISDHARYELSYTFGQTKSKVLLTDYRIGDRYWAAIDAVRDPATGQIVCRSTLDPTGNINPDNYDAPATTFTPGAGSGCQPLNLLGNGSPSQAALDWVNADIMNRAKIQQHVVSGSISGDFGQFFELPGGPVGFALGAEYRKEKSSFVPDDLLQQGALADFSLQLPERGSFDVKEVFGELSVPVLKEVPFAYNLSFGAALRLSDYSTIGKTTTWKVDGTYAPIPDITFRGTWSEAVRAPNITELFAPLNGGFSFIGDPCDPVYIGEGTQYRAANCQAALSALGLTPDQIAAFNPENDPTATVSLPGNSGGNRNLREETARTWTAGVVVRPSFIRGLVASFDWYDIKLKNAVNTATAEEVAELCVDQPSLDNVFCGNISRDPTTGYINGWFVQPQNVANFRTSGADFKLNYQFETASAGNFALSLVGGYLNKLEFIPTPGATVDVDREEPYYPKWNATGDITWKLDKLTVNYGISWFSKTRRYEIEQTNANPDIAESKYLWYKEKWQHDLYVAYDVDERFRFYVGANNLFDQQPSIASSNYPISYVGRYMYAGAKITM

SEQ ID NO: 2214 - protein, 730 aa, Burkholderia dolosa AUO158
  misc_feature (140)..(140): Xaa can be any naturally occurring amino acid
  misc_feature (155)..(155): Xaa can be any naturally occurring amino acid
  misc_feature (701)..(701): Xaa can be any naturally occurring amino acid
  misc_feature (726)..(726): Xaa can be any naturally occurring amino acid
MWRQASRGRSGRAPVGSVCPGETRHPKKQSIFGTNMMQIRLSSRAALMASALVAPVCIAPGTALAQQGPDTGYYLGDIIIRGNIAERSLKDTSSSVSVLGDEEIEEKSASGTVNEVIADTPNVLISGSTSAPIIRGVDTXRPLIGGNAYLAKPLXRATMSIDGRYVSSVELGAGGGTTWDVESIEVFRGPQTTSQGANAIAGAVVVTTKDPTFEPEYSAQAVYGSRNKRRLSFAASGPLSQDFAARLALDYTGRDTFVDYTHPDFTEPDFDYDFASLNGRLKLLWEPADMPGLRVKLTYSHTDLHRPSNEQVTKPYRDLDNASDYQDYMDVIADGVVLDTQYDFDNGIRLSNQLQYSEADYDFTFAAPYSGTAARDSATLSNELKLTLGQGEDIWSGVLGVYFSDEDADADFANSYEGVPLGSADLSYRTRSLALFGEATWRFASDWALTGGLRLQQDRIEIEGKTSYVVDERLDYDETFTEILPALTLSHDLNSDWTLGATVSKGYLPGGSGTNFHGKEYYEFDPETALNSEIFLRGSALDGALDVSANLFYTKYRDIQRSVINCLNADCSVTQGSMIVNGERAHAYGFELSADYQASSTLRLSGDIGALQTEVTEFSDHDGTKYEGNEFARSPGYSVGLGAAWDITPDVTLQGDMRYVDGYYSDDTNEPAAEVDGYALANMRLSYRPRDGVEYFAYVNXVFDNRAALSVSTNDAAEIAQPRELXSASG

SEQ ID NO: 2215 - protein, 511 aa, Burkholderia dolosa AUO158
MRISMKLDRLCQSLLLTSAIAILIPSPAQGEEVETEIRQAKQNISQLSEIELPPTNARMLVQTPTNPSTLQGDIIPIMGVKANPTEKGVEVILETAAGDKLQITNRSEDNNFVADVSGGQLRLPNGDAFTFKSEKPIEGITEITVTNIDVNTVRVTVVGEKALPAVELFDDDMGLIFAVASTATSAQTPETPTEEQPATEKPEEQRAAQQDDPIELVVTGERDSYRVPNASTATRTDTPLRDIPQSIQVVPQEVLRDRNAQTVFEAVETVSGVLDGSNNYGAPGGTNIIRGFISFDSGSLRNGFRDYDYYSVSSIGTIEQVEVLKGPASVLFSAQEPGGVINTVTKKPLSTPYYNVAFQAGNYGFYQPSIDLSGPLTTDGNALYRLITSHRGTGSYIDFVNSNTTTIAPSITLKFGERTDLNLSYEYVRYFADNPIFEVPLLTDGSLPPRNFYSAYPDLVLSDITTNRIALNLNHEFSENWKLRNNLAIVLNQRTLALALVLWWSIKITVL

SEQ ID NO: 2216 - protein, 789 aa, Burkholderia dolosa AUO158
MSLRFKRAFLVGSAAFAASEGLPASQALAQQAATALPEVVVTAPSPIVRRHSAPPSRPATRVAAPARQRGTAPAEAPPVVAQPAPPPPGALPIFTDQFATVTVVPNEEIRRNGGGTLGDLLNNKPGITGSGYAPGASSRPIIRGLDVNRVGIVENGIGSNGASDLGEDHFVPIDPLATNQVEVIRGPATLRYGSTAIGGVVSASNNRIPDALPPCATPFQSYGLPVKAPAAIGGAAGCMNAEVRSAMSSVDRGVESAVLLDAGGNNVAVHADVFGRNAGDYNVPSYPYQAPGLPFNGRQPNSATQATGASIGGSYLFDGGFIGAAITQNNSVYRIPGTEGAEFGTRIDAKQTKVTAKGEYRPDAAAIEAIRFWVGATDYKHNEIGLAVAGDPASDGVRQSFTNKEQEGRLEAQLTPFNARFATVTTAVGVQASHQELTAPSPDDPTSPLNGLFDPNKNTKLAGYVFNELRFTESTKAQVAGRIEHVDLSGTTPAFVPGLFDLSTDPGAIGPATSRNLSFTPKSFSLGLIQALPWGLSASITGQYVERAPKPAELFSRGGHDATTTFDIGNPNLGIETAKSVEVGLRRADGPFRFEITAYYTQFSGFIYRRLTGNSCDDVSCVDPATGTLELNQAIYAQRDATFRGGEFQSQLDVAQIYGGTWGIENQFDVVRATFADGTNVPRIPPLRVGGGLFWRDANWLTRINLLHAFAQNDVAPIAETTTSGYNLLKAEISYRTKLDPNAWGAREMLVGLVGNNLLNENIRNAVSYSKDNVLMPGIGVRAFANLKF

SEQ ID NO: 2217 - protein, 380 aa, Burkholderia dolosa AUO158
MKKTLIVAALAGVAASAAHAQSSVTLYGLIDAGITYTNNQHGHSAWQETSGSINGSRWGLRGTEDLGGGLKAIFTLENGFGINNGSLKQNGREFGRQAFVGLAHNSFGSLTLGRQYDSVVDYLGPLSLTGTQYGGTQFAHPFDNDNLNNSFRINNSVKYQSANYGGLKFGGLYGFSNSTGFANNRAYSVGASYSYMGFNVAAAYLQLNNNINALALAASDPGAVAGDWTFAASRQRTWGAGLNYTFGPATAGFVFTQTRLTNSAGISAGQSGVSTGIPLTGGTRFNNYEVNGRYALTPAFSLAGSYTYTDSRLDGQTPSWHQFNLQADYALSKRTDLYLQSEYQRVNTNGLAIGANINGLGAASSTNKQIAVTAGMRHRF

SEQ ID NO: 2218 - protein, 1051 aa, Burkholderia dolosa AUO158
MILFNFNAMGKLCRLHLLLLALLLPGVSFAQNLFKVQGCVTDEQNEPLIGATVQTIDKSKGTITDSSGNYVLSGVPKGSTLVFSHVGYKSKEAKATSTSLNVVLESDDEMLDEVVVIGYGQQRKVTLTGSVSNVGGKELLKSPAASLGNTLSGKLPGLQSVQYTGVPGADDPVIRIRGVGSFNSAEPLVLVDGVEREFSQIDPNEVQDISILKDASATAVFGVRGANGVILVTTRRGEMGKPTITLTTSVGLQQISKFLEPANSYEYATAYNHAQEVEGVAEDGWKFSKEAIQHWKDMDMPTVYPSTNWFKYLMNDHAWQEQYNINVSGGTERARYFVSVGMLNQDGLFKTFDQGDDANFKYRRYNFRANLDVDFSKLSTLSIGIGGRIGRRNSIGNGEYNGQSGVFGVEGLLNNGTPMSGYGLDSEGRRIISDPNLVGAVGSDGLGLIYEQGYTTQRQSVVNLDLQYKLKLDFITKGLDFRIKGSYNSDYTQQKARTTGGGISYKATIAKGEYEENGSPKIVYVRQGDSWPLGYEESKWGGRNWYAEASLNYTRKFGDHNFGALVLYNESKNYYPGGVYNSIPRGYVGMVGRITYDYQTKYMVDLNMGYNGSENFAKGKRFGFFPSASLGWIISSEKFWEPIRNVVSYFKLRGSIGKVGNDQGVGRFLYLPGTWQFYNNNGGAWWTNDRTGNFGTNNGVFMPGARESSNGNPDVTWETATKQNYGADVHFFGGRLNLGVDFFWEDRKNILISNETSIAGISALKPNSVNFGRVKNHGYEITLRCTDQIGKVNYSIAPTLAFARNKVVEMAEVKKEFPHMYHTGHPVGQPFGYDFFEFYVPGETEQRYKEVYGVDMPDQQITLRPGDSVFVDLTGDGKVDANDVHAIGYSDIPEYTGSINATLNWKGLDFSMTWVGATHVNRQLSSFYTPAFGTGNQSMLNKWVYDNSWTENNPSASLPRISLEKSAREHNGSLSDPWMVDASYIRLKNLEIGYSFRIPGVPINNIRVYANGYNLLTFTSFKANDPEAQAGFGSTRYPMTRVYNFGINLNF

SEQ ID NO: 2219 - protein, 243 aa, Burkholderia dolosa AUO158
MKRKLAITGAAALAFAFAGGPAHAQSAGDFYVSTGWLHLSPQDSSDPLFVYRVGGTPINQSIPNTGAGINDADTLGLAAGYFVTDHISTELVMGIPPKFDITGKGRFENFGVLGRAYQWSPALLLRYHFNDANAKFRPYLGVGATYVWFTGAKITNSSFENGVLGGPTSATTSNQWAPVLNAGFTYNFTKHWFGGLSISYIPVSVTATFTTARRTPVGTLTETSKAKISLNPIVTYLNVGYRF

SEQ ID NO: 2220 - protein, 672 aa, Burkholderia dolosa AUO158
MFACLLPIMVATGATAVAAANRYSADDLLSMKIEDLVNVKVTTLSKHEEKYMSTAGAVFVISSDDIRRSGARSIPDALRLAPGLQVSQSNMNQFQIGIRGQTDFFTDLLLVMVDGRPIYTTTFSGVWWVAQNYPLQDIERIEIVRGPGGAVWGSNAVNGVINIITKNSGATQGLRITGGGGTTDKGFGNISFGSHAGNLDYRVYAMNELRGGGLPTHGGLSHLTVYPAGQNTPDFRRVNQQGFRMDWDAGATTRITLHGDAYQVKTGVANYWMPIVTLPVQPAREYRGLNGFNGKNMVFRLEKELVPDILFKGQLFYDQYKLHTQIMREQKETFDGDFQVDFNNVLSQNISLGTNIRRLRTRMHNTPQFQLPSRTTKLASFFINDELRLFDGLFRIIGGMKMERNSYTGWVYQPSARAIVSDDNWALWVSASQAARTPNDMENGLRWNLKSSAGKLVRQIGSGVARTEKVLSYEVGARLRPVEESLIELTAFKIRYKGVLDTWQNRSATNPYIINGIIPEYLTNVLNGEGDGFEANFRYNPWQWLTLKGSYTYLHQVYTDYPVKDGETIWTVRSNKGQDPANRFHLGVGVNPVKGIEFDANLYFTGPFREGDIHGYHRLDMRLAWKPVEYLEVSLVGQDMLQASYQSNTDSIVGYAARIPQRYYAQVTYTYH

SEQ ID NO: 2221 - protein, 214 aa, Burkholderia dolosa AUO158
MKKLALSLVAFGALAAGAAQAQDFTPNAKGDLIVHARLTQVAPAKDAAILTAAGANSGLKAHVGNDIKPTLGFTYFLTDKVAVEAILGTTEHNIRAQGPGTDVLVHKTWVLPPVVTLQYHPLPASQVSPYVGAGLNYMLFYSGKNKNGFTVKVDDGVGYALQAGVNIKMKNSWLVNADVKKVYFSTDAKINGGALKAKVDLDPVVASIGLSRKF

SEQ ID NO: 2222 - protein, 718 aa, Burkholderia dolosa AUO158
MAAQHSPDFARPFEPLATNPSRTENALERHARRTWPLAAALLLASASAAAQSSDQHLAEVVVSASGFEQAIKDAPASITIITREQLETNRVNSVAEALRGVEGVDVGDAPGKTGGMNISMRGMNSRFTLILIDGRRQNTAGSVTPNGFGETSTSFMPPPSAIERIEVIRGPMSTLYGSDAMGGVINIITRKVGKVWSGNVTAETTLQGESQFGNSQAGSVYLSGPLVENLFGLQVRARRYHRDDSNIQWPGKLPGSLTLGNDPVKSTIDTAGAKLTFTPNKDNDISLDIDSSRQTYDNSRGQLGTLDKTGAIRGYLPEQKFNRDQVTLAHTLRMANSVLESSLSHTKTETIGRTIPDGAPGGKPAGSPRTLESESTIFDTKLVTALDTHMLSVGAQWWEAKMIDAIAPRGFDQKQIGVFAEDEWRIRKDLALTVGVRHDNHSTFGGATTPRMYLVWNATDQWTFKGGVSKAYRTPGLEQLVNGLSGIGGQGTIPLYGNPALQPERSVSSELGTYFDNNKGFRANATIFQTDFKDAISTISNYVPPGGGAQGSFPVNVSNATVKGLELGGSLEFARVWRVAANYTYTDSEQKTGANIGKPLENTPKHAANVKLDWRTSEQLNLWAQAEYKSERYRPEDNATSNTKALLGDFKAYTLLNVGGTYKINKSFAINMAVNNLLNKDFVAYRQVRNNGNPNSFANQYISTMEPRRLWISANYTF

SEQ ID NO: 2223 - protein, 797 aa, Burkholderia dolosa AUO158
MPKQEALSLWPGPAAETRPDRLWEENAMRASSFTFIRTVPAAVSAIAIAFATSAQAQEVEEIIVTAQKVEENVQKVPIAITAVSGDRLEATGTTSLEGITRLVPSVTFRKGTTSANSAIVMRGVGTITFSIAAEPSVSTVIDGIVLSRSGQAFMDLVDAERLEVLRGPQGTLFGKNASAGLVNIVSKGGTDQLEAEAKAEWFEGDEYRLRASVAGPLGGDWSGRVTGFYGSYDGNVTNINGGRNRKVNGYEHWGTRGIVDYRGDGARLRFIADYFKADDDCCADVTGASRGAVLDAELGLPDGVALGENQRFINHNLVTQTRDKQWSLTASGDFDLTDTHTLSVVAGYRNWENREIREGDFLPRAIVGTAELHDDGLVKTQQFSVEARIASDQSMPFFYQVGAFAWHSDNKQDFTRRDISCATSTLPVDPATGARPCNVNDMVNTLFPTATSNSDVNSTNFALFGQATYRFNDLIALTGGLRYTWDDLSFTHIRAPGVNASTGLPATGPGISGNPAGGTVASGGTGLNTSSGSSSNGNLSGKAVLQFTPSDDIMLYGSYTRGYKGPAFNVFFNHTAPTNAVPIDEETSDAFEIGLKSRFLDNKVQLNLAGFSVEYDGFQANNFVLLNGAVVTNLTNAGTVKSEGFEADLTAVPVDGLTLRGSAAYADAKVKRFNPNPLTNAPDARDGTRLPLAPKFTYTLGADYDVPVGGMILYLGTDYRHVSKQFSDLGEQGVIDAYGQWNASIGISDAEDRYRLTFHARNISDESYVLLNVSNGQRLQIPRDADRYFGVSLRARM

SEQ ID NO: 2224 - protein, 363 aa, Burkholderia dolosa AUO158
MKSRAERSIRTVVLTGSAAAACLAAPAAHAQSSVTMYGIMDAGIEFTNHAAPQGGNSVKLKSGNKNTSRWGLRGVEDLGGGLKAVFRLESGIDLANGASDDGPDSIFARRATVGLKGKWGELSLGRNFTVTYDYMLPFDPMGYAQNYSWATSSMATGGRKDGLFTRSSNAVRYDGEFSGFKFGALYGFGNVPGSTKTSSKYDFAVGYETGPFAAVVTFDRQNGAADSVTPADTVNYIQGIHAGLSYDFGNLKTMAGYRNYRRTFHTTAANQLSDMYWLGGSYQFTPTFSLIAAVYHQNIKGGTDADPTLVSVRAQYALSKRTVLYAAGAFAIAKHDQKVGVSRDFNGYGTTQVGVTAGIQQRF

SEQ ID NO: 2225 - protein, 276 aa, Burkholderia dolosa AUO158
MSQAALNTRNSEEEVSSRRNNGTRLAGILFLLTVLTTVLVSGWVVLGWMEDAQRLPLSKLVLTGERHYTRNDDIRQSILALGEPGTFMTQDVNIIQTQIEQRLPWIKQVSVRKQWPDELKIHLVEYVPIARWNDQHMVDAEGNTFSVPPERTSKQVLPMLYGPEGSANEVLQGYREMGQMLAKDRFTLKEAAMTARRSWQLTLNNDIKLNLGRGDTMKRLARFVELYPVLQQQAQTDGKRISYVDLRYDSGAAVGWAPLPPEESTQQQNQAQAEQQ

SEQ ID NO: 2226 - protein, 677 aa, Burkholderia dolosa AUO158
MLLAAVAHAQADTAARPTSTPTQTTPLAPIFVTANPLGDTQLIAPTAQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGVAGALDARYGGANSVRAGAAQVEGGNGRFAFHVDAFDREASKLRIPSYARSSAQRAIDGPDTPQPYGNVPNSDGRVHGGAAGASYTWADGFAGLSYSGYESNYGSVAEEDVRLRMRQERLAFASEVRNLSGPFTKLKFDFAYTDYRHKEVDNGETATTFRNRGYEARIEARHRRIGPFEGAIGVQFGRNTFSALGDELLVPSTRTNSVALFGLEEWQVDPALKLSLGGRLEHVKVDPDPAGVEKFAGAQPRDFNAGSVSAGALFSLTPVWSVAANVAYTERAPTFYELYSNGPHDATGQFLIGNPNASKEKAVSTDLSLRYASGPNRGSVGVFYNRFSNYLTEYNTGRVVDDDGEPVAPGADGSLNEAIYRGVRAEFYGVELDGKWRAFSRRGHTVDLELTADYTHARNVDTGQPLPRIAPLRATLAADYGYGPFGARAQVTHAWSQHRVPDNDFPTDGYTSLGVMLTYKFRVGATHWLAYLRGDNLTNQEIRYATSVVRGFAPQGGRSVMAGLRTTF

SEQ ID NO: 2227 - protein, 251 aa, Burkholderia dolosa AUO158
MHFWDGAKDGSSASEILEKHTMKKFLLGTVALVAMATTVPALAADLGARTYTKAPAYVAAPIYNWTGFYIGGHVGGAFVGDDSIGTGATRSSDGTFLGGVQGGYDYQFAPNWVLGVEAQYSWLDQGTDPVLVGPYSFSDKQKGLGSVTGRIGYTWGPALLYAKGGYAFADYDTTVTLGGVGAAVSSKSDGYTVGAGLEYLFAQNWSGKVEYQYYDFGNVDFGGFSFKNDEHVVKAGLNYRFNWGGPVVAKY

SEQ ID NO: 2228 - protein, 788 aa, Burkholderia dolosa AUO158
MRRARTCVQPIKQDDSSMFRKKLIVTALGGLLTGGAVSLPAWAEDGAATAGAPDAQPAQQASDDAAAAAPKAVRANRGAAARETNLGTVTVTARRRKESIQDVPVAVTALSGDAIRNNELRVINDVTKYVPNFTGQSTEGRERPRWFLRGVGSNDPSDLSLSPIGVYFDDVYINSVFGQGFPLFDLDHIEVLRGPQGTLWGKNTVGGALSITSQKPTFDVSGYGKIGLGQYNSRLAEAAIGGPIGKNDVLAARVSVYHENADSFYTNTVQQGRFGGFHDNAVRFQVLAVPTSDTDFLFNIHGRNYTGGGNAWHAEGAGRGGTNQFGFVGSSDPYTVSLNAPSSDHISTWGTSLTAHWRINPAVSLTSITAFEGLHRWYQDDEDYSPVDAARSHDRLSSRQFSQEFRLESPQNDRLSWIVGTHLFTEQLAEQGAGGGLPGSPSPAYYHLTDLTQHTQSAAIFGSVKYRFTDRFNVTGGLRYTIERKTINLTGLQDTGNVTFSDPNSWWSPSSVSSPLAVSAQQHQTNTWRAPTWDLTPEYALSSNVRAYFRYARGFRSGGYNGNAYTQSTVSTVSPEYLSDYEVGIKSEWFDKRLIVNASVFHYDYRDIQVFALAPNPFGGPPVSTLSNAGQGRADGFELELKAQPVNSLYLFANLGMLNTRYTEFRNVPTAVGNSFARSPHTTLNAGVDYRVPVSFGTLTAGGDVNYRSREYFSATRQTMPQLWQGGYTVLNAHVSYTTPNQKYIVTGYVTNLTNKVYKKLELLPSYGAYPVLYGDPRTVGITLTAKI

SEQ ID NO: 2229 - protein, 135 aa, Burkholderia dolosa AUO158
MPSVGLKHTQSTDMDYYLGKFDRDTVSADNVNTKETALTVGLNGLWKADSEGKLTLNAGLNFYQILNGKVAYISNYGGYKVNVSEKTSGNRPDVGVKLGANYQVSDNVRIFLNGEYQTGKFRHRKAVNVGLKLDF

SEQ ID NO: 2230 - protein, 310 aa, Burkholderia dolosa AUO158
MRNGMMNNKVSFTNSNNPTISLSAVIYFPPKFDETRQYQAIVLSHPGGGVKEQTAGTYAKKLAEKGFVTIAYDASYQGESGGEPRQLENPYIRTEDISAVIDYLTTLSYVDNTRIGAMGICAGAGYTANAAIQDRRIKAIGTVSAVNIGSIFRNGWENNVKSIDALPYVEAGSNARTSDISSGEYAIMPLAPMKESDAPNEELRQAWEYYHTPRAQYPTAPGYATLRSLNQIITYDAYHMAEVYLTQPTQIVAGSQAGSKWMSDDLYDRASSQDKRYHIVEGANHMDLYDGKAYVAEAISVLAPFFEETL

SEQ ID NO: 2231 - protein, 368 aa, Burkholderia dolosa AUO158
MNKTLIVAAAAASFATVAHAQSSVTLYGVLDAGITYQSNVQNAAGQGKSLWSMGSGIDQSRFGLRGSEDLGGGLKAIFTLESGFNIGNGKFANNNGMFNRQAFVGLSSQYGTVTLGKQYDSVQDYLAPLTATGSWGGTYFAHPFNNDNLSTNGGYSANNTIKFASANYAGLQFGGTYSFSNSTNFGNNRAYSGGVSYQYQGLKLGAAYSQANNPNNNATGAIDSSSALFNGQGRLRTYGAAAAYAFGPAQVGAAWTQSRIDNQANGAATFHADNYEVNAKYNLTPALGLGAAYTYTNAKVDGSSTHWNQFGLQADYSLSKRTDVYAQAVYQRAAKNGVGASIYNGDVNTLPSSSINQTAATVGLRHRF

SEQ ID NO: 2232 - protein, 822 aa, Burkholderia dolosa AUO158
MTIGLGAARRGTTMTGRRGARPLASLLASTILGWSLASPASEVWAQQPQAIDQHAIRFQIPAQPLASAIDAFIDQSGWQISYSTAVARDKTSSAVAGEMTPAEALRRLVSGTGLAVRLTGADAAALFDPLPQGDDQKTGALTLDTLTVEGAGIDPGVGLGGGVVTRGYVAEAARIGTKTDTDLKKVPQSIAVVSRQELEDRDAQSLVEAVGYSSGVRTGVYGFDPRFDTIHVRGFNVSSEGFYRDGLRDLGGSFSVFRKEPYGFEAVSVLKGPSSTLYGGGSPGGIIDVVSKRPTEQAFNEIEIQAGTRDHRQINLDTSGPVLENDTVLYRLTGLYREADTQYLAAPNDRFYVAPAVTLRSDDRDTHLTLLTEYTDLTTGGAAGYYTSPDLKTRIETGDPAWGDFDQMQWRVGYEFEHRFNDVLALRQNMRYSNIKADMRWTGINDISDDGATATRSTGRIRDEAWTIGVDTHAQADFATGPLSHTVLGGVDVSYIDSDYKYGAGTAPDLNLITGNYGQQAIEGPATLDLIRNTVRQRQTGLYLQDQIEIDRVVLTFGGRYDWLRSQAKNRLDLSSSTEHYDDNFSYRVGLTYLFDNGISPYVSYATSFAPTTGTSASGAAFEPTTGEQVEVGVKYIPDSLPLSINAALFKIRQENVLASDPDNVYFQIQRGEVESTGFEIQATTRPIDGLDLTASYTYLDMEIAAGDNAGKIPSGIPHHQITAWANYVFQSGLAKGLTLGAGSRFYGESWGNDTNTVKNDARVLVDAAIGYDFSALSPQLRGVSAQINGKNLFDNRAVTFASNLSYREEGREVVGSLRYRF

SEQ ID NO: 2233 - protein, 179 aa, Burkholderia dolosa AUO158
  misc_feature (171)..(171): Xaa can be any naturally occurring amino acid
LYVRLQYNGEILPLFTKVDGIEYKKGSEILTPLKASFIAGGGAFGYKMDDIRVDVEGLYSQLSKNDVTGAAFTPIDTIADSLTAFSGLVNVYYDIAIEDMPITPYIGVGVGAAYISNPSKVDAVKDQRGFGFAYQAKAGVSYDVTPEIKLYAGARYFGSYGANFDKTSTSXAGIKGVFY

SEQ ID NO: 2234 - protein, 711 aa, Burkholderia dolosa AUO158
MRRTFVSLCVLHAVSPLAFAESESLGNPAQIELQALNISGTADSERADGPVEGYKASRSASATRTDTALHEIPQSISVVPKDVLEDTGATRLQDGLDYAGGVGRANNFGGQGLTTFTVRGFTTGEFYRNGFPINRGYPNAPDANSVERLEVIRGPATSLYGRGDPGGTFNVVSKQPLADPKVTLGSQLDDQGMHRATLDATGPLNEDGSLAYRLNVLGEGGDSFRDDVESERYDVAPVLSWQVNDATKIVFEGDFMRNNHPLDRGLTRLPGQRGTASRDTNIWEKGSDNLLHNDNNMAQLRFEHALSDDWTLGGGMQWLDGSLKGNAVEANALQADGRTLGRNFNYRKLEWTDRDYQLNLTGHFETGGLAHTLLTGIEYEDYDYSSIIQRSAAGAGAYPIDIFDPVLGQPRPALTRTTTHDKENLKTWAAFIQDQVALTERLKALAGVRFERYEHDYDNKLNNAGDFSKGENGVTPRFGLLYDLTDTLAVYANTARSFKPNSGASLQGSGFDPEKGKSYELGVKWEAPDRQLSIDAAAYHIVKENVLTRDPNDPSGTYSIAAGEVRSRGLDINIAGNLTPEWRVIGGYAYVDAEVTQDNTVPTGTRLANIPRNSFSLLNTYEFQDGLAKGLGLGVGVKYIDDRAGQTAATTYTMASYSVVDLHSFYKVNEHVRLNLDVKNVFNKGYDEGAFNTYVYPGAPRTVQAGVSYTF

SEQ ID NO: 2235 - protein, 405 aa, Burkholderia dolosa AUO158
MNSLTTPRRIAAAVAALAVAQGVQASSSVTLYGDVDAGITYTNDQQTTSADGSVRGGRAVQIGGGNLAPSRVGLTGSEDIGGGTSVTFKLENSFWTGSGSLLQAGTLFNQNAWVGLTNERYGTLTVGRQFDAYTTTLAPYASSIPWATLYGSHIGDVDNLNAALNLNSAIQYASPTFAGFSFSGTFSFGGVAGDFSRQRGWALAASYNRAPFSFGVGVLDLNRPLDAALGGASGYIGDFACSNPAAMYCTLQNARSLTAIGAGGAYTIGPLTLGLVYTHTTLDDSRYFADAAHPHGADARFDIVEVNAAFAVSPALTLGAAYIYNAMKTDASGSPTFHQVNLGATYNLSKRTALYAVGFFQQAAGHGIGRDPATGAPANYAQIPNLPNANGNRQLALTMGVRHNF

SEQ ID NO: 2236 - protein, 89 aa, Burkholderia dolosa AUO158
MKQSIGAGLTAFGLIANRKADSIGSGFSLAWLNQRVTNRKTELMFQIYYQAKLFNFIYLEPVLSYIPTPGQSSHLNPASAGTLRAIVLL

SEQ ID NO: 2237 - protein, 274 aa, Burkholderia dolosa AUO158
MKKLIVAGVVAGVSTLASAQQAGDNVATLGWLHIMPQDSTNGLTTNLAGMPINGPLRLPGSFTSPGTSLTVNNADTVGLTLTHFFTDHIAVTSVLGVPPEFTLTGHGSIRPPGPAGALGSVNMDDPANQPAVKNARQWSPTIILQYYFNSSTARFRPFVGIGVAYSWFSNIELNGNFAKDINENLGSVLAAGAGKPGATSVEGKASSSFTPVYNVGASYAIDKHWGVTATLTYMPLKTYSSLVIKAADGSTLATTRTKLKADPLITFVGISYKF

SEQ ID NO: 2238 - protein, 763 aa, Burkholderia dolosa AUO158
MMRLNKIITLTFFHLFLGCYQTVAWGQTINGKIIDDKQLPIDGATIILQAMDSTYIGASISNSDGIFVFKSQQKEYRLIIQHLLYETKQMVGKGNNAGTIQLQPQDYALDEVIIKAERPFAKVENGLLGYNLAVLTQNQLVNNAYEALTKIPGVQEDRGILTLAGAGKLTVILNGKPTTMDAGQLETILRNTPVNRVEKVEVMYSAPPEYHVRGAAINMILKHSNDYSFQGEISANYKNQYFNDGGMNGNFRLSTPKMAFDVMYGANNVKKMEYIDLDSKHTLKGELHNIIQNEQLRSKYWKHDLRVAFEYNFNNKNNINIAYTGSYTPDQYNNSRTSGNYQTSNVDKYIDNQMRNITLQYHSGFGLDIGGDYTYYTSNNAQRLYADYQDGSQSSFSMVGGQKIDRYSIYADQKQSLSKGWNLGYGISYRFAKDLDFQTYDKVTGNIQTQNTYSNLREQTTNFYVSLSKNYTTGTSLSVSATGEYYTIGNYHKWAVYPQASLTYFKTPKHVFQLSLSTDKTYPSYWDMQSSVSYLNGYTELWGTPNLKPMTNYNLNGSYIFLNKYILSLFFTHTSDYFTQAAYQSTDRLALIYKNTNWNYMQVWGANIILPFKVGNWLDSRLTLVGMQMHQRCDDFFDIPFNRKKWVFSGTLDNTFKVNKNLSFELMGNVQTPVIQGTFDIESIFNLTAGLRWNFANDKLSLSVRCNDIFDTGMPATKVRFKGQNLNMNSGFYSRAFTLHFSYRFGGYKKKEIKGVDTSRFRY

SEQ ID NO: 2239 - protein, 456 aa, Burkholderia dolosa AUO158
MMVVHTTRISGARLRRTLLACTAGMAVLHAAPAAATLDGEDLAHGADAIGEVAITSGADLALAAVADDTVVQDKVAPDVAPPTPPAPPRRPAPPPTDARLVVSQFADTVLTGSPDDTVRYGGRADAYITLRGDTWGLDESWSLQIRPEFRWGDSANGVVGLVPKNTALFRPEGTDNYDLSLSVKKTFGSGASLEVGKMNLLDISGALPIVASDGHFGFQNLGIALPPTAIVPNTLTGAMLTVPTKRAIYRLWVFDPDSQYGRTGFETAFRSGVGFLASAAALTRLGGKPGVYNLAVVGSTRSGPAVDILPRALTPPRNGRFGNESGEFALQLSGFQYLSLNPRAPGKGIGIFGRFQASMGDPTFLDYSGFIGISGNPAARPQDRFGITAFHYSLTDELVDDIAFRLPIEDEQGIEAFYTVGLPEAFELTLDVQVVDGAIVFRDTGVTAGLRLTKTF

SEQ ID NO: 2240 - protein, 385 aa, Burkholderia dolosa AUO158
MNKKLLTIAALAATAGTAHAQSSVTLYGVIDAGISYVNHSKTANGGTGKLFKYDDGVAQGSRWGLRGTEDLGGGLKAIFVLENGFNSGNGTIGQGGAIFGRQAYVGLSQSQYGTVTFGRQYSFSTDILGSNYSTGGNTVAGNYAYHVNNIDQLTSSRINNAVKFQSANYSGFTFGALYGFSNSTDFAGAPATTTGTTTTAGSSRAYSFGLNYANGPVSVGAAYTDIRYPSQSTPGFSTTIANLSTGNVRDLRTYGVGGRYVWGPATAWLLWTRTQFSTVSGAGGTFYNAYEAGAKYAFTPALSGGLGYTYTNATQNGNSWHWNQVNGIADYALSKRTDVYGLVVYQQASGKGVQAQIGSSTSYFNTSGTGSKNQIAARIGIRHKF

SEQ ID NO: 2241 - protein, 359 aa, Burkholderia dolosa AUO158
MHCYESITSGLKNIKKGIRKGYPKLRKGSGLIMKKTLVALAVAGISTSALAAGNIYDNGTTSFNLKGEIDTYVSTVEGKENGKTVVKRDVDVDLWAKIQIDAEHKLNEDVKVFGSFELENGEFFDKDNSSDHARVRTDDLYFGAYFGDNWGVAFGEVGDFGDSLDAITIDNTNEGLGYVDDFVKSKESAGHAVSVKGSFDKLTVIADAYLDQDEKIDTAFGLSAQYAINDMFTVGASYQDQENRDAAGTDYQVMGAAVRFNMDNFSAAVNYVAEELNKADQDTWSAVAAYKMNEARVYTSFGFTEYEGDHDQSYYTFGADYAVTGNVLTFIEYTSSENDEKNVSKKEADLVVAGVYYTF

SEQ ID NO: 2242 - protein, 1159 aa, Burkholderia dolosa AUO158
MSFASGGGKMAGRKDRASRARARIGRAVGTLAFLIAGTAIAGAQTFEAAGAIFFATASRQTSAIPLDLSTIIGSSAGIVSGSISSTGASGVGTVITSQAPIATGTMTPVTGFGTTIATAPTLIVAKPGSGSPQSPPAGWSLYSGYSTSYSIPYANTPVFGGPQAQLMVNVTVGGQTTQVQVDTGSQGIVIPQYLFGNQTFTGKQGTIVYSSSGNNATGIWTTMTVSFPGAKDQNGNPTTASASVPVFIEQSANNGTKDCTVAGTGCYFMMGIGYGRPDNGWTGYQPSLNTNPLLHLTGMDEGTVRSGYIVTATGIQAGLTAANAGQGYALIQLQPSTGQASANWTTPPGTLIVTPNGGSPATTALPVLVDTGISYLWGNLGTASTACTYHNQQFTCAPAGTAVTVYLGPGSYVGYSYVVGGSDNNSAAPPASRDSVIGALNTGISPLAQFDLMFDAVGGFAGYKATAPNTSGIYFSPYLSTAGALSVPDGFLTTLPVYVSSATTFSTTGTATLQGAVTGVSGLTVAGPGNTSFFGTVTLPSVTISGGAASFLANVTAPQFQVLSGAAAANSATLTATVSNAGTLINAGTIVGGVSNSGTVFNWQTVTGAVQSSGTFANTGTVNGTVTNSGTLTNDGTINGIVISTGTMNGNGIVTGALAVSGTVAPGHSIGTMAVNGNVELRRGSVYEAELGPAGTSDRILASGSATLDGTRIAVSPYAGYTPGLGSYQIITAGGGVSGTYSVSAPDFGALPAAYPFLAANGRITGSGLTIDMVRSTVPFAAAGITANETATGRGLDTLAQQGTLFNALLGLNAATAAGAYDQLSGEIYASTQSLLIDQSFYVRDGVLGRLRQESGAPGAAGAVQTATLVPGLPLTLWGEGYGGWGQAGGNGNSAGDSRSIGGFLMGLDLPLGTNWRAGIAGGYSQSTFSTDARGSSGTSDNYDVALYAGGALAAVGPGTLNLRAGAAYAWHDIAMSRSAAFSGFANALSAGYGADTAQVFAELGYGFTLEKTPLGRVGLEPFAGLAYVHLSTDGLTETFGAAALSVASSSFDTTLTQFGLRASAVLLPGPNLPAVDVHGLIGWQHAFGDTVPTVAASFASGSLPFTVSGAPIATDSLLLGFGLDTAIGQNARLGVAYTGQLASNVQDSAVKGTFSLRF

SEQ ID NO: 2243 - protein, 379 aa, Burkholderia dolosa AUO158
MKHTKALLAAGACALAASGAHAQSSVTLYGIIDTGVEFVSHANAAGDHVVRMPGVTGELPSRWGLRGTEDLGGGYQAVFTLESGFNVRGGDLGQGGRLFGRQAFVGLKSGFGTLAFGRQYTMTYLALQGADIIGPDIYGLGSFDAYVPNGRADNAVTYVGTYRGVTLGAAYSFGRDGAGTGNSPGQGTCAGQVPGDAVQCRNWSVMLKYDSAYFGAAASYEEQRGGTGAAANFFDGVAPVPFTSSGGKDARTHVSAYAQAAGARLGAGWIGRRVSTGSPAAPGAHSDLFFVGASYAVKPAFIVDGEGYRIVNSAHDTRATMATLRATYLLSKRTAVYAQSSYLWNSAHARYAVSGGGAGTTPGAGMGQLGAMVGVRHMF

SEQ ID NO: 2244 - protein, 759 aa, Burkholderia dolosa AUO158
MSRAPHAPSRRRAFGRGFAAAARAAHGAPVAPVAHGAHACFAAASRRATAVERCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGARLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWQATRDVDLALYARNLANRTYAASTSNGGAQWLLGPSRSVELVATLRF

SEQ ID NO: 2245 - protein, 532 aa, Burkholderia dolosa AUO158
MRRCEIITVLALLTLCSVYVRAEPENIVITKFEPVQQYDQIKHQAQKNTTDFSPSKVCLPYKGIKFQGITLIDPLPYLPKKNECLNQSRLNQLSQDITQAYLNKGYIHNPFQFEDKLSGFLIMRVLEGKVIKLTSKSDRVNLNTIAYHILGNPLKVQDLDQALDQANQMFGSRVTVDVLTQQDGGIHLDLVNEEQRRVNGFIGLDNNASKIYRRWQAKTGAYVDNPFGFSDMLHLGLTHSLKSFQHDYTQSASLLYRIPYGYKALSVYGSISKFKQQLPLKFNVLKQAGKNWQLGAKLNYTLARDSRYISNISIQLEHSDNKHYFEDVLVKIQSPRITSMQAELSYLRLFKQGSFLANLLYERGLPWFNAMRNQGRHQPEGQFSKWRFDLSFNYYYQFFGKTLHQYHGLKTQYSKNYLVSGKQFDLLNKENVRGFNDAGSLSENAVILRNSLGISFQCKNWKVGPYGFVDIGRQKNSINNIAPQSALGYGVGINLENKKALLNVEYARGKFFSTKEATKQENSIYIDIKCFF

SEQ ID NO: 2246 - protein, 1027 aa, Burkholderia dolosa AUO158
MRNKIRYIRLIGLIFVLIVGSSLTFAQNKSKRKSAKKPLVEVVSIVTDEKGSPLKNVSIICGEGAVVLYTDAKGRFQTKVENDATVMVEALGYEDKVYKLTGSNIVPEKIVLKKEPLFLTEESLVNRADGGKTYKGNEVGATSVLENGQFGTFPDLTLTNMLQGKMLGLQVRSTVSGLGNNTPDLFIRGQHGMSENTAIVIIDGVERPAADLIPEEIERIELLKDATAKILYGARAANGVLWVTTRRGKANRRIYNATAEAGVVQMTRTPDFLNSYQYANLYNEARANDGLTPYYNQKQLEGYKNSKGVNDLLYPNVDLYDQLLNKNANYRKVSFDMTGGTDRVRYALIAGYVGGSGFEDVTYTPQLHRLTLRGNLDFNVTDFLTISADVAGRMEMRKWGQLDCGQVFTALSTHRPNEYPLTMSPEETGLASSDGIPLFGASLLRPMNAYAETMYGGYTDERYTRSQTNIGLKFDLDMLTKGLKAGAFLSFDNYDYLQLSLSKVYPTYAIKTYRDFAGEEQIMYTQMKKTDVATSQSRKSTTLQQTLGWNAFAAYENTFNQKHDVSARLTYMYSKTTNQGVTQDIINANYALRLNYMYDHRYAVEADMALMGSNRFKSGDKYFFSAAGGLAWILSNEDFLKDNEYVNFLKLKTSAGILGYDRSTEHLLYERAWSQDGSFRFGTTNNGATAYYSTFVRAGNPNLKWEKAAEWNIGVEGLFLNNRLYTEINYFREKHTDIIGSVDASYGDYTGNFTYQDNMGSVLNHGIEGMFTWSDRINDWAYSVGANFVWSKNKVLKWNQVKHGEEYRYTVGRSTDAMMGLVAEGLFGKDVAINGHAPQTFADYQEGDIAYKDLNGDKIIDGRDVKELGNSFPRTTLGIDFNVSYKGWGLYLQGYSELGVHTWATNAYYWNNGEGKYSKLALDRYHPANNPTGSYPRLTTTAGENNFRNSSFWLKNTSFFRMKNVELSYTFNQFSPSSVVKKMKVFARGANLFVLSSVKDLDPELLNAGVTNYPVTRTFTGGVSFVF

SEQ ID NO: 2247 - protein, 713 aa, Burkholderia dolosa AUO158
MKPSVHFQLTLLALAITSVPSYSLAADASEATDTRSEDQLSALVVKGQTYRNTATKTQLDPEETPQAISVIEKEALQQRGTETVAEAVRYTSGINTELRGGAVTRLDFFNIRGFENDKAYYDGLQLLYNDWNLQPQIDMAAVEQVEVFKGPTSTLYGAMPPGGMVNLISKAPQSESQHSVELTLGSDNKRETQIDSTGAINDTMNYRIVGLLRKKDGQAVTSEEERIMIAPSIDWRISKNTMLNLNLYYQKDPSMGIYSTLPSKGTVYSSINGKLSSDAYAGDTNWETYDRDVLLLGYKLDHKINNTWSFLQNARFTTAKVYQENTYSSSLDSDERTLNRRAYLTDEKSEGINIDNQFSGVFDIGNAEHNVLVGVDYLKLKSDVIYENAVAPSIDLYNPNHDQIIRDNLDFAGSGYSSDFTIDKEQTGVYLQDQIRLDQWVFIAGGRYDQFKATEKGRKYGAATNTKVDQSQFSGRAGALYEFDNGLAPFISYAQSFEPVTGSDRNGKTFDTSTADQWEAGLKYKKRDITASATAFEITKRNVLTRDPDSTDYSQKVQVGEMQSRGIELELQKAITSDITVKAAYTLQDVEVTKDNSGIEGNTPVWVPKKQFNTWLTYTPTEGRLAGTSLGAGVRYVGQMQLDAANSNTVPSFTLVDLSIGYDLSMLSAQWQGASVRFSMSNVFDETYYSCYDESNCWFGDERAFEVSARYEF

SEQ ID NO: 2248 - protein, 455 aa, Burkholderia dolosa AUO158
MRICHTRALEQPHAHRRWSRVLDTGTRRYPPMRSLLAALSLLISGAALAQDATPQPPLPSPAASEPREAVEPSATTPQERPPPRANAPSVPEASPSIDERLTADEHRVEALEEQNTETKNDLSALKKLRISGYIQARYQYQEPLDEITGAGGFSRFTIRRSRLKATYTTDLAQAMIQIDASPTGVALRDAEATLFIPGTKQQLSLTVGQMKWPFGYEGPQSSSDREFPERTRVTRNLLPSERDRGAKVNGRYKFLRLAVGMFDGAGIDSGTTQDNDKEKDLIGHVGFDLKWIAGGVSGWYGHALGKLPTDTFRRAYDRSRVGVDLQTYFDLLPVGGTSLKGEFLAGRTYGAANNATHLDVPAHGWYLLLVQNIGLNDAVGFRYDSFDPHNGQPDDGTLELPGADNTVDTVGFVVQHHFGENLKMTASYELPITHVIAQAQDPHDNLFTLQMQARF

SEQ ID NO: 2249 - protein, 367 aa, Burkholderia dolosa AUO158
MRLKHFAWLMAAAAPATALAQTSVTLYGRIDGGVEYLNHIATPSGSATRWSAEGGDWGTSMFGLKGFEDLGGGMSTVFNLETAFQVMNGTTGGGRMWSRRAYVGLKSDTWGQLQAGRNLFIDSDGVWEFDPFVQQAFSSASLVRGRNWQQSSNNVEYHSPVIGGFDVQAQYAFGNQSRGFNYGAADDFGRSDGIMISYHSPLLDVRGIYDELRDRNGKMSNIFTASREYFVGANVKVSQFKIQGAYTHYQAPDSPAGVADRADHYWLGATYTATPQWAVTGGGYYVKVGDGGGDASHDPSGHAMMYVLGTTYNLSKRTFLYGTVAYVRNGGNSNFSLLASPRDATSGTSPLTGESQTGAYVGMMHTF

SEQ ID NO: 2250 - protein, 138 aa, Burkholderia dolosa AUO158
MLDKLDAALRFQQEALNLRAQRQEVLAANIANADTPGYQARDIDFASELKKVMQRGRDATSVVALTMTSTQHIPAQALTPPTAELQYRIPDQPSLDGNTVDMDRERTQFADNSLQYQMSLSALSGQIKGMMNVLQSGN

SEQ ID NO: 2251 - protein, 1317 aa, Burkholderia dolosa AUO158
MSGLPVSHVGEKVSGGVISTGSPTVHVGSSAVGLADRVSACVPLVGKPVNPMLGSKLLPEEVDFALAAPDTFTFARGYLSSNPRIGRLGRGWWLPGESMHLELSEDACVLVDAQGRRIGFPALAPGAQHYSGSEELWLRRGGSSGGEAQAWRGRWAAVPAELQTQEGSVLVLSGHSYLHFQRCPDGIWRLQASFGRAGYRTEFRWSGRGLLTGVRDSAGRSYALVYQQACEPSEGDDGLRLFGVILASHDGPPPDYIDPQSPGLDWLVRYQFSDSGDLIAVRDRLGQVVRVFAWREHMLVAHGEPGGLEVRYEWDVHAPHGRVVKQIEAGGLTRTFRYLRDATEVSDSLGRVERYEFAGEGGQRRWTALVRADGSRSEFDYDLFGRLVAMRDPLGRETRRRRDGQGRMLEEESPGKARYRKRVDEETGLLVELEDAMQRRWTFERDERGNATTVRGPAGSTRYAYEDPRLPDRPTRIVDPRGGERRLEWNRFGLLAALTDCSGQVWRYDYDNEGRLVASSDPLGQLTRRRYDPLGQLIGLELADGSALSYEYDALGRQTRIADAEGHATLFSWGHGDLLARVSDAGGGELSYLHDEAGRLVALTNENGVQAQFRYDLLDRLVEETGFDGRRQRYRYNAADELIAREDADGRETTYAYDRDGRLASIRVPATEHAPALVERYRWLADGRLASAGGADCEVRYTYDEVGNLRLESQVHADGWVYSVEHSHDALGVRQTSRYGDAPPVAWLTYGPGHLHGALVGAVELAFERDALHREVRRDARRDGQDDALFTQERQHAPLGRLQRSRLRLAGGFDWQRGYRYDGLGQLVGIDDNQYPSVRYEYDLGGRLLASRRAGAAASTYRYDAAGNRLEGVGEHAREDARQAFAENELYRSGFSRSETRASQAGEGPARWAGNRVERIAGNRYRFDALGNLVERIGADGERLRLAYDGAQRLVHLTRDYADGTRLEARYRYDALSRRIAKVVLRDGVEQQVRFGWDGDRQCAEAFARELRTTVHEPGGFVPLLRLEQACEPDPPELLQLRQAFAAEGQPLPAQCVPALGEARIAFFHTDHLGTPLQLSDERGQLRWQGVPDDWRAVAPERQPGAQPIRFQGQYHDEESGLYYNRYRYYLPEAGRYASQDPLGLGGGPNPYAYALNAPTLAYDPTGLIIPLVVIGAFAARAAIGAALGAGIELGMQTGKQVLGQMKDNWDSDRDLTDIKWKCIDINWKHVGASAAIGTVAPGMLSTGKTVVQSAKAIRTLSGQAANTANRAAKLAARKAAHADTIKKAVATQAAWQTGKQIVKCPLKDEEEECPPQ

SEQ ID NO: 2252 - protein, 379 aa, Burkholderia dolosa AUO158
MKKTLIFAALSGACAAAHAQSSVTLYGLIDAGITYTNNQGGHSAWQETSGSINGSRWGLRGTEDLGGGLKAIFTLENGFGINNGTLKQNGREFGRQAFVGLAHSGFGSLTLGRQYDSVVDFLGPLSLTGTQYGGTQFAHPFDNDNLNNSFRISNAVKYQSADFGGLKFGALYGFSNSTDFSNNRAYSVGASYSFMGFNVAAAYMQLNNNINSLALAASDPGAVAGDWTFAASRQRTWGAGLNYAFGPATAGFVFTQTRLTDSAGISAGQSGVSGGIPLTGDTRFNNYELNARYALTPAFSLAGSYTYTDGRMEGQKPSWHQFNLQADYALSKRTDLYLQGEYQRVNGDGLAVGANINGLGVASSTNKQIAVTAGMRHRF

SEQ ID NO: 2253 - protein, 379 aa, Burkholderia dolosa AUO158
MKQTKVAVAAALACAACIPTIGHAQSSVTLYGILDAGITYVNNTGGSHVVKFDDGVSYGNRFGLKGTEDLGGGLKAVFALESGFHLGNGQLGFGGAEFGRQAYVGLQNDWGTLSFGNQLDITNELVSIYNISAWGSGYAIHQGDFDRFNGDRLPNSVKFLSNDLSGFKFGAMYSFGNVAGNFHRNSAWSAGASFTKGDFSIGAAYTRLNNPNGIYAFDPYAMIGTHTFLGQQTVTVDPATGARTDLFANTAMDVDSQGTFGIGTSYTIGKLSLDANFSYTTIKGFGQSSHMQVYEGGGLYQFTPALSFIAGYQHTRFEGHHWNQGTAGLHYLLSKRTDVYISGDYLRASQGVDAVIGYSFTPSTTQTQADVRIGMRHSF

SEQ ID NO: 2254 - protein, 767 aa, Shewanella baltica
MITTNTLFRVSSLAIAIGLSFTVQADEIARDPRLNINEVIVVHGDGGEASEMATTHWSISEEEIRATGAQSLDQVLKNVPGVYIRVGGDGTPRVDIRGFKTRHVTLLVNGVPMSSADDGQFDPSIIPTSQIASVEVSVGPTSVLYGPSGAGGVINIITKQGSTAPALAGRLEAGKDNTFNGDISAAGSGDDWQGLVSVSRQQTDGFPMSNDFEPTQYQDGELRVNSDKEVTNVYAQGSYWLSDKTQLIANMALRSGEWGKPARDGTGSGKLKFERTDDYDAHTFQLGLAHQFDDTFTLRGFGYHNQSDTLEASYADETYQAVTLSQDGRSVVQGINLQLITDLHTAGLFTTSVIAEKQSWKSVVDTYTANTGSNNGGTIGSGGGTGTGGGTGTGGGTGTGGGTGTGGGTGTGGGTGTGGGTGTGGGTGTGGGTGTGGGTGTGGGTGTGGGTGTGGGTGTGGGTGTGGGTGTGGGTGTGGGTGTGGAENLNDSAWLYTAAAEYQYQSELQYGFTLGGAYHSLDTTDSTDGNYSAMASSYWQAAQDSRLSLSVARKVRFPSMVNLYSQLSGNRDLEAEESKHVELGLEQNLPASTDFSLYGYYTDAKNYIAKDVDGFYQNMGRYKFKGVDFQINNHAIEHLDLSFSYSFLDSEEIDGDDTLDALQYRPRHQLRWQMSYEFPFETQVHLNVERILDQVYATQVKVGGQTQYQQQSLDNYTLVDVNLVQPLIRDKLDVYLRATNLLDENYYQSEALPQAGRQIFIGVNWQI

SEQ ID NO: 2255 - protein, 728 aa, Shewanella baltica
MPPLSVLTSWRSPLIPVLLSTLTLTVQANTDPKQDEKEDTEQIERLNVVGTYTRAAMNSATGLSMSLKETPQSVTLITEEMISDKGLITMESVLNHTPGVTMVGDASENSKIFVRGYALDSGVQIDGLITTSSSNVYSGSIDQGLDPVIAERVEVLKGAAGILSGLGEPSATVNFIRKRPTDDTRATASVSYGSWNTYRLEADVSGWLTDSGNVKGRFVSAVKKGDSFIDRYQRDTTVLYGVVETSLAVDTSLSLFADYQKSQTDGVYNWNSNPAFYTDGTAVDFGRSYSSSQDWTHWDVTQKSLMAEFKHRFDNDWSLVSAYRIANATIDALAFYPGDNIVKSTGEFVGPWGDTYSAQHDRESDTNSFNLYATGNFDLLGREHSAVIGFNYGDNEFDNINTNSTPQRRYNVADQGNYPKPNLPNSPTNGQKNEQSQSGVYGTVRINVLDSLKLMVGGRVSNWSYEKHDLVGNSTDATMEKTGIFIPYYGLVYDVTEQISVYASRTEIFKPGTYFGEDGQLLEPAEGTNVEGGIKVALFDDTLNMSAAIYETNKDNEPEYAGKGQLPSGDFIYESVDGITTKGYELEIAGRLTDLWDISGGYTHNDAEDEDGLRRQTYLPEDIFKLTTKYNFEDILPGVTAGASWRWQSSTFYQGTIWGVDGAPNVAYRQAQSAYSLVDLMFGYQITPSISMQVNINNIFDKNYNRSLWGYADFGEPRNATLSLRWTL

SEQ ID NO: 2256 - protein, 666 aa, Shewanella baltica
MLLSRKKYLAQVITALCLLPAVPVTNALADTAPDKEKMMERIVVTASGFEQQIRDAPASISVITREDLDNRFYRDLTDAMLEVPGVVITGGADRQDISLRGMGSQYTLILVDGKRQSSRETRTNSDGPGVEGAWTPPLAAIDRIEIVRGPMSSLYGSDAIGGVINIITRKVPNEWQGEVRLDTTLQEKSTSGNVYQSNFFVNGGLIKDLLGMQLYGQYTQREEDNIYGGYRGRDATNLTARFALTPNENHDIMLEVGVSNQELDSSLGKTVTPLAPGEACGRRGCPQSSTTEYENSTISLSHTGRWDFGTSDSYIKHEVFDNKTRKMKITNTDVQSSLITTLGQSHTATFGAAFNHQDLTDETGNQVSDLTDISRRQWSVFSEDEWRIVDNFALTMGLRLDDDENFGHHVSPRVYGVWGLTDSTTLKGGVSTGFRAPSLRQTVPDWGQVSRGGNMYGNPDLQPETSVNYELGVYSDLTESITASAGVFYNEFKDKITRVACPATQCTDGPNQFGSDPTTYVNIDDAVTQGIELSIDYRIRSNLSFTGNYTYTDSEQKTGAYKGSPLNQLPKHLIQASFNYEPIDNLSTWLRVNYRGEESQPTTGPSSSSFIAPSYTLLDLGANYQLNDSLKFSAGIYNAFDKDITQEEYGYLEDGRRYWLGMTYSF

SEQ ID NO: 2257 - protein, 725 aa, Shewanella baltica
MTFKTSFVALAVFAALSQSAAAQDAPDSSSNNKNKDIEKITVTASRMDKSPSSIPNTVTIIDRAQLEEQFRTTKDLSTIIGNLAPSFSPSRQKMSNTGETLRGRPPLIMIDGVPQSNPLRSGGRSGQTIDPAMIERIEIIHGANAMHGLGAQGGIINYITKKPTGDSEQVASFDVTVPDSMKSNGLSFGASYAFSGESEFIDMIGSVSYRNNGVYYDANHNVVGVDTTQGESMDSQSTDFFIKLGHNFDESRLELMVNHYTADNNGDWMPVAGDKPNGVPTGAVKETQPWEAANNQVTTTSLTYTHANIGGQQLNLQLFNQDFKAVYGGGCFDSFYDPSFEGSDQVIQCGVGSKGESLYYEQSRNASVKWGLKSSLIAKDIAGSGIDAAYGVDLFRDTTEQDLVKTGFSWVPESTYDNVAPYLQLDYDLIENLTLSTGVRYEHAELSVDDYKTLWGAGNKQIAGGSANFDETLFNVGISYKITPDIRVYTSYNQGFGMPDIGRILRDGKSFPGDNPSIDDSLALTPIVTDNVEVGADYQGKYLSAKFAYYRSATDFGSRLALNGDGFYDVKREKSVIEGIEANVTAYLTSNDDLGMNIAIQQGEYDSNGDNKVDTDLDGANISPNRINLFWTHNFDNDMSTRVQANYYMDRDFKNAAGNKYAEFDGYTTVDASFSMPLYTGTLSLGLQNLFNKDYFNYYSQTMGTNDRYFKGMGRTATIGYTLPF

SEQ ID NO: 2258 - protein, 449 aa, Shewanella baltica
MQKRLLTLAVTAALLSSTTQLHAAGFQLAEYSATGLGRAFAGEAAMADNASAQARNPAMLTYLEGRQLSTGGIYVMPNVDVTGDVSISSPLLGPDPVVMKGGDALDVADDALVPNFYYSNQLNDQWTWGLAVNSNYGLATELPATHAAAIFGNKTSVTTVEFNPNIAYRINDAVSVGAGVRIVYGEGEIGASLPGWVDGIKPALPAPVQAMLPPGGTELKSMKGDDVGYGWQLGASWQINPAHRLGFAYHSGVQLDLDGHASGVLYTGGQDVSIEGYLPLELPAFAEIASHHQLTDNWAMHASVNWTDWSVFDQLVAYFPGDVKPKGNLESDLVKEEHFEDNWRFALGTTYQVNNDWLVRAGVALDKTAANDEWRTTTIPDSDRLWFSVGAGYQATKNLNVDFAVTYIKATGDAPINEQQNLLGLAAVNFNGEASGDVWLAGIQMSYKM

SEQ ID NO: 2259 - protein, 653 aa, Shewanella baltica
MGTNPTKIALLIGSLCSFSVIAPAMAADDTSTAKVDEHLVVIGRSDNTPLNIAANVNVIDAAAIEMSGATSVTDVLRGQSGIQISDNNIGTSFAMRGFSASTAVNNTLILLDGRRLNNIDIAAPSLNAIPLNQVERIEILSGSAGVLYGDQAVGGVINIVTKSPENTGGSVQLSGGSFDTYEGRGDVSGAINKDWRYFFTGSYNQGDNYRKHNANETGSILGRIQYKTATDSFFVETSYYDDDRENPGSLTKKQFKDDPRASSNKLEYAHEMTTAARTGYQHQLNQNWALSADLDYSDTLVSSFNWGANSHNTRSLLMFSPKALANYSTRQGELNLVTGLDISRGKADFDTMARSNVQQMQSAYLQATVPLSHTLSYVVGGRYARVTDELVDGNVYPNGMDLDEDATAFEFGLNYRPSTEHRFYLRGDENFRFAKVDEQAYTSKNVFGLKPQMGRSYEAGWDWTLASQTLRVSLYRLDLEDEIVFDPSAEKPELGSFQGANVNADASRRYGASADWDWQVTQAMQLGLEYNYIDAEFTDGINDGKELSWVAKHTGRGYVSMDFAEHFQVFAEAIYTGNRFIEGDNANEGDKLASYVLGNLALNYNRDAWLASLRIDNLFDKDYVSAGYYGGGIYNGYYSGRGRDIRLTLGYRF

SEQ ID NO: 2260 - protein, 861 aa, Shewanella baltica
MNRPQILPSACAIAIALAFAPTVAHAADKGAEKVERIEVTGSRIKRTDIEGPSPIQSISKDDIANMGFDNLQQLLERMPANGAGAFSTRGNSQDSTANGGASISLRGLGPDATLVLINGRRVAASAFAEGITNSFVDINNIPVSAIERIDILKDGASAIYGSDAIAGVVNIILKKDIEGIEVNLGYGDASGTGYDETTANMVWGMKSDKGSASVILDYFKNGTLAATDLGRFGSADQTPYGGEDFRSSRGFPGYFYVDGVKTIDPACPPDRATPSGSCVFDYGPYNLVIPSAERVGAIGQFEYHFNDDLTAFLELAAQHNTSEAGGAPTPLDEDAGLTVPGTHPNNPWGKDIEIGRFRTVDAGARRWDIESDTLRLVAGLRGVVKDWDWEASVQKGRSESTQTGDRSQGWVRTDYLQREIDAGRYNPFGGTMNSQDVIDDITTSLVRQGLSNMTSYAANISGQAFTLAGRDIMMAAGAEYREEDVSDVPDEQFQRGLIFGTEAVSAAASREQYAAYVELSIPVTDNFELQLAGRYDHYSDFGSTTNPKVAFQWGVTDEITARASWSTGFRAPSLAQIGLGPSRESSFFIDTYRCAADSVDCEALDYNTEFEGNSELDAEESETWNVGMIWAPSQKFDVGFDIYSITQDNKIDKQPLGDIYTANCNDQNSTVCERLAPQVGQTLGPISIIHSSFINLSSQDVQGMDVSSHYGVELDSYGDLKFGLEYSYLHSFEKDGLDYTGEYKFPQHRWLLTTNWTMDNFAANINLSYIGEFEDTPDINFDGVLDFESNKSRMVDAQILVDMSGTYRFNEMFKLTLGVNNVFDEEPPFAIGDGDTDLYGYVISVHNPMGRYIYTKLTMNF

SEQ ID NO: 2261 - protein, 815 aa, Shewanella baltica
MKRLFIFNKFIGILSLALLQIFTMKNILYVLIFLGSLHPLLSQEKYTLSGTITDVSSNETLIGVSILFPELNDGVVTNSYGFYSITLPEGTYKVQVSYLGYKDVIETIELNKDIRKNIALSTSLEQLDEIVIEEKVERVRIRKPQMSVNALTSETIKSIPVVLGEADVIKAILLLPGVTSAGEGASGFNVRGGAADQNLILLDEATIFNSSHLFGFFSVFNPDAIKDLKLYKGGIPARYGGRVSSVLDIYQKEGNSKKTKVTGGIGAVASRLLVEGPIVEDKAAFLFGGRASYAHLFLPLFDIDNKAYFYDLNTKINYKINDNNSLYLSGYFGRDLFSVSDSFKNVYGNAVGNLRWNHIFSDKLFSNASLIYSDYYYGLDLDFVGFEWNSGINNINIKYDLTHYLNDKMKIYSGINNLYYTFNPGKIQPNGPDSGIIEEQLVKKYANEFAAYVDVEHKLSQNLTVEYGLRFSNFTRLGQDEVNIYSNDQPVSFDPFLLIYQSEDPIGVDTSFSRGDKLATYNALEPRIAASYAFNDDTSIKASYTRLVQYLHLLSNTSSPTPLDIWTPSGQYAAPQQLDQYAIGYFKNLEIGNSEYTIETEAFYKDIDGRIDYIDGAQLIANEAIEQVILQGEARAYGLEFLLRKNDGKFKGFLAYTLSKSEQRTPGRTPEELGINRGQWYNTPYDKTHDISMNLNYELNDKWKFGSNFLFQTGQPTNFPVGQFEFQGIVIPTYGPRNEQRLPNYHRLDLSATLTPEKNKNRSWQSEWVFSIYNAYNRRNAASINFRQNADTGNNEAVRTAIFGIIPAVTYNFKF

SEQ ID NO: 2262 - protein, 195 aa, Shewanella baltica
MPKLGMQSIRRRQLIDATLEAINEVGMHDATIAQIARRAGVSTGIISHYFRDKNGLLEATMRDITSQLRDAVLNRLHALPQGSAEQRLQAIVGGNFDETQVSSAAMKAWLAFWASSMHQPMLYRLQQVSSRRLLSNLVSEFRRELPREQAQEAGYGLAALIDGLWLRAALSGKPLDKTRANSLTRHFITQHLPTD

SEQ ID NO: 2263 - protein, 220 aa, Shewanella baltica
MKLALLCSVAFLAAASPVLAADIVEPVAAMPFSWTGFYGGVQAGGGWNDSRWSGATFDSFNTNGSGGIFGGQIGYNYQINQFVIGIEGDLAGSTVKGDGQCSTALGTTCETKQDYLGSVRGRLGYAIDRILIYGDAGVAFTKYKIAEVDGFHQSFGGGSRVGWTAGLGAEYALTDHWTAGVEWNYYDFGTKSGESDTIPGFFVDNRNTENVVVGKINYKF

SEQ ID NO: 2264 - protein, 904 aa, Shewanella baltica
MTRSAVMTSMAISLASMATFLGIAAEAETEAMFPVSAIKPQVSTPTAIERIAITGSRIQREEMASTAPMTVFTAQDIEKTGATSVEVLLQRMTASAGFAGNQTNAYWTEGGYGSTQVNLRGLGVNRTLVLLNGRRMLNSGTGANSSVDLNTIPISVVERIEVLKDGASAIYGADAVAGVVNIITRQQIEGVEFQARTGITEQNDGEQYKLDLALGHVGERGSAYVAMSYDKTQAVDMLSRASCPLEEVNGELVCGGSSALPGGRGHFIDTNGNPIGDPLMLLPTGSAPYTSSHKDNTYQYFNAVQPNERVNLFAYGEYDLTASSQVFAEAMYTHRSSQLPATPQSVSGIVIPAWHESNPTDADFLLQSRRLAEAPRQFNIQADTWRLVTGFRGDLDNGWQWDAAVNFGSNRGSYEVTNVINKARLAEATDYSNCNLDPNVPCADFWGVGSLTPEMLDYFLFNMRDSGGNEQFSLTTNITGDLWQLPAGMMSFAAGLEHRNEKGWNDPDPLKISGEANTAQQDPIDGRYTADEIYLETLLPILSDLPFAKSVELTAALRYSYFDTFGGDTNYKMGLLWVVNDAVTLRATQSTAFRVPNIPELFGGIDQGSMNTTDPCSEWAKLDPSSNRYANCMASNVPTNYKQEGTILTDRGGNAELEPEEANTFTAGIVWDLGFIEGLNITLDYYKIEINNAINSVNGSSKLAACYDSKGMTHPFCSDEHFVRDAMTGNITYLQTQLGNAANEVVSGVDMVMFYQKEMGSVVTNTTWELSYLDQYDLQTYAGAPVESRAGTIGYDGSYTKWRSNLYFDVTNDNWRFSYNIQYIGAADDQYANAGDIGDSVDAITYHNAQVHYQMDNNIAFTAGIDNLFDKQAPYHQSYTDGNTNTMTYDLMGRRYYVGMKWAL

SEQ ID NO: 2265 - protein, 684 aa, Shewanella baltica
MPSRYFTVSLCAISVSLACSNTTFADDFHSQMLELNQLNDTFHSTADSLALGQLTALMVLPADLNGNPASISMRSASQGVAVLQDRVYFSPAPYSAPQLQLLPNLLQQQSVTVTPMANMAVGGQGAFGVVSYQTLPVAEQAENCKVTLEGNTDADYSVDVNWGVKQKEYGMILAVNYSDGSGADHLLNGQDTDRQTTDILFKINAASLLGARSPQVTEFTYQFLDDDSYRSQLGLTQADWQQDPMSLYSATAGDKHQGRHHKYQLSHQVALSGGHKVITDFYYQSYSQQLNQLNQFDGKMLDTQSLAALAAFERQPTVDGVAVASLQQDNDFSSFGVQTESVNQYGAHQISYSARYYTDKAEMHLGDQQSLWQQDLSVVSDVPNALLAYTDDATAFTSAIDSLFNWDGLQLKLALAYEKVDVNRKVNLAYAGLEAADFSDSDWMPQLGVLYHAGDWRFSTDIRRSWTAASAGNLEQEAQVSLQYQVSAQYVSERFSADIKTYVQDFDNLHVNCDAYTQCADSRLWVQGNVVDVLTKGVELNLGYQWELGSVQLPLALNYQYSNAEYQTNSCNEIQGCVVAGDRVAWLPKQQLQLSAGMKYDEYELHANVFYQSKREMGQFGAELQPVAAQWRVDLAANYHFNRHHEIYFRIENLLDETLVTTASNSGIRSENGRISYLGYQWRF

SEQ ID NO: 2266 - protein, 696 aa, Shewanella baltica
MKKKPLVIAMAIALSSTALSFTLAAEENVKPVVQGDADKKLVTTEFDEVLVSATRISEKASETSRSVAVVGEEQLAVAQASSVANALKNEANITLTNGPRASSQGVEIRGLSGSRVLQTIDGARQNTGSGHRATYFMDPELLKSIEVLRGPASSLWGSGALGGVVAQNTKSAQDFLAPNETFGGFLKQGYETNGSRTKTSGAIYGQQDSIDWLLNGSYTDSNNIKTGNDETLSNSSSHGSSGLVKFGWQADEASRLELSARVNKINELVPSNPSAAASNSIPLVRRKTDDQNITLDYSFNPANNPYLDTKMQVYWNSTDYDEDRITKGQLDSTEYRTVGINLNNSSRLGNTLLTYGVDGFRDTIETTRDDSGQVGQRPGNIDGETTVWGAFTRADIELTQTLNLDAGLRYDSFKNDSNNLNLSSDDNELSPSLGLVWQTQSWLTLSARYDQAFRAPSVEEMYSSGTHYCIPPIPGFLPQGLCNTFATNPDLKSEKARNKEIKADLRFSELAGDDELALTFNIFRNDVDDFIVQQVSNPWHGIPGFEQTTSWNNVEDARLTGFEISGRYRIGQTRLAINYGQTHGEDRKNGGDIEGIPANKFNVDLSQGIMEGDMKLGTRVTYVATQSNTPDGFKVAKYDDYTLWDVYVAWEPTMGAMAGVRVDFAIENIGDEKYQQAWQTLYQPGRNMKLSARYMF

SEQ ID NO: 2267 - protein, 861 aa, Shewanella baltica
MMTSKKQKFGLSAVSLAITLALSGSFISPQAMAEEEDAAVKNEGVEKIAVVGSRAAPRSIGDSPVPIDIISSDDLKKNGSTDMIDMLVTSVPSFNSRAQPISDAATLVRPVNLRGLPSDSTLVLVNGKRRHRAAVIAFQGGGINDGAQGPDISVIPGSALKQVEVLRDGAAAQYGSDAIAGVMNFVLKDNSDGGSITVTQGEYYEGDGATTTVEGDVGLPLTDNGFVNLSFQYKNADATSRSVQRPDAANLAEQGNTAINDPAQVWGNPEINDDYSVFINSGLDINANMHAYAFGNLSSRDAVGGFYYRYPQNRSNVYSNDDGQNLLVGAVNGVQSTCAAVPIPKNADGSDGNVLDTDAYKAMVADPNCFAMNQIFPGGYTPQFTGTIEDMSFFAGVKGDIGEWNYDFSAGTGSNKASFGLKNSLNPSLGLDTPTDFDTGAYEQVETTVNLDFSRFITIGGIEDISFASGFEWRNESFEISQGDEASWIAGPYANQGFNIGAHGFKGFGPESAGKNSRHNIGIYTDLEAYLSDDWLVGLALRYEDFSTFGDTLNYKLTLQYSATDELSFRASHSTGFRAPTVGQENVVNTQTSIIDGELIQTFIAPPTDPLAAFYGGEVLKPEESISYALGAVYEYESFFLTVDYYNIGVEGRIAQSSKIDVEAKDYDALRAAGVEFPELIQGVSYYTNDFDTTTQGIDIVASYDAEILSGNAKFSLAYGWTDTSVDKFDLKTTDEGKVRRLEDGIPAHRATLTWAQSWDQLSMSLRGNYFGEYYATHADDTSDWGSEMADAAVTIDLEVSYELFDGLTLAVGANNLFDQKAQKLKVGDDYAYSQLGGVYYESGPFDYNGGFYYGRVNYRF

SEQ ID NO: 2268 - protein, 1741 aa, Shewanella baltica
MNHIYRLVWNRTLCALKVAPETAGSQGSGGTGTATIAPTASRRRTGWSVGLPALSALSAGLLPAIAMAATPIAGTLPTGPVWISGSGTVNSIGTTTTVNQYSSSGTINWSSFDVAAYSTVNFTTGSNAVTLNNISGTTASQIYGSVSAAGQTILANANGLVFGGTTSTGGLLATSLGVSAPATTGGSYSLDAAATRGTVAFAGGATFNGNSAALVGAGVSNNGLLMANGGRISLVAADHATMTFDDSGLMNVAISGALSTTQGSTAVVNTGTLLATGGTIVMAAAAQPGLYGTLVNNSGVINANGGNVRLSGTGGAVVNNGSIDVSQGGQSQAGQVQITSDAAVSLGGNIDASGTTTGGSIAISGGSVQLGGTLTAGTGQINLQSLGDVLQTWGSLTAGTLTGSAIGSMKLDQSSNNIAALGPISTGGDFALTTTRSLGQSGMLMVGGDTTINAGTNAITLTNASNAFAGAVNLTGGATQITSSSGLNLGTVNAGTLTATSTGALVFGTTAVNGSLSATSNRGFIMQNGALTIAGNSTFNAGTGAISLTNVGNWFGGTVNLTGGATTISSASALTFGNVNTDTLLATSLGPMNLGTGTVRGNLSASTIDKAITQSGALSVAGSTTISAGTGAITLTDAGNSFQGPIAISGGSVQIGGTLAAGTGQISLQSLGDVRQTGGSLTAGTLTGSAIGNMTLNQSSNSIAALGPISTGGDFALTTTRSLGQSGALSVGGDTTINAGTNAISLTNASNSFAGAVSLTGGTTIISSASALTFGNVNTDTLLATSLGPMNLGTGTVRGNLSASTIDKAITQSGALSVAGSTTISAGTGAITLTDAGNSFQGPIAATGSSVALRAAGDLRVSALNNSTNGAVSLTAGGALTLPVSAINTGTSNLQLAANGGTLLANAALSGSNVTISARDGIALYGPVTASGQLALSTSAGQWIFALGDVRAATTQLSSGTLRIGNATTTGSIGGNVVNNGTLMFNRTDSIGYADVISGTGNLVQQGTGTLTLTGVNTYTGATQVAGGTLALSGAGSIANSSGVQVDAAGILDISGITAAQASFGSLSGAGQIKLGTRTLATGGDNSSGTLSGAISGTGGLLKTGSGTLTLGGDNSFSGGTALKQGRIDLGSNGALGTGTLSMDDGTTLGIATDGLRIANAIRLTGSNDPVIDTGAFNATLAGAISGSGFLTKNGSGALTLAGANDYTGATNVAAGTLRAGAANTFSAASVHTVASGATLDLAGFSQRVAGLNNGGVVSLMGTTPGATLTVTGPYTGNNGSLRMGTALGDSTGVSDRLILSGPAAIASGQTTLQITNLNGLGALTAGNGIEVISAVNGASTTAQTSKNAFVLAGGHVDAGAYQYRLYAADAKGSGENWYLRSNGETGETGETGEPTETTPTTEPADPPVTTYRAEAALYAALPSQLRQSNLAMIGNLHQRVGDDDPRSATSGTLSGTPSGTPAGRDRRAWARVLTTDVDVSQDGTVSPKSKGRLTGFQAGTDLLATQDWRAGLYVGQLDGNVSVNGFVGGIANTGAGRNDLHNQYLGFYGTYAGNSGFYADAVLQLGRHRYTVTPASSSGVETKGDSLLASLELGRAFPLGGSAWSIEPQLQVVHQRIHLDNAQIPGATVQNDVNSSWLARVGARVKGEMEAGSAALRPYGRVNLYMASNGSDVARFTNPAATTDIVAATGGTSIEVAAGLTAALNRRFSLYGEVGRIWAAGGNAKVRNSILGSAGLQVKW

SEQ ID NO: 2269 - protein, 749 aa, Shewanella baltica
MGLDQNRHSVKTRFAYSLIALALAQHQSAFAAETVLDKEAPQQTLSTSSPVASPVSTEPAAYEQVKLAAPERIAVHGRAMQMYVDKETTVGTKTAINVMELPQSVQVLTEQLIVDQAARNITDLYRSIAGVSEFSYSGVTFRGFRDDANVFYDGVRGDPYSGFSVPQLFNVQRVEVLKGPASALYGGGEPGGMINYVTKKPTFVESKELTLSTGSEDMMGGSLDFTGGLTQNLAYRFGAYYQQEDSFRNNADSQNAEVAGGLLYEISDDTKLTTTFDIIKQDLGGNRLRGVPVDNDGNFLVAPSYNANEKSDFQKMDAVVLQSILDHQFSDNFSVKTQIRYLNNDSTQQYHESRGWATLDANKKPIMGDGTIKREYRVQARANDEISLTNDFVYAFDALGFEHEFLFGGDYHYVETEYSYKLATDKTGVGNLNIFDLNYGETDPSTYTLQDKDTDGTRANRYGVYVQEHLHFNEQWSLIAGLRFSQFDDYDKKTGFSFSDNAITPRAGLNYRPIDSMSFYLNYSESFNPASLTNQAEDIGDGFLDPETGNQIELGMKNEWLDGQFMTTLAVYRIEKQNVAQANPLDTGDDDGIPALLNLGEVHSQGVEWTLVGDLTDNLTVTANYAYNKTEVVKGVTNDSLTNTFDSKHFANAPRHQAGIWTRYDINALDSAIAFGMDYVGEQFSLDGQIVKPHTIFDMSWTTQWEQTQVRLNLKNIFDKEYAVSGFSERNGHFPGEPRNITLELSHKF

SEQ ID NO: 2270 - protein, 686 aa, Shewanella baltica
MDVKKSTLALAVGSALCLANNAWAAAPVGAVELEQITVTGEKINRTLEQTQSSVVVITDKQLREKEDHNLVDVFARTPGVYNQSGNENWGIRGVPVSGFEDQGPATLNGAVSVFVDGAVQPNRALTLSPMPLWDTEQVEVFLGPQSTTQGRNSLAGAVVIQTRNPTFDPSFSAQTNMGNYGERGAAVAGGGALVDNKVAGRIAVDYQEGDGYIDNTTLHDDANPTRTANARGKLLILPSDDLDILLTYAHGESRKGDNTVMRQNGKVRYYKMTSDTKAFDKLQQDTVSAKVDYRLDDYWSLTSLTANTSSDYDARLDFDQSADANQVVLRQQDGNLFSQELRLNYNGDTLKSFVGAYYGHNTNDFHDRLLFDNQLFGTAKGDTTIENQALFGEINWTFVPSWTLITGLRYDHETNDTDIDQDDFSSPGKVSKSFDAVLPKLGLDYELADGQYLGFMVQKGYRGGGVNMRAGGGHEAYDPEYTTNYELSYRGSLLDDTLRTRANLYYTDWKDQQVSVLDPNIEFVHVFNAGRSDIKGLEVSVEKDLGQQLTLNGAASVTVGKYKDFVTGDGRDMSGEDFLYSPKYKMSLGATYRWNERLTLNTDLVYQSTSPSEYEFDDAGQVTDERRSDNYWLVNFNTEYKITRNIAVSGFVKNAFDKEYITNNRSGDILDVGAPRTVGLALRYDL

SEQ ID NO: 2271 - protein, 820 aa, Shewanella baltica
MKPFRLSLTALACLSVLSQTAHAEANSISANAEANVERITVYGRQNSVVKNSGLATKSDMSLMETPAAVVIVDQELIETQGTDNLQDLIRNISGVTQAGNNYGIGDNIVIRGLGANYTYDGMYGGAGLGNTFNPTRSLTNVESVEVLKGPATGLYGMGSAGGVINLIEKKPQFESKHKFSAEMGQWDTYSLALDSTGGLSDDVAYRLVAKSGRSDGYRDIGTDRDEIYGALKWVLSDSQDLMLSGAYIKDAIAVDSIGHPIRIYNAESVGGKSAGEVTWQDLVNDPNGNGLQLTDAQRQQLAASLSGADGLTPYSFGDAGLISPMAKDNEGEELRFKLTHNIYFTDNLFLNQQLQYRDYTSGFARQTGAYNYVYWKRNIKIKNVLTDVINEEPRSPLVENGVLYPFAARRQEYRKVDADETSWQYFADLRYDFQIGNIDNELLVNANYEDRNIRFQQYSIFDADQIYKNKDGEITYQGSLPYIYDIRNPNWGTGKFEDYDPLKTANYDKKVSAWGLGVQHVGYLGHGFTTRVGVAFNEIKQSYEHLGVDERYSASQAAATQEEDTTDNGITYNLGLTYMPTDDLSFFVNHSKGRTAYSILGTVTGKNTDREDSESVSNDLGMRFKAFDDQMLASLVLFKSSRTNVPYTNEEYKIGVSGPEVPVYFYDGSEDTQGVELDLNAHLNDQWRVNLNGMYQDARDKQNPNSLTYNSRQKGVPYVTASAWVTYGADWFSLSSPIELSLGAKYVGDRSTHSSSFGIPDGYVPSYTVVDSAVSYSTDSWKIQLNINNLFNKDYYSKAMFLGGMPGEERNVKLQYSYSF

SEQ ID NO: 2272 - protein, 314 aa, Shewanella baltica
MMNVFCKTLLASALASATLASAYAAEPLTVYGKLNVTAQSNDEKGDATTTIQSNASRFGVKGNFELSSSLEAFYTVEYEVDTGAATSDNFKARNQFVGLKGAFGSFSVGRNDTLLKISQGNVDQFNDLSGDLKSLFKGDNRLGQTATYLSPSISGFVFGATYAAEGDADQQGQDGFSLAAMYGDAKLKKSPIYAAIAYDSDVKGYEILRASVQGKIADLTLGGMYQQQEETYKNALPVTTDSINGYLFSAAYDIDAVTLKAQYQDMEDKGDSWSVGADYALAKPTKVFAFYTNRSLEASTDDDKYIGVGLEHKF

SEQ ID NO: 2273 - protein, 739 aa, Shewanella baltica
MGCLPKFEKWKANRNLSLMGLCILPSMPLYAAEVLGEPKVEPIEILQVHGQQYRRAITVAKPGEAIISMEQIEEMQATTFAEVIDDMAGAHIDGGTRSGGERINIWGFGETEDFNVYVDNAPVGFEQYRYGSFFLDPDLIKRVEVIKGAHDVRSGNGGFGGAMYVVTKSADDFLKYDQAIGARVKTSYASNNDAMGYTGTVYGRVNPHLSGLLHLTRRDAGDVTLANGDEFEYSGYEQDNYLGKIDYEQGDHQLALSVTHYLDEGRKPWANRRGPMPAISDYNIKKYGSYELALYATTAYNTYEDNTWSANYRYSPSNPLIDTQVVISHSANARHWVRPDIAWEKMTVSVGNFGHESWLDYKRDYIDINNLSLIGDHEITTGLQYRSLDRTSLVFNKSYEKNPEKNFGWYTPYYQPEGRQDTYAVYVRDAIHLTNDLTVTPSLRYDFIYSIGRPNIAPDYNDISAGHDYSSTHHSGFSPRLGIDYQLTNYARLNFDYAYSLQAPVVDEIYAVQYAKASITGTSRDIDVERLHAFKLGLMTQHQHLLANDDALTTQLTLFANLGRDDIAQRRGAKSDKTQLIQSGYTNLDGYHIYGADFEAQYRYQDVFSDLAVSWLQGQHNGSFRDSQDDDEYLANMAPLDIRLRLGMYITDDISVAWQGAWYDAQTNVPHGDIFNAESPSENYFLQNLYLAYEPQAGLKGLSVRLMVKNLTNLQVVPFLSDGIPAAGRDVRLSLAYEF

SEQ ID NO: 2274 - protein, 878 aa, Shewanella baltica
MSEGQLFKSSLLALCIANALFGMSSTAVAAEQQEATAENMEVIQVRGIRRSIEASLNTKRFADSTVDAITSEDIGKFPDKNIGDALQRISGVTVDRQYGEVSGVTIRGTAPEQSRILLNGQTVASTSWYDLGPATRTFNMELLSAEQVNAVEVHKTPTARLEEGALGGTVDLKTRKPLDLDAHTYQVAGELSQSSLYDETDPSGSFLGSWKNDDEKFGILGAYSVEKITSGRQVLESLSGYYEYFAADPAQNQESTVGAWGIGSQAFRAERERTSAQVTLQFAPTDNTEFTLDYFNFELDIPHVNHNFLTVGARGSGSTNVVNNAQGGTASATILPAYASIIYNPVVRHAVNMKSDVLNLTGKYVGDSFTISGVIGQSTSDGGTQGGSSSWWIPATDQGGKIGDPAFPNGQGSVDGGFSYDATGPYQVVLTSLDANDASQFKHAQEANYETTVQDHKVTYAQTDFEYQLDHDFINKIAVGIKYNTSDFERNAFNRNPEEILGFVPNGNLANWSDGVLSGLHSQSGGNVLDSYAKLDEDKWWAFISEKYANGELVEVADLGNTFTVEEDMLALYAQADFSGEFYRGNFGVRYVNTDQTSTGFADGKPYNESVNYDNWLPSINVAFDLQEDLILRASASSVMARNNYSDLKPGLAIAKNFGTATGGNPNLKPYKANQADLGIEWYFTESSMLSAALFYKDIDNVVFVTESTQYIEGCGASESEWDKCRVTAPANGGSGSVTGLEIQLQHNFESGFGFLTNYTYVDSKSTRPDGTEQMIEGVSENSFNGSLFYEDDLFSARIAYNWRSEYLGVGNIQNVLNDSYQQVDASIIWHAMENLDVSLEGVNLTNEVVQSYDVKYGLTQNTIEFGSRYFVGASYKF

SEQ ID NO: 2275 - protein, 448 aa, Shewanella baltica
MMNKNKITLSLTAALALGMSTNTLAAGFQLAEYSATGLGRAFAGEAAMADNASAQFRNPAMLTYLEGTQISVGAIYVDPNIDVKGNLQLNDQTIDQTESRDIANSAVIPNFYISRQLNDKATLGLSFGTNFGMRTDLGTDFTASMFGNQAEVHTVEINPNLGYKINDQFSVGAGVRYIMAKGHFGAALPSALPAAVSGMLSPQQKYIYDQGLASKNLKYMEGEDNAWGWQAGAAWQINSANRIGVSYRSAVNLNLSGHASGLAYNNQTLPGSLPLELPASAEIATFHQLTDQWAIHTSINWTDWSSFEKLEANIPALGSHSNDLIKEENWKDNYRFAIGTTYQVNSKLALRSGIAYDMAAVDEAHRTQTIPETDRTWLSLGAGYQWSKNLTLDAGITYVYAKKAHLNETDKNINGLASGLLQQPTKLSFAGTTSGDVWLAGVQASYRF

SEQ ID NO: 2276 - protein, 403 aa, Shewanella baltica
MNKTLVATALAAIFLVPSVSAIEIYKDNKNAVEIGGFIDARVINTQGETEVVNGASRINFGFNRELTDGWKAFAKLEWGVNPVGSSDIVYNNRFESVQEEFFYNRLGYAGLSHDTYGTLTIGKQWGAWYDVVYNTNYGFVWDGNTAGVYTYNKDDGAVNGVGRGDKTVQYRNAFGDVSFAVQAQLKNSSFYTCDTTDDISQAQCQANWESGDKAAQQVEYNYTYGGALTYKATDMLTLTAGINRGEFEVSFGNGEQRTAIDVIYGAGITWGNFDNDGLYAAANFNRQENHDTDNIGRLIKDAYGIESLVSYKFDNGLRPFISYNVLDAGKDYVIQPNFNADPNDEFKRQFLVVGLHFVWDPNTVLYIEARKDYSDFTSADKDQEARMALSESDGVAIGIRYTL

SEQ ID NO: 2277 - protein, 1052 aa, Shewanella baltica
MRNRILFLLCFLCIGLQAFAQISISGKVVDAGGLELPGVNVMVKGTTIGTLTDGDGRFTIPDVPGSSNAVLVFSYVGFQTQEIKVGNTKNLTVKLQEDNMALDEVVVVGYGTSRKKDLAGSISSVKLDDSPLTQLANVNALVALSSKIPGFNYSPTTDAGGDNTASMTIRGMNSIITGPSEASLNKPLLVVDGSIFNGSINEIAMTDVESIDVLKDASSAAIYGSRSANGVIIITTKRGRSSKPTVNLDAYYGIQSWTRKPQMVTDQNEFLNRRREAMIAAGSIDPSVGLDPAQLLNAEELEVYNAGGWVDWIDEVSQNAQIQNYNLSISGNASDKVNYYLSAGYMKQDGLIVGDDYKKLTFMAKMDAKVTDWLTVGMRASYYNASNPGQIANIQSATWLSPYSHKYVRYDGYTDWYERYANGNVASPFWSSSETTSYLWTDREKKYDNLNGTGFVQIDFPFVKGLSYKFTMNAVKNTNNVDMFVNPQYFLDTRKVEELADPYKYTAEANGKSEINQTYAWTMDNVFTYTKDFGKNHLDAMLGYTRDATHQNQLKTAYSGFKLPTVLGSYGQNLATTQQINKTLKEWQNVGYMARVNYNYANKYYLTANFRRDGFSGFAKGSKWANFPGVSAAWTLSQEDFMQNVIPGLSFLKLRGSYGLTGNQSIEAYATLATVASGYTWYDASSLYIYQNSLANEELTWATTKTGNFGLDFGFLDGRISGSIDVYKSKTNDMLLNRSLPYMTGFSEAKFNAGEVMNRGVELSLNTVNINGDGKDNFRWESGLTFYRNKNKIVHLFGKDANGKEANDTGNATTNGYETARALVIGESINAAWDLKMLGIFQSQAEIDSYVDANGNKIQPDAVPGDIKFLDYNGDGKISTDDRHCIGDMDPLFTINFSNTLSWKNFSLYFNFRWDAGNSSHFIGSDPFGNYHNTATTSGAQLKVAPWSENNPTNEHPRLGYVNTYSYYFWSQRQYLKLKDLSLSYTFDQPWVKKANIQNLRLYLSGTDLFTITGWSGLDPETGGTIAAGPGSSRYGSKPAYRTLTIGANITF

SEQ ID NO: 2278 - protein, 936 aa, Shewanella baltica
MHKNNLLAKSVRFALIGGVAATALNVPLVMAADEAGADKKVERIEVTGSRIKRTDMEAASPVLSMNRDEIEATGMISVGDILQTIPAAGSALNTAFNNGGDGSTNMDLRNLGSQRLLVLVNGKRWISSLGSTVDLNTIPTSTIERIDVLKDGASAVYGSDAIAGVVNIITRKNFEGVEVSVYGGQNAKYDDGRQYTADFTVGSVSEKGGLLFNMAHVTQQPIWAGDRDISDTGYSSTADNTRIRVKGSQLNQANQDALAAIGKPNSSGIYDYMSKEGTGANVGMDQFRPRTGSDVYNFAPDNYLSTPQNRNSFYVQGFYDISDNLRVVSDFMMTNRKSSQELAPMPLTLGASFGAAASRVDIGGNNIYNPFGETLYGDSARAVANGKPVGYVPYALQRRMVEAGSRQYNQNDTTYRAMVGLEGNINDNWSWTASYIYGQNNQDVLTTGLLNLTRINQALGDNCNASNGCVALNLFGGPGSVTQDMVDYITFDSVSRSGLTMKDYTFNIAGDLFDLPAGPVGLAFGLERREESGFDTPDPLTVTGESSGNQRDATSGGFRLDEAYAELAIPVIESLLITPAVRVSDHDAYGNNTTGKVGAEFRPMDDMLLRGTWAQGYRAPSISDLYAGSADSYPTWNDPCNTRDSKGNVLNISGLPGCAGVPDGYRQANTQIRISQVSSPDLKPETSESYTFGTVYNPSWLEGAEFTVDYYNIKVEDAIGRYGHTTIARECATGDKVSSCDKIDRDSLGNIVDLRNFLQNAGTYEVEGIDFFTAYRFPETSFGSFKTSLDLAYVLGNEFDGEDRAGIQYGDGGFPELKGSLNIDWAMGDWDAHWKMRYVGELTSDFYANDPANYDFYKDNGYRETFSAYMVHNVSVGYNIEDYNTKVSLGINNLFATEPQAEGPTNNEALSSNNFSVTEYDVNMDRFIYLRATTKF

SEQ ID NO: 2279 - protein, 292 aa, Shewanella baltica
MGLDHIVIMIFVVTLLYNVYWSMSILKYFLEYMVERDSMCKKSVASILVSAIVFSGSVYADVNKTSVDLGYKFYTSDTKNDNPGVFNQPFVKLNHLGIADWGTYFANLKLENPAEIAENQKHLDGKTTIKSLLILENKLGESQFNFWTQNFISASETLVEDNLYLGVTHNAKIQNLSLNYGVGLNYTIGSFSPTSEKFNDLSGYAVVLNAKYPFELLGFKHSLSLNYEAQIDRDEAHQALFSYDSYGHQIITTLQTGFTDSIFSKLYITHYDSWGSQYNDGIEYGISVGYQF

SEQ ID NO: 2280 - protein, 387 aa, Shewanella baltica
MKQAKLSLLYSATLLAFMGSANAASLKNTDVEFGGYIKADVMFSDYGNGAPDSGDLSRQFYVPGTIYGKDGNGNQVVDFQARETRFNFKAATDLDGHSLSGFIELDFMTHTDGNERVSNSYSPRIRHAYVSYDNWTVGQTWTTFQNPAALPENLDFVGAADGTPFVRQSLLRYTHGNFQFAIENPETTVTPNQGGARITSGNGVVPDVVARYNLKTDGGASFSFAGIARQLNLETKIGATQIDSSSFGYGASVAGIIPIGKDDLRFTATYGDGLGRYMALNYINAGVLDASGDIESIRTFGGFVSYRHWWNEQWRTSVTLSGMQADNDVALTGTGVNKDAYSGYINLLYSPSKPLTFGVEYMYAQNSKENGDDGDLSRIIFSAKYVL

SEQ ID NO: 2281 - protein, 744 aa, Shewanella baltica
MLNSKTLNSYTSKRHSPFSTVSPSLFLTRAPLALAIAAALSTSAFAQTDAIDKPDPSTEMEVMVVTADFRSSSLEKMPSSITVIDSQKIQDESAQHFEDLLNSIANFNWSGGSSRPKYFQIRGVGEQEQYQGAPNSSVGYIIDDIDLSGIGMVSSMYDLLQVEVLRGPQGTRYGANALAGLIYLKSNDPTDVFEHGAEVSLGDDDLRTFSGFSSGPLTDSGKLLYRVSLQQHQQNGYHDNLYLGRDDTNGRDEFSGRAKLRWYATDDLQFDLTVLHADFDNGYDVWSLTNSPTQTTSDQPGVDSQRTTGAGFKATYSGAETFELTSLTSFANTDHHYSYDGDWSNPEYWASKQCSDDDGNLAPCQYDYFWDKTGQRKTVSQEFRLSSTEQGRIFADSTDWLLGVYAMNLKEDNQLYSEYNTWPDEVLDSEYEATNYALFGQLDTDLGSYYALSVGLRLERRNSHYSDTNNDNFDPSETMWGGHIAVSKVLNDSHNAYIRVARGYKAGGFNMTLPVELNDKKEFSTETLYNYEIGLKSHWLAGLIDTNLALFYMDRQDQQVAASQQDPDKPQRFILFTENAGSSNNYGAELDATWYATDNLQIYSSLGWLETAYGDYQYQDKYGTEVDLSGRDLAHSPHLTYSLGGTYRTNSGWFTNLNLSGKSEFYYSDSNESRSEPYTIVNARVGYEASAWSAYLWGRNLFNEEYGVRGFYFGNEPDNGWAEKQYIRYGDPRQIGVTFNVKFM

SEQ ID NO: 2282 - protein, 600 aa, Shewanella baltica
MRSSSLDETVASLPGVQSSNFGPGVGRPIIRGLDGPRVAVLRDGLSTQDVSTVSQDHSPAIEPFLANQIDVLKGPSTLLYGSGASGGVVNVVDGRIAETPVDGFSGRAEVRVDGDDKDGNKDGNTDMFRVDAGNGSGLSIHADGVYRNQNDYDTPKGRQLNSWVDSKVGSIGASLSGDWGFVGLSASRFRDNYGNPGEPGDPSIGERGVSLKLQQDRYDLKGGLTDPWGEGSALRYSVGHTDYALTEFEGAEVGTVFTKRANEGRVKASLTFGGGWQTAFGLLGSDSTFQAIGEESFVPKTDTRSLGAFAVARNNWERVTAEFGARVDTVKYQTDIGVDRDFTPTSFSASGGFRFNEQWRLTANLDHAERAPAEEELFANGPHIATLAFEIGGADLQTEKANQAELGLNFQNAWVDAKVAAYYNRYNDFIYIVDTGGQWFNEEDNDFLPIRQWTQADATFHGFEGEATFHLANNDNGAWDLRVFGDTVRARLNDGGNLPRIAPGRFGAQLRWNAQQWRASLGATRTMKQDKVAVNETPTDGYTFVDAHLAYHVDRGSTAWEVFLDGNNLTNQDARVHTFFLKDDVMLPGRNASFGVRLFF

SEQ ID NO: 2283 - protein, 366 aa, Shewanella baltica
MKKTLLATAIAGAMAASGAQAATVYNQDGTKLDIYGNVQIGFRNIEAENDNGNIETQNDVFDNGSTIGFAAEHVIYDGLTGYMKIEFDDFKADEMKTAGRDAGDTAYVGLKGNFGDVKLGSYDTLMDDWIQDPITNNEYFDVSDTSGSGSSVVAVGGEVETDQLTYVSPSFNGLELAIGTQYKGDMEEENVTSRGNASVFGGAKYTAGNFSVAATYDNLDNYEVTQTGVDNKQEFGDRYGVTGQYQWNSLRVALKYERFDSDLDNVDSVNFYGLGARYGYGYGDIYGAYQYVDVGGDTFGNVVDDATSGDSPSDTASDRGDDTYNEFIIGGTYNISDAMYTWVEAAFYDREDDEGDGVAAGVTYMF

SEQ ID NO: 2284 - protein, 853 aa, Shewanella baltica
MIKRTKVASAINLAIVASITSGAFVTSSAFAAEEKAKVERIEVTGSRIQRQDMETASPVTVIDAAAIKAEGFTSVDQMLQVQTSMAGAAVGSSTNNGADGVAQVDLRGMGSQRTLVLLNGRRMVNSGSGADSAVDLNSIPVAMIARVEILKDGASAVYGSDAIAGVVNIITKKDFEGFQLDFNGSGTDKGDGESGDVSALYGFNTEGGNYTFGAAYADRRGVIQGDRDWYDPLDNTSSIIPTGALNQKVIDANGNWVNRATGYDYSNDVYFQTPSERRSLFANMTQELGNDVVLTADAIYTNRRSNQQLAAQPAQIKLNVCGDPRVTDPTAGCLNLDQSMVDAGIKADARGQVQYNRRMNDVGPRVYSQDTDTWRLSGGLAGSLDVHTGMNWNVDYTFGKNEAKTGVDNSINATLMAASIYADPYAWFEGSPLTNEMKDVSYDEKSTGGNEQQTLSAGLNGELFDLSAGAVGFAIGAEYRRESGFYNPDPVVVAGDSTAAQQDPTSGNYNVISIFQEVSVPFTEKLTGEFALRLDDYSTFGKATTWKIGLTYVASDELMLRTVAATGFRAPSVAELYGGNSGSFDYLTNPWLPLSEQTGQILVNRTSDQNLKPEESESYTAGLVYSPSYIDGMSLTLDYWRFKVTNAIARADVQVGLDACYKGDAEACSTFNITADGDLFNLTSALTNVGSQDTSGVDFNLAYSFALFGLDWKVSNDTTYLINYEQDGENYTGTIDGNFGAYSRVRNNFSISAGQDDWSVMYFNRYIRSMNDNYTDYDVNDEPFAAVRGVDSILYHNISGTYHVNDSTTVSLGVKNFTDEKPLYVTNGSDAGTVPEVYDTIGRTIYGGVTVKF

SEQ ID NO: 2285 - protein, 722 aa, Shewanella baltica
MQFNLLPLAAAVALALNPLLVLAEEQSPPDLQDQNIEKITVMGKYTVSKTIDTATGLGLSLMETPQSVSILTAERIQDQALNTVVDVVNNAVGLSSSKTDNVRNGFNARGFSVQNYQIDGVPLSWSLGGDAGETVSDVSLYERVEVVRGATGLLTGAGDPSASINLVRKHADSSDLKGYVDVATGSWDKKQITADVSNGLNESGSVRGRMVAKYVNSDSYQELYQDRKTILYGVIDTDITDNTMLRVGGSYNNNNPKGAMWGALQAVYSNGTPTDWDVSATTAADWSRWETTNVNYFANLNHYFNNGWQLVANYNRMEYETTTKMIYMSGLLDKETGAGLSGQRYHSHGESNSDNFDLQLKGDYQLFNLEHEFVVGALYSKQKSYTDTFEPIRDNMSGYDNKPVDNFYEWQNNAFAEPEWSTDANRQLKMDTEQKGFYAATRFTITEALKIIAGGRISSWNREGVSYGTDTNFGDDGVFVPYVGALYDISEQHRAYASYTEIFNPQNVTNAYGEYLDPLKGKAYEIGLKSAYLDDRLHTTVALFKIDQDNLATPDGTVIIDGKPVTNYKAAQGTESTGFELEVVGEFIDGWNITAGYSQFTAEDVEGNRMATTSPRKQFKLFTTYQFVDYVPELTVGGGINWQSDSYSEGGTVKIDQEAYSLVNLMARYNLADNMDLQLNVENLLDEKYYAYMSASSSMSEAYSVYHYGTPRNVTLSFNYRF

SEQ ID NO: 2286 - protein, 908 aa, Shewanella baltica
MMRFKPSLLTLALIAAGASMHSYAADEVATDKTAKDENIEVIQVTGIRRSLQESQSLKMSSSSIVEAISAEDIGKLPDVSIAESLARLPGVSAQRLDGRANVISIRGMGPDFTTATLNGREQASVNDNRSVEFDQYPSELLNRVVVYKTPDASVMAQAIGGTVDMQTISPLAHGEQTIAVSLRGEMNDLGSLNSGSSDTGYRGSISYIDQFADDTIGVAIGYARMMSPNQEERWQAWGYPTNDNGDSVLGGAKPFVRSSELERDGVLAVFEYAPNTTYHSTLDIYYSKFTDDQRLRGIEIPGAWGTNGGVIPTTTDNGLVTEGVIKGAEVVIRNDVNKRDADSLSIGWNNKFNINENWNVEADISMSRANRTDIGMESYSGTGRGTGVGAVDDLGFAYNGKGGYVFDHNLDYSDKNLIKLGDPLGWGSPLGANTQDGFINKPEIEDELKSFRLSAEYVLDGGAVRSVEFGVNRTNRDKTKLDKGYYLTLKGYDGSANYTMAVPDQYLLAPTSLDFFGMGNVLSYDSLAFYNDGNYTETDVADVDLSRATNSWAVQEKVTTGYVMANLESEVFGIPLTGNAGLQAVHTDQSSDGTVATVENGLVVLTPRTAGDSYVEWLPSVNLSFEVADSQVVRLAAARTLTRSRMDKMNANLNYTYSANPSGGMVNWSGNAGNPELRPWLARQYDLSYENYFSDQGYFSVAVFYKDLENFVYDQHTDFDFSTLFPQGPTDNPIGDVTQPQNGEGGYVQGVEASVSVDFGMFADVLSGFGTVISGSYNDSEVKETPTSNPTTLPGLSEKTLNATIYYENSGFEARISSRYRSDFLGEVTKISLQRENVNIKAETVVDAQIGYDFSESGIESLYGLSVQFQVNNLTNEPFTSYTSDDQRLVRDYQNYGRNFMLGANYKF

SEQ ID NO: 2287 - protein, 315 aa, Shewanella baltica
MSRHSTSACLLGFATLCASPLLLAACTTSSGTGNFGSLSSFTVASTAQTITGTTGFKCTGSLLSILSTNTIDATIASTANPLGTTPRLYNAASGTYLPYSICKDNGCGTVYNVGSTVRWSSTTFLGILGLFNATDGSLPLYLRTATGVTLPAGTYTDTIGLNWAWHLCAAGIGPVCVYDDGTASSSVNVTLTVLKDCFIDSAPDLSFGSAALVSAFTAVNQNIGVRCTLNATYTIGFDNGNNFSGGWRRMLSGANAIQYNLYKPGDSTVWTTSNTQAGTGSGAAQNVPYRAIVNPAQGNVPAGTYSDTVRVILTY

SEQ ID NO: 2288 - protein, 680 aa, Shewanella baltica
MHYLRIIIIRRNYPRKNDMSRFIRRTRKTSHTSGATLSPKLSLLSRAIGLSLLLPAAWATAAAPQDATPEMERMVITATQTQHSELSAPASVSVINRSELEALVIDDLASAVRYLQGVNISEGTPYGRNEISLRGLDSDYTLILINGRRVNSREALTSGYGNDFDLSSIPMSAIERIEVVRGPMSSLYGSEALGGVVNVILRQPTDDWQTSVGVQYDTPTSGKGGNSTKYNFYTSGALIKDKLLANLIVDSNQRDAWRSDLKPTIDALEDRDEISALANLQWLIDSQQDLQFDLSYANDERESDWNNYGTILTNNQRAERISSGLTHNGHWNWGDTRLRYYYENVEVTDDSALIAEIGHITQTNHNLDGQTTVLLGDHMLTSGAEYRWTQLENSRNILGDGTLDDSQSALYLQDEFSLGELNITLGGRVDHHDVYGTEFSPRVYLVYNLSSEWVIKGGGGKAFKAPNMSQSQADYIIPACRGACTVAGNPDLQPETSVNYELSTQYQTTDFGGSITYFHNDVENKIITETWDRTPGAVLTYQNVNEAKITGWELQAWYDVTDTVSFSGNYSKTDAEDKQNGAPFTLTPDDSYNLKLQWQALDGLSTFIAYHYTGDQYLRTNVKSTGYGSLDLGANYQINPMFRVKLGVTNLTDAERDQVATDLDYIQKSRSIYAGVTASF

SEQ ID NO: 2289 - protein, 431 aa, Shewanella baltica
MSTYTPCGWRALALTLSTASIQPTMAAPQAEARGFAEEAGAHLMLRNGYVYRDNQDGVRDQSRWAQAFIASFDSGFSRGPVGVGLDAFGLLAVRLDTGKSRDDGDIAYFPTDSDGDTEEDLGELGIAFKLRISNTLLQYGDQLPALPVLSYDSSRLLPQTFRGVLLSSEEIDGLTLHAGRFTAQNDNNHSGRDVPGRELDSIELVGASYAFNERLSVALYFSDIEKVARKRYANIVWQLPLAEENTLEFDFDFYRTRYDRDYTRTGKGEDNSIWSLMGTYRRGPHAFILAWQRSIGGFENLDEDGQPVTHGYDFDFGDGGDANYLANAFYSDFNRKDERSWQIGYELDFADLGMPGLTWRTAYVHGSKIDTGRDGTASEREFYNQIQYVVPEGVAKDLSISLYGSIYRASRDLNQDLNEIWLFVDYPLDYP

SEQ ID NO: 2290 - protein, 749 aa, Shewanella baltica
MELIMKIAKSNKTTFMLNPILIAMLGLSAPLAAQASVHAADKNDNMTVVTANRSTQSISDIAATVLVIDEAQIAEQAKSGIDFKAMLANLIPSLDVGSQSRTNAGQNMRGRKTLVMIDGISLNSSRGISRQFDAINPFNIARIEVISGASAMYGGGSTGGIINIITKKGRDADGVSETWLGAKSGFNSSEDLEWQVAQAVSTSSDKMDARIAVSYVDTGAMYDSNGDMVLQDVTQTSSQFVSQLDIMANMGFNISSTKRLELLAQYYDSGQDSDYGVDYGSGFGYLYDPSKQIGMKKGYVSDQQAESVRGLITLNYSDSHFYNQTLNLQLFYRNEELRYNPFPDPTTQSMGASQQNTQVFGTKIVFTAEPTNNMNLVYGLDADFESFESSQSLYDYNTSAASGGLINNKTDEIGRYPEIQNTSFATFLQGDYAVSPSLILNAGVRYQYTNVDVETFVPAKQQIVISKGYYSSAEAVEGGDKGYSNTLVNAGALYKISKEQQVWLSFAQGFEIPDPAKYYGQGKYSDLVNAGDGLGNTLIKAVSVADNPLDGVKTNALELGWRLNSNDVSAQLVAYYSKSDKQVHYDKTEQTINIIDKDERNYGLEGKLDYFVTSEVSIGTNFNYIISEVKADDKWKDKGISYASPSKASAYVAWQSDLLQARLQTMQMFSYEDDSDKKLNGYNTVDLLTGVRLPVGSLQFGITNLLNTEYNTLWSQRSEEIYSALIPNTSLVRFKGQGRTYSVNYSVEF

SEQ ID NO: 2291 - protein, 223 aa, Shewanella baltica
MKTFLRITAAVAMATACMAATAQSAGTWSVRLGATRIDPQTSSGWLSTPSFPDTRVDVKANSQLTGGVTYMVTNNWAIDVPVGLPFKHDFVGDGAISGTGKLGRTKVLPATVFAQYRFGEANSAFRPYLGLGVTYAKFFGERTTASLNGLTGGTLANPTTASVDSKWGLTPQIGFVYSFNERWFLDVAYYKSFLKTTAHLSSGQSVSLKLNPNVYAIGIGYRF

SEQ ID NO: 2292 - protein, 278 aa, Shewanella baltica
MKNVKTLALAAAAVAVMSAPTFAADRGDDIRAGDYSWMQFNAMYAFDELPSAGESGHDYLEMEFGGRAGVVDLYGYVDVFNLASGDSGDKAEGSGASKMFMKFAPRFSIDAITGMDLSAGPIQEVYISTLFNWGGGVIGEDVNNVAVGIGADVMVPWLGKTGMNLYGFYDINDKDWNGYQFSMNWFKPFYFLENGSFVSFQGYVDYQFGADDTKGDEWVPMTSSGGAAYFGVHWHSDNYALGYGLKGYSDVYLLEDGAGKVGLETTGFAHYLTATYKF

SEQ ID NO: 2293 - protein, 720 aa, Shewanella baltica
MTSFYIPKRAALLLGALFVLNPISMLLAAEDAQSGNAILETDIERLSIHYRQAYRGNVSATELPQAISVLDEQLIKDAGLTRFQDVLDYSASVARQNNGGGLWDSFSLRGFPGNENMPSGYLINGFNGGRGFSGHRDLSNVAYVEILKGPGSALYGRSEPGGTVNIVTKKPQYQTSGYLKASAGSFDQYRLEGDVTSGLTDNVAFRINGAWQEHDSFRDYVFSDKKIVTPSVRWQISDKASLLYEMEYLKQEQLFDRGIIVLNNDINTVPRSRYLGEPNDGATVVNATRHQLTYDYELNDDWSLTAGYNYRDSSLKGYSSDAELAKGRQSLFDDGRTLTRQHRYRDYASEDNSLRLELSGHVDTGFIRHNLLLGADAYHYSLKTGLYRYRGQKGEYAIDIYEPQYGGPQPEVSLLYENNETQKAWGTYLQDQMDLTEKWKLHLGLRFDSYQQDISEVAKNTLSEQTDSRVSPKVGLVYLWSDALSFYSSYSEGFLPLSGTDFAGQPFEAEESKSVELGMKFNGNWLNGLAENGIAVSGSLAVFDAQKSNILTSDPVNVGFSATLGKAKSSGVELDLVAELTENLQAKLSYAYLNTRTANDSLNPDWGVLIPAGSPLVNVPKHTASVMLKRDLNAFSIDGHLGMSWRYVDSRLGDSADPSFQLPSYQLLGVFMNTHLSDNFVLGVTLDNLLDEHYIASSYSALWAVPGEPRSIKVSVSYEF

SEQ ID NO: 2294 - protein, 431 aa, Shewanella baltica
MPRLTLLAAATAVAFTGFANAQDLTPQELQAQLTQLTQEVNQLKQQQAANATVTPSKPSAPAFEIGGRIQLDYNLFNGAYNAEHNGSSAQDIFPRRVRTFVEGELQDWDYKLLLEFAENTAEIVMARMRYSGFENGPKLQFGKLREDISLDALTSSNHIALIERSSLADTMSPYFRWGISAYQYFPSTGLRYALGVYKNDAFGSDGKDETDDLNYALSSRVTWSQAKESGQVLHAGLWYSARQMGGDDLSASFARGELRETNTRLINYVAGGETAAIDRLNQAGLELAFQHKALLLQGEYAQRNLTTQDPQSVLDGERYQAYYLQASYFLTGEQRSYSKGSAVFSQPKGVTEAWELAARFSSVDASSDFQGTKAQGTRAQTYTLGVSYYFNPKIKVMANYIHSSVDGAGTIALVGNEDVGDAFAARLQYVF

SEQ ID NO: 2295 - protein, 354 aa, Shewanella baltica
MKKTLLTTAIISSLTLYSFTALADGPEFYGHADLAITNSDTGYATQNQKDGTVLENNFSWLGVKGSEAVSPYFDIIYQMEFGVENFDNSNKTFNARNTFLGIRSAAGTALVGRNDTVFKAAEGSFDLFGNTNADIDLLVAGQTRSADGISYYSPKIADLVTLNATYLMSDNYDQVDSNGDEVYSKDHMYALSATLGDKAFKAQNYYVAAAYSDGIDNVEAYRGVAQAKFGDVILGALYQHSEHVDDKFANLSGDTYFVNAAYLIGDLKLKMMYGKDNSGLGKYVSRYVGDQDNSGLEQVRDVDLQQFSVGADYRLSTKTMVYGHYTRFDGDLMLADMKQDLNDNIFTVGLRVDF

SEQ ID NO: 2296 - protein, 362 aa, Shewanella baltica
MKKTFISASVASVLALASFGALAEGPSFYGRLDLAVTTTDSSTTLQGSTNKKNPVTYGDSGTYLENNFSWLGVKGSEKVADGVDIVYQMEFGVDNTTNSSDTFNARNTFLGFKTVAGTVLAGRNDTVFKQAEGNVDVFGNTNADIDRLVSAQAGAGRSGDGVWYYSPKIADLVTLNATYLFDDNYGTSDSMYAVSATLGDKAFKEQNYYLAAAYNKAIDGVDAYRGVAQAKLGDFTVGGLFQHAESIKNDNRDGNSYFVNVVYKLQNGVNLKAEYGKDEAGFGSYFKNASGLKDPADANYYMNTNLDDVNVDQITIGADYRLVKSTLLFAHYAHYEGDFTQNGVKKDLIEDDVVSIGVRYDF

SEQ ID NO: 2297 - protein, 730 aa, Shewanella baltica
MKFAKRRNGRVALGAHVLGSLTIGMAISATPAIAADQAQVAGKKVEHIEVNGEYLGYNTRKVQSGKFTDDLLNSAKTVTVINQDLIKDMGAQSFTDALRATPGITLGTGEGGNPYGDRPFIRGYDAQSSTFINGMRDVGSQSRETFNIEQIEVLKGPSSVYNGRGAVGGSINIVTKKAQAEDFINADVAIGTDALKRASLDVNHVIADEAAVRVNLMAHDANTPGRDEVSGNRWGIAPSVTFGLTTPTKVTLEYYHFENNDIPDYGIPYDQATGRPADVDPNNFYGLLSRDFRDNNDDTASVLISHDFSNDMQFTSTSVYSRNTNYYIVTNPDDTTGNVANGYVWRNTKSRHSVTKTLATQLQLAGEAKLAGFTNRFAIGTEFSNERTSNLSYTVDTGNGRNAGCNDALLANYNCTLLSKPNPHDPWVGSVTLGTDATVTETDTRSVYAFNTIELNESWMINGGVRWDDYSTAVQNSTSSLSNDDDFLNYQLSVLYKPAVNGSIYAAWGTSSNPPGTSNGDGSDRLGSNNEDLKPEDTESYELGTKWDFFSGRLSLNGSVFQIEKNNARVATSADRNSPQENVGEQKVKGFEIGFSGDITEHWHGFGGYTYLDASLESNGFNAAYDGNRFPNTAKNSISLFTTYDITEQLNVGTGAYYMGQVYGNTANTLSIPSYWRFDVVSSYKMNDFLTLRLNVQNLTDERYYDKAYTAHFANMAPGRLVMLSADMHF

SEQ ID NO: 2298 - protein, 355 aa, Shewanella baltica
MKQFKLTSAVLVLSFATPIFAVQANDTAATNDELRTELQQIQQRLAMLEAQEKEASVLSDTQFNFYGSLRPTFGLTHTNSDDVWDVGDANSRIGFAAEHQLGNGLVGFAKGEFKVDIKDDGDFGDARKAYVGLKGFFGSVAIGKQAVTQEIISDPVDIFNRSGTPLAYDSASPFRLNNLVTYRKEFGDLLFSADAQFDGNKGSGGSDFVNAGIRYKTDLIYIAAAFYNKELDDGKDENTVGVTLAKSFNALYLAAAYQNIEKDDIDGTTLDGSTLDVVACYPITDSYKIKLGVSRYDDGGNDITSAKYNAYNTTLEWHKTPQFSTFIEYQKTDFEYRETNDQIMLGMRYNFDYTF

SEQ ID NO: 2299 - protein, 974 aa, Shewanella baltica
MKNTHFFKPALLSIAVSTAMYSNVSFAQEAAQAEDVEVISVSGIRGSLIRAQAVKMENTSIVEAISAEDIGKLPDSSIAESLARLPGMSGERVGGRTSGISIRGFKEDFTGTSLNGRELIGIGDNRGVEYDLYPSEIMTGATVYKTTDAALMVQGIGGTVDLQTVRPLQAQETLTVNGVYELAGRDSDNPEFDNKGHRLSLSFVEKFADDTIGLAVALATTESPNNQRKFGVWGYNPPNEDGHILPSGLDTNVQSQVLDRDTVSAVLQFQPNDSLNIVIDALDISFSDSGIIRGFVEPFEATNVTGTGFNTTGTQINANSVLINNPKQKDGDLSVYGLNVEYHVNDNWSVKLDVARSESTKRDLQGESYSGLARNGALDATDPSQFGTREFEMSQDGIYFTGSTGLEAFSDPSALQLTGPQAWGGGLKNLADNFATTELMANGDPYSYVQAQDGFLNYADFEEELTTYKFEVVGLLDGDIFHTVTAGINYSDRYKSKDNKGFFVTASSYPFSDAIPSQYVYNGLADLTWAGLGEVVAYDGFAPYNDGEYQYNDAGLLEPDRLGDTYVVEEEVTTIYAKVDFNTEIADFPVMGNVGLQYVQTDQSSTGYNGIVGANFAVCDDDNDQQIDESCVVSGGDEYSHVLPSLNVSVEVGDNQFVRFAANKAISRARIDQMKASSFVKFDQNITLIAIPNTIEAVNDYGSPWSKFAGNPELRPLESNNFDLSFEHYFEDEGYLSAVLFYKDLVNLTQESSGDSSLINFRNDETNDGADYYIPGFHDRLAVFTGEHDPAGVFYNEGDLITPPDYGTYSFFEDGLKGEVKGIELTGNVPFNIFSDSLDGFGVAASAIFIDAELDDGSPLVGQSDRTYSLTAYYAMDGFEIRVAGTDRSDYSTYQRGGSNKIETAQRNGVTLVDAQISYDFENSDIDYLKGLRVSLQGTNLTDVDEETVDTNGIVTARRQFGPSYMVNVNYAFY

SEQ ID NO: 2300 - protein, 702 aa, Shewanella baltica
MEDVVVIGRRASAAERLNATAGATGLIEADDLPQSANLTISRALAFAPGVVVQDFFGGNDQPRIQIRGSGLQQNPVERGVLMLRNGLPVNRADGSYIVGFANPAEAQSIEIFRGHAANRLGATVLGGALNLISPTGRSAPGLRLKASAGDFGQIGTGASAGYVHDTIDALLRVDHTERDGSRTYNGSSRSAVGANFGVRLSDRVTVRAFASYADLGFDVAGPLTRALLDSGSRSVFTGPTVTPTGAVNPGPNVVRDQPRREATQFHAGVRATGVMDAHLIDVALGYAQTDDMFRFPISAGVRDTRGDDATVVARYAYAPDPARAIPLFEGTLQWVTGTADRDYYLNLSGRRGAQFGRNRLKADTLSLNGGFNLPLGRTLTLSPSAAWSRATRDNQDRYAPSTRPTAAYSPANPGLALPFGAVPTVGSSYERTYEGWSPALGLTWRPDHRQTVFVSANQTFEPPTHDDLFATVNGTPNSSPGRPNPAAPNQAAAVFATPALKAQRATTVEMGWRARAGAWTWDAVAYHAWVRNELLSLRDETGVSLGAVNAPRTRHLGLELGLSLRMTPDLTGRLAYTWQDFRFHDDPLRGDNHLAGTPPHWVQAGLDWRPGPGWLLQGGVRWVPEKTPIDNLNTLYSDPYAVFDLRAEREIRDGLVVFAEGLNLFDETYAASTLVVDQARADQAVFLPGDGRAFGAGVSLKF

SEQ ID NO: 2301 - protein, 250 aa, Shewanella baltica
MKKTCLCLALMLSPQAFAGDLVQWWDFSATALYGEDYDLAPSDKQATITLETAGGWKYGDWFAFQDFIYFKGNDTGMESTTYGEISPRFSASKILGEKIAFGPVIDLSLALTYEEGEGPVHSLLYGLGVDVAVPYFTYLNFNTYRRNSMSTGNNSDGWQFTPVFRIDIPVGSANIVLDGFIDWVFATDDNGYEENFHFNPQLKYDLGKSLFGDHQANKLLVGIEYDLWTNKYGVKGVDQDTYSVIAQYHF

SEQ ID NO: 2302 - protein, 797 aa, Shewanella baltica
MRLGIIALAVSSILAIPAVQAEEQQPGFEKIEIIGSRIALRTATDSVAPVDIITAEQLESTGMTETAKALQFAAPSYSFPFSSVTDGSDAVRPASLRGLSPDHTLVLVNGKRRHGSALVHLSGTVGKGSSNVDLNAIPMTAIKRIEILRDGASAQYGSDAIAGVINVVLKDSDQGGSISAQAGQTYIGDGEQWRVGVNHGISLSDDGFVNVSLEAHHKDSTNRAGLDPRQQYEKLPDGSADPREATFNRKSHQVGDAEYDNLGLFINAAQPITKDGKLYAFGGISQRETKSGAFYRRALDARNLTEIYPDGFLPQINPKIIDASLVLGYELSLGEWNIDTSAGHGENSFNYNIVNTLNASLGPDSPTEFDAGTLTTRETNLNLDASRYFAFANDSEILFATGVSWRQNGYQIEAGETGSYINGGYDNRAAGSQGFTGFTPESQVDETRDNTGVYVEFENQLTNEFYWAAALRYENYSDFGGNTSWKLAGRYDFTDNLALRGTINTGFRAPSVQQLYFSNISTLFNPDPVTGQLVPIESGTFNTLSPVTKALGINELDPELSQSFSLGLVYTNDTGLALTLDAYQISIDDRIILSSSVTPNDSPAVAAALAGTNAESARFFINAVDTRTRGVDLVVSQDFDIGSWGDLRANLAYAYNKTEIQDIHFPQILDGLGKKLFDSIEQTRMTSATPHNTGNLGLTHELGDFKTNIRLSYFGDYTVGYSTGDVNYSDQWVMDLSVRYAATDALSFTAGVQNLFDVYPEKTPAINSNNGIFVYPLTNTPFGFNGGYYFLEAKYTY

SEQ ID NO: 2303 - protein, 384 aa, Shewanella baltica
MNKTCLALALPMLLTATSSQAVELYKDQKNTLDLTGWLGFAALNDSHDTSVIDDSSRLRFSFERSERNGWTAFATTEWGINMVSSDDGLVMQGGKLAAEKTDDFLYNRLGYVGMSHDVWGSLSFGKQWGAYYDVAGTTDLPNVFAGYSVGAYTFGDGGLTGTGRADSAFIYRNSVGPVQIALQYAAKTNGDVSLKNDDGSEMSNSELSFDSSYGASITYSATEKFKLLAGFNRGDFEGHLGNTQVDETNEIIGIGAMYGDYYHYAEGREASGLYVGFNAHQSKSNELVNGDLYDATGAELMTAYQFDNGFVPMVVLSYLDLDTDATTPIQGNWTRQFAMLGLHYRYSNDTVMFAEMKLDFSDMDDTALEAQEDNSFAVGINYFF

SEQ ID NO: 2304 - protein, 3699 aa, Shewanella baltica
MLQHAYKMIHAFKHIMTRFCHSYLKMFIVGSFFAMTSLYASAQNRSFDFTTGDTVTLTNAGSALSNRTTFTLEFWAKFTNVSGTINLVDFTGGADAGGLIFNSSKLTVDLECDFGCLTESNVLSLSTGTWYHIAVVFDNGTWDFYVDGVAQGINVLDQGARSSVPNYTGFGVTNLVFGLQNLGAVDDFVGSIDDIRMWSSARTQVQIQNNRSIELVGNESGLLGYWKLNEASGTTVNDSQTNSSMLTGTSSGIGYNATGAFVTDFVAPTVSSITASTANGTYKVGNVISVQVNFDEAVLVTGTPQLTLETGTTDRTINYASGSNSSTLTFSYTVQSGDTSADLDYVATNSLMLNSGTIRDAASNNATLTLPSPGAANSLGANRNIVIDGVAPTVSSVNASTADGTYKLGDIISIQVNLSEVVSVTGTPQLTLDTGTTDRTIDYASGSGSSTLTFNYTIQSGDTSSDLDYAATNSLALNSGTIRDAATNNATLTLASPGAANSLGNNKALVVDGIVPSVTSTAPAGGAVSTDTSVDFTVNFNESVNNISIDDFALGTTGSATGTIASVSASSGSGVTVTVNGITGNGTIKLNLNASTNISDAAGNAGPAAYTSGSIHTVAIPTAPDAPTIGAATAGIGQASVAFSAPANNGGAAITGYTVTSNPDGISAGGNGFTTSPITVTGLTNGTAYTFTVTATNTIGTSSASGASNSVIPKVNQTITFANPGAQNFGTSPTLTATSDSSLIVSFSSSTPAVCTITSSGTLTFLSTGSCTIDTDQSGNASTNAASTVSQTFMVNAVVPSAPTIGTATAGNAQASVNFTASASNGGAAVTSYTVTSNPSGFTGTGVGSPISVIGLTNGVAYTFTVTATNSAGTGAASAASNSVTPASPQTITFANPGAQNFGTSPTLTATSDSGLTPTFTSSTTGVCTISSGGLLNFVSVGTCTINADQAGDSSYLAATTVSRSFSISAVVPGAPTAASATAGDTQASVTFSAPIFTGGAAITGYTATSNPGGFTGASASSPLTVTGLTNGVAYTFTVTATNSVGTGAASTATSSTTPKAIQTITFADPGAQSFGTAPTLIASASSGLTVTFTSSTTGVCTITAGGALTFGSTGTCTIDANQAGDGSYLAAAQVSRSFTVNAVVPGVPTIGAASAGDSQASVSFTAPIFNGGSSITGYTVTSSPGGFHASGAASPITVTGLANGSPYTFSVVATNAIGSSSASVASNSVTPNGAPVISGTPTLSVNQDVSYQFTPTASDSVGDVLSFSIANKPAWATFNTTTGTLSGTPSNQDVGVTNGIIISVSDGALSASLPAFNLSVVNINDAPTISSTAITAATQDAAYSYNFAAADTDVGDVLTLSAVTKPSWLSFNAATGVLSGTPSNADVGSHAVTLKVTDTDGLTAEQSFSITVTNVNDAPTISSTAITAATQDAAYSYTFAAADTDVGDTLTLSAVTKPSWLSFNAATGLLSGTPSNADVGAHPVTLRVTDTDGLTAEQSFSITVTNVNDAPTISSTAITAATQDAVYSYSFAASDTDVGDVLTLSAVTKPSWLSFNAATGVLSGTPSNADVGAHPVTLRVTDTDGLTADQSFSITVTNVNDAPTISSTAITAATQDAAYSYSFAAADTDVGDTLTLSAVTKPSWLSFNAATGLLSGTPSNADVGSHAVTLKVTDTDGLTAEQSFSITVTNVNDAPTISSTAIITATQDAAYSYTFAAADTDVGDTLTLSAVTKPSWLSFNTTSGVLSGTPGNADVGSHVVLLRVTDTDGLTAEQSFSITVTNVNDAPTISSTAITAATQDAAYSYTFAAADTDVGDALTLSAVTKPSWLSFNAATGLLSGTPGNADVGSHVVLLRVTDTDGLTADQSFSITVTNVNDAPTISSTPITAATQDAAYSYTFAASDTDVGDTLTLSAVTKPSWLSFNTTSGVLSGTPGNADVGSHVVLLRVTDTDGLTADQSFSITVTNVNDAPTISSTAITAATQDAAYSYTFAASDTDVGDTLTLSAVTKPSWLSFNAATGLLSGTPGNADVGAHPVTLRVTDTDGLTADQSFSITVTNVNDAPTISSTAITAATQDAAYSYTFAASDTDVGDVLTFSAVTKPSWLSFNAATGLLSGTPSNADVGAHPVTLRVTDTDGLTAEQSFSITVTNVNDAPTISSTAMTAATQDVAYSYTFAAADTDVGDVLTFSAVTKPSWLSFNAATGLLSGTPSNTDVGAHPVLLRVTDTDGLTADQSFSITVTNVNDAPTISSTAITAATQDAAYSYTFAASDTDVGDTLTLSAVTKPSWLSFNAATGLLSGTPGNADVVAHPVTLRVTDTDGLTADQSFSITVTNVNDAPTISSTAITAATQDAAYSYTFAASDTDVGDVLTLSAVTKPSWLNFNVATGLLSGTPSNADVGSHVVLLRVTDTDGLTAEQSFSITVTNVNDAPTISSTAITAAIQDAAYSYIFAASDTDVGDTLTLSAVTKPSWLSFNAATGLLSGTPSNADVGSHAVTLKVTDTDGLTAEQSFSITVTNVNDAPTISSTAIITATQDAAYSYTFAAADTDVGDTLTLSAVTKPSWLSFNTTSGVLSGTPGNADVGSHVVLLRVTDTDGLTAEQSFSITVTNVNDAPVATSSTVTLEEDGSVTIILTAEDVDNDPLTYEVVSQPDSGTLEQHGTVWLYTPEKDFNGTDVFSFIAKDAELSSEPVTVTINVTPVNDDPQAVDDDYTLTSTANDIYALAVLANDVDVDGDTLTIDGAAADIGSVQITSDGLSFTAPEAYVGPVALRYTISDGNKGRASAKVNVLIEGAESANQPVITLPDDVDVNATGLFTRVKLGFAKAVDRNGHPLPVSLVNKSLFFAPGSYLAYWQAVDRDGNKAIKAQKVKVHPLISLSKDQLVGEGNEVVVSVHLNGVAPVYPLSVPYTVSGSAGSSDHDLVDGVVEVTSGQQAEIRFRTFEDGEVEGDEDVLISLDPSLNLGSKQQTQVLITEANIAPKVTLDVTQAGAHQFIVAQNGGDVRINADISDANMQDSLASTWASGSLNLQSDDAGMFFSPVSVLPGIYPVSVTVTDNGLPALSTTEKVYIVVRSSLPVLTGADTDGDLIPDVQEGFTDTDGDGIPDYLDAVNDCNIMPEGELQPVYFLAEGQAGVCLRLGNIALRQGQTGMQLLPTLVPEDSIAANVGGIFDFIATGLPQQGQSYSLVMPQRSPIPANAVYRKYQAQNGWKDFVIDARNSVASSEGERGFCPPPGDSRWTAGLTEGHWCLQLTLEDGGPNDDDGVANRTIVDPSGVSVILNGNHLPVAHPDTAALFWNQSIDVDVLANDTDSDGDTLTVTQVTSEFGTAVILANQQLSYTPASDFIGTDVLIYSITDGKGGTASSELTVIVSGNTAPTTVNDSAATDDRTSLLLDVLSNDSDPDGNALTLVSATAQQGAVSVESNKLRYIPKAGFDGVDTVSYQISDGLGGEATGQVLITVKAYQEVVIDNKSGGGSLSLWVLGLLITTGLIRRRKLHKVVLGAVLLAGTVSQANAADNWYVEGFVGQAQVDSSRRDLQPQTAAGVVTSVDDKDTAFGLSVGYQWTPMVAIELGYADFGNGSARIEGASLTPAQYHEQVKAVTPVLADGVMLGLRFTLLQHDAWRFEVPIGLFRWQADISSTMGNNRLTTELDGTDWYAGVRFSYQVSDAWSVGLGYQYVDIDPNDFLSYQLNLRYQF

SEQ ID NO: 2305 - protein, 798 aa, Shewanella baltica
MIKSTSQKFLLSTLAVLVSSHLWAAEAPQQEEAKKDALGLERITVTGVARGTRVMDSSVSVSSVSLAELEVSSPRSSAEAFRIIPGMKVESTGGEGNANIAVRGLPVASGGAKFLQIQEDGLPILQFGDIAFGNADIFLRLDSTVQTIESIRGGSASTAASNAPGGIINVISKTGTSDSGSVATTLGLDYDTFRTDFEYGTSINDSLRFHVGGFVRTGEGPRDAGYNANKGGQIKANLTKEFDKGYVRLYFKHLDDKSIGYLPMPMYSDGSSIPGFDAKSDAIQSAYFQSTLSLGADGERRRGDMRDGMNPVVNSVGLEASFDLGNDWQVENRFRFSDVSGNFIAPFPAEVANGSDIATSIAGTGAKLIYANGPNSGSQMDGLAMRINTFDVQMNDFGSIVNDFKLTKTFDDTSVTLGYYNAVQNISMTWMWNSYLMEVKGDNAALLDVVAADGTAYSDNGLYGYGVPYWGNCCQRNYDTDYTIKAPYLALASSFGDLSLDASVRYDSGDASGNYAGSVQSQVDMNLDGVISIPEQSVSSIDNANPQPVNYDWSYTSYSLGANYQFASDLAAFARLSHGGRANADRLLFGKVRADGSVAKEDAVDIVDQYELGVKYRYDDLSVFATAFYSETEEQNFEATSQRFFDRKYKAKGIEIESAYFIGDFDFRGNLTWTDAEIAKDALTPEVVGNTPRRQADFIYSLMGRYNFDQGSVGVNLIGTTDSYAQDNNDLSFDGYNQVNAFATYNLTEAMSVSLNVNNLFNVTGITEAEEGSIPDNNIIRARTINGRTTSATLKYEF

SEQ ID NO: 2306 - protein, 706 aa, Shewanella baltica
MVFKYSVLGLAVGSALMAMPVLAEVASDANIERINVTGRTFNDYKVGTASGAMRGDIDLMDTPQSVNVIPDFVTDEQLATNLAEVLVNDSSVTAGTTRWNRQVFSIRGFELDSGNGYLINGHQQWSHYVQPIETLQQVEVLKGPSSMLYGQSGPGGLVNMVTKKPTYDSMLNLGIDTDGYGSTRAQLDAGGSLNEAQSIRYRGVLVKQDTKYWREYSANDENQERDRWLGYLNMEFDLSDDLLLSVKYDHTQDKAGIDAGGWLDKQGNVIGERKTVWDAPWAFTDNTVSNLGADLTWHMSDNWKVKAGYNDQQFNRQRFDSAPSLIEGSEDPFKDGYKIKPFDRYDDWQHKTAYADFTGEFALAGMQHQLLIGANYLDYFYQQQIHRGAAQTVIPGQPITQPALDYHTKPKGNASTYKYYGFYLQDLMTLNEQWKLLAGVRYDEQKKDAIGGNSYAVSPKFGVIYSPMANGSIYINYSKSFTPQGSVTSSEDVNEGDNLKPEYGTQYELGTKWELFDDSLLLTAALFDITVSNVTIEQDIPETSDGKKTITTQGGEQHHRGFEVGAQGQLGESWFVTSSMMYLDAEYKTGAGKIDGKILDGKTPIDAPEWSANIWTRYEVTDNFAMNFGAIYVGERFADTNNTISKDGYVRFDIGAAYTMDIMGKDVSLRANVRNLFDTEYLDGGSDKMVTIGQGRNFSVAVEAKF

SEQ ID NO: 2307 - protein, 992 aa, Shewanella baltica
MKKYLLIRMMQTVAIILFAANVSAQNQNVVISVRNIPVRTTLTQIRQAANVHFVYEEKNINSQQTVTLNYPQGTSLSTLLNNLCKQIGLTYEINESVILLYPAQKQTTTHDIHILLLERGNKQPLPMATCVLNPLGAYAATDMEGKAVLKNVPTGKYILNISYVGFETVQREINVEQNLDLTIRMSPTSLALKEVVVVAKQNAAGESTSSIIGRQAIDHLQAMSLDDVMQLIPGHLMKNTDLTSRSNVQLRTLVNNNTNAFGSSIIMDGVPMSNNGTLSQGGFSSTAFVGTDLRQISADDIESVEIIRGIPSAEYGDLTSGLVVVHSKIGQTPWQIKGKINPGTMNYSLGKGLRLNKDAGILNFNLDYAQAWGDPRQKTKSFDRYTFSLGYSKDFSRIWHTDTKVRYMMGKDWNGKDPDAIDDGTFQKNRNQLFSLSHNGKLSINKPFSRTVNYTLGVSYTQTEMEKSAIVANSSGLLPILTATETGYYNVPFEQSSYQASGGSLSRPGNVYAKVSNTFFVKSKKTYQNFKMGVEYHYDWNNARGYYNDDDRYPLQPNSNGRPRPFSDIPSIHQMAAYIEDNFRWDISENRFLKIQLGGRFTTLQPWADEATFSFSPRVNASFSVNKWLNIRGGFGLNSKTPGLDYLYPDKKYIDRVAANYMPQDDKVGQILMYHTQVYNVQRTKGLKNATNRKWEAGFDIKLSDKHKLSLIGYHDKTANGFGSATEYFTYTANYYSAEKGLIITPGQATKIDWDNPERTDLVLSTTGKIGNTNVSINKGIEMDFDFGEIPALHTSFYLSGAYMESKTYSTDINSSNPTDLPTEYQVTNTIPFKIVYPSGLNYSTYRRFTNTLRIVTNIPALRMVASFSTQAIWYNYSKSNNPPMDPIGWIDTDLSYHEITADMLADENYKIKGVSLKSQRKNPKDNVPSKAPITWLMAGRLTKELGNIGGISFYANNILFYEPFLKNSTSNTLVQRNTGNFSFGVELFFNL

SEQ ID NO: 2308 - protein, 390 aa, Francisella philomiragia
MKLKNIVIATSVLFGTATFSFAAGSDNMDMSADTNTPVTQSSSSNSFIAPFANTYSSLTNKNNTWGPQDRTGQWYFGVDANGLAGTPNSPSGAGANMTIGYNVNKYFAVQYNQLVGRVFAGLGEGVINFSNSTMITPYAAGGAGWANLAGQATGAWDVGGGLKFELSRDVQVSADYRYIQTMAPRGMSGAQGRAGTNMIGGGITWFFGGKDDTTNDTGNIQDNGATTAAETTAMPTIDETKYVLPQGIKQCEGNFNLTKEGVACYTVNGDDVTVYLDTKFAYDSANLNSKGKEAIASFVNFVKNSDIKTVTVKGYASQGATGSEFEIYNQKLSERRAEAVADYMNQLGLDNDKIITKGFGYENTLDGIHKSDARNQRVQASVSAPLKEEA

SEQ ID NO: 2309 - protein, 331 aa, Vibrio cholerae V51
MKKAAIAVAVLSAVVSGSTLAATVYDAEGTSLKVGGRLEFRGDFNGDDKGKEIEGTMLNKSRVRLNVAGETDIGAGMKGFGFWEAEQGVKSSAGTSTEQETTFKQRYIYVGMKGDFGSLSFGRQNTAGVQISDMSDIATFTGDQKAFISAGNEQINNTIAYGYDFESFKLKASYIADDEKNADGYGLSGIYSAPFGLDIGLGYAANDLGTDKGSADQIIAGLGYTMGDLYFGATYTTGDKNDKADTEFTGIEVSAQYKITKEFRLIAAYQNQEEETKNVTKDTADFFELTGRYDFTKNFRSYLAYKANGLDDKDAGYKVEDTIRLGLRYDF

SEQ ID NO: 2310 - protein, 217 aa, Vibrio cholerae V51
MKQTICGLAVLAALSSAPVFAHQEGDFIVRAGIASVVPNDSSDKVLNTQSELAVNSNTQLGLTLGYMFTDNISFEVLAATPFSHKISTSGGELGSLGDIGETKHLPPTFMVQYYFGEANSTFRPYVGAGLNYTTFFDESFNSTGTNNALSDLKLDDSWGLAANVGFDYMLNDSWFLNASVWYANIETTATYKAGADAKSTDVEINPWVFMIAGGYKF

SEQ ID NO: 2311 - protein, 412 aa, Vibrio cholerae V51
MLYKSSLAVAISALIAGQVSAAGFQVAEHSASGLGRAFSGEAAVADNASVLARNPAAMMLFETAQFSGALSIVDPEVNVDDLSNNQSMKDVAPLQIVPAAYYIRPINDQWAWGLAMFTTYGVATDYPNEIYAGDLAGDTSLISVNLNPNIAYRVNPELSLGFGLDLVAAKAKLTRHKGGLAPFMGGGNPSDNLIGMTGETLALGWNIGALYELDEQNRIGFGYRSRVKLNFDDGEFSSYDSGIATSAVVPGQLKIELPAIWELSGFHQLNEQWAVHYSYQQTDWSSFEELTATSSQCKNGTCFQKIEQYQDNGRWSVGATYTLNTTWTLRAGLAFDEQAGKATLSIPDSDRFWYSAGLTYTLTPQLTMDAGFALVQSRKGSFTEKNQIGQNLQFESEAVAYISALQFNYRFH

SEQ ID NO: 2312 - protein, 784 aa, Vibrio cholerae V51
MFVGARSLKSLLQIVDNSYQLHQYSCFIFDKDQIMQLKPLFTLLPVVLSSVVQAQENNEQAVDETVTVHGQSIPSDQRTRSDLDKVRGIANADIFSGITSVQSNNMHNEAGALDIGIRGVQGEGRVPIFIDGSLQSTHTSRGYQGVSDRTYIDTDLLSSLTVNKGATIESSPYASGAVGGVVNATTLGIKDIIKDDQAFGVVLKARANNHNRTPDVSSDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASDSLLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 2313 - protein, 680 aa, Vibrio cholerae V51
MSHFTRSRTWVSLAVFAACAPAHAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVSSDATHKVRSYGIYVQDQLQWGDWIVLAGLRHDDFTVTTHRHDTYKEETISSNSLSPRLGVVWTPVQEHALYASYSQTYSPVGGGVIGITPGDKHNHLDPEHSRLYETGVKSDWLEGRISTTLSVYRLEMYNRRMRDPNDQERIILTGLQRTDGIELSSRALLTDEFSLRGGIGLQDAKYVEADASEQGKRPTNVSRLNGELFVAYQSASDGWFGETGFVAVGDRYADRTNTTKLPGYARFDARLGYQWQAWRTQLSVENLLDKDYYLSATSSTQIQPGAPREFYLTASYQF

SEQ ID NO: 2314 - protein, 687 aa, Vibrio cholerae V51
MAALCPARVSVAENKKFKLHTLSAVMMGLFTGSFAYAETQNTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNALIGARYYQSSQDDMYIDAASAYPIDGRTKAKSVFAEVTYALTPSINVNLAGRFEREQVKRNVSHPRYKLDYDETSSVFLPKLDVAYTPVQGQTYGIKAAKGYNAGGAGLAFNSMQFTGFRPYEFEQESIWNYEFYTRHRFSHSVEVLTNLFYNDFDSMQMTQTTSSGDVFIANLDEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDKTTLYLSTNTTLDQLKQQPRMIGASVQLNF

SEQ ID NO: 2315 - protein, 746 aa, Vibrio cholerae V51
MRPPMPAKTLPLATLSAALLCALTMTPAAARAADLADANADADANAKTLDAVSVNGTVSRAQPATTTRLPLTLQETPQSVSVIGLQRLEDESLFSIDDVMRNVTGVNVSFYDTQRPLYFARGFQITDFQVDGLPTYSGATNQEYDTVFYDRIEVIRGANGLLTGAGIPSATVNLLRKRPGKEFDASFAVSAGTWDFRRMQADVNAPLTSDGRWRSRVVAAWQDRDYYYDRYHDTKMSGMAVLEGDLTESTTLTVGYQRQDNTPVGSTWGTVPFFAADGTLANLSRSTNLAPEWTRWQRETSTAFANLEQRIGEDWLLRVNAAHTKGNVQSLRVYGTGYPAADGSGMFLRTGVGETEDTRDSVDVYLSGGFSLFGRQHDVVVGGSWQDLQSTSYGLAQTYPDDWATCPNAFGPPERCYFIPNIRNWDGNASEVTYARNGRRSEGRTTQRGVYASTRFRLADPLSLIAGARLSSWETRTQAFDASGAYTGTSGRYEVSDEVTPYVGLVYDIVPDVSVYASYTEIFNPQNYRDKDNNLLAPVEGSNLEAGIKAQLLDGHAMATAAVFEAKQDNFAVRDMTQPESSLPDGNSAYIGINGTKSRGWEMDINGEILPGWTVNAGFTHVKVTRPPTDAIYANLPEDYLQLSTQLRLPGAWERLSIGGGVSWQSAVRGFNIARPTGDGSGATTPVTVVQNPYALVHFNANYRISEQWTATLAVRNAFDKTYWANLDYQNYGEPRFVSVSLRWRY

SEQ ID NO: 2316 - protein, 370 aa, Vibrio cholerae V51
  misc_feature (115)..(115): Xaa can be any naturally occurring amino acid
MDKMFKRTLLGAAVAMAAVGVQAAQLTDNVQLYGQAAGNLYFESKGDSAKDDTVGVEIESRIGLRGTQSFNNFGPDFVWQIETSNAYNGDTGGQFGGRDTYLGLAFDGVGTVKVXRQLVSIYDYVDWPHSNPGLGNVFDWHNAIGAGYQDRADHVIRFDSSDYSGFKYSLSASKMNESTDNAVVSFALAYNAERFGLHGGAYLGSKEEKKTAAKKAYYEFNTETGLAELKPATAAKIDEAQAAYYLVGGNVSITDKLSLTAAWKHMTNEVNNVERKQDAYSATLAYWATSEWLFKAGYAATTKAKFGGETQAETDSQAITARALYVLDPSAVLYFDIRNYDMMTPTEGDDKGKADANDQTRFLLGVEYYF

SEQ ID NO: 2317 - protein, 652 aa, Vibrio cholerae V51
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDEIEHGYGDKSLRSLTSKLNYQLNPDHQLQLEAGVSAQDRENNVGKSAQSSGCRGTCSNTDNQYRRNHVAVSHQGDWQDVGQSDTYLQYEENTNKSREMSIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSGGGNIYGNPDLKPETSINKELSLMYSTGSGLAASLTAFHNDFKDKITRVACPANICTAGPNQWGAAPTYRVNIDEAETYGAEATLSLPITESVELSSSYTYTHSEQKSGNFAGRPLLQLPKHLFNANLSWQTTDRLNSWANLNYRGKEMQPEGGASNDDFIAPSYTFIDTGVTYALTDTATIKAAVYNLFDQEVNYAEYGYVEDGRRYWLGLDIAF

SEQ ID NO: 2318 - protein, 718 aa, Vibrio cholerae V51
MRKINTNKNDSQIHSRGFIMRNIRPSQLGQFIRRALRLHFIPVVLVAAPSAMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPPGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPIYGNFTPIDESSAADRTITKEQASLYAQYQIKLDQQWIGLIGGRMDWVDTENESQKNAQRKSRSDAEFSFNAGLMYLASNGVSPYLSYSQSFDVLSTIDSATGELYKPLKGEQTEVGVKYQPEFYDGYINLAWFDITQQNALVTNPTTFVATQTGEMTAQGIEVESVGYVTDSLKLTASYTFTDAKTDETGGKGTQQAGLIPKHQASAWLDYDAAQLGLQGWTFGSGVRYIGESKDNPRSSDRTVPSVTLVDLMAGYEITENWQAQLNINNLFDREFVSGCDYWCYYGQSRSAVLSANYRW

SEQ ID NO: 2319 - protein, 428 aa, Vibrio cholerae V51
MNNMRLFKKSLLAVTVTLATQQAFAAGFQLNAQSATGLGRAFAGDAVIADNAAVMSRNPAAMALFDEMALSLGFETITTMIDVKDVSYRGVLGNSVSVQDTDDVGGTSVAPNIHLIVPVNEQFAWGVNAYSNFGTKTEFSDSYPASEYGGLTDVKSFNLGLAGSYRVNKEWSFGAGLDLIYGQGTMKRIAGTSFPASTIVVNPTTVIPARGTSLLNVDKADGWAVGFNLGTVYEMDENNRFGLSYRYSPEFKAKDDYGQEITLPLPDIAEFSGFHKIENTQFAVHYSVQWIGWSAFDKIEFRNLVTSRSSVGALTKGSYDKMYEWQDGWHYSIGGTYYLNSDWTLRAGYMYDTSAQDSRTSISVPDSDRQWLSAGFTYNIDDKSNVDFGFTYLMGKDVAVSENDAGSKLTATTHADAILLGLQYSRTF

SEQ ID NO: 2320 - protein, 432 aa, Vibrio cholerae V51
MKTNKTLLSCAVAFGLASVSTFTQAAGFQLAEYSATGLGRAYAGEAAMADNASAQWRNPAMLTYLEGTQVSAGAIYVNPNVDVEGTVNHAQLGKTHASSNDFAHDAVIPNFYLSHQLNEQMALGFALGTNYGMETDLGTEFAASHFGNQASVISKEANLNIAYQILPQLSIGGGVRYVMGEGHFGATAPAKNLIRHPVTNNVMTLPKGTTLKYMEGEDNSWGWQVGSAWQINQDHRVGFAYKSEVVMDFEGHAEGVSYGSYKPGMMSVTLPATAELASFHQLNDQWAIHASINWTDWSSFKELTAVFPEKSDLIKSENWEDNYRFALGTTYQYDAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 2321 - protein, 155 aa, Vibrio cholerae V51
MQVVCLTLVIILYLLNLLREYYYFSYTPSHTENGAIAKDIDSMKNNSVSIEVGAEFRKYMNENSYIFVTPKIEQFVINSGDDYTANLAVNNAFFTSVEANNKKKTYGQIIVGGNVDFTNQLSMNLGFGAKQILAGKVDNKNETYLSGQVGLKYKF

SEQ ID NO: 2322 - protein, 644 aa, Vibrio cholerae V51
MKLSPVSAAVLSVLAAGFAHAETEPSHYEEVVVTANRIEQPLSEVAGSVAVLEGETLEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFTHHYWLNDALRLKTHLEYFDDYAKRREGTSSIQKDDKWDLVSFYEYQRSQTRLASVGADYTANLSWMDTLEGKFYWRSTENITQTNRLMANDRSGAGILSYRRELRDEGFNDEALGATLNAQKEWQQGERLHQFAYGMSVDGHDYQRPKSIRRMESSGDDLQADEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFLIKPNNKLRAETSDSFELGSKYDNGQTQFYVAVFYSIFDNFIDVKQVGYDNATGSVIQQYQNIAGVKTYGAEMSVMHRLDDRWSVENKLGYVDGKDGENQYVRTLTPLERECAAQLPTRALGRLQPPELGECHEPGADLHHRARQRS

SEQ ID NO: 2323 - protein, 763 aa, Leptospirillum rubarum
MPPAQGWRSALFMPARCCVPSPTTPMANLHRSDSPAFCLSSAAAAVAAALGVLASPVHAQTANAAATEAALDSVTVTGNWLDGDMSSAEKVLEHPGARTIVERERIQESGAATLREALRLVPGVQVQDSNGTGGSDISLNLSVRGLTARLSPRSYVLQDGVPVSYAPYGQPQLSLAPLALGNLDSIDVVRGAGSVRYGPQNVGGIINFTTRAIPKTFAAEASIGTEIYSHGGNVKSTPSFFVGGTNESGLGLAVLYSGTHGKGWRSSNDKTDIDDLLVKGSYKLGNNSSISASLHHFEGKGQMPGGLTTAQYAADPFQSTRNYDQFTGRRTDGSLKYSYKDGRNNFEVLSYYVDSFRGSYIERDATGANAGKRSLTAAPRDYSYYGVEPRYSRIFETGSVVQEVSVGYRYLKEKSSETALATSGLYVPGQADAMALPLNTTQTSQGGTTANAFYIDNRIDVGNWTITPGVRYERIRSFNNVVDYKGATAAAIYPTAAANELLPTLSVLYRVDSHWSVFANAGKSFGPQQYAQLAQSSNNQLYPESAKTYELGTHYKSDTWNGELTLFNIDFNKELFLDRPGDGTGNGIWTDLGATRHRGLESALRYDFGKNYPALKGLSLGMSYTFTQATSQAGPFAGRDLPLYSRHTAGLSARYAMERWTFNADLNAQSKQRSPGTPGTSAKPNSYITQEDANGNLGDIPGFAILGLRTSYQAGKELNNLRLTVGMKNVFDRRYFTRSTDNNGGGKYVGMPRTLYVQATLPF

SEQ ID NO: 2324 - protein, 974 aa, Leptospirillum rubarum
MFLKPQRVAWTMMASATLSLATQTGWAADATPGTPGPASQPASQSMQAPAVLYGTIRSQKDRKPLANVPILLQNQDTKATVQKTSDGQGSFIFSDLPAGDYVIEVGGGNFSLQHKEGLLKPGTVGQLDFAVNPLSTGSSELVGRTYEGHGDHKIPVAAKLAVKNTKTGEIYSLTSDSQGAFDLKNIPSGDYLVQAIKRGYVPYSAQVAVNGKVQSDIRLHINRTAQANINANENKKIKDTTGAITVVDHKTFETWQTTGIGFALSNQPGINYYSRSGANGVTGGMNYFTCRGYSTGGSNTAPSGGANIEFTVEGVPFNENQDGGMVYDLNLFNIDIASVDIQRGVTTSANLYNYASGCTVNIHLMQPTQDPYSQITYGMGSYGQYYTSFISNTGINDKLGIGAYNDLSIINQQGFQDFTSLQEYQDYANVSKYLENGKVSLMFTGAYKNYDRGASTSLQNFQQFGPSYNGMPNGENASFPSGQYAPDSPYYKEWISQRYMITLQGEDQLNSTVSVKNNAFAYLVPYGVIQVPTGILGSPVAGASGTAFQNISPDYGGICSGTSPTTACANPFNFTYIQGQGFKVGDIAETAIQTFNGNKVHLGMRLSYNNTLYGNEPIGTPNITGNAGGSNMLTTIGGYLEDHYRPDDDWLVSAGFRVMAINEQYSNSLMSGAQTITNGANGGNAVYQANAGEAYVVPLPHVGVNWYPSKHWKVYANAGQSFSAPSIQFFELSPGAGTINVKPEIVNDLEVGARYSTDKGFVAFDVYNDYINNMFTTSLQTLPSGVTNVLPDSAGLAEMRGFEAEFKRELPAGFSIDGSFSTVDAYFVSAQYNAGTNQVFSNSGDSIPFVPNILGNLDLNYARGNWHFTINERYTGMMNVINTSGGPLCGGGSPVCSNIQENSPGYWATNILVAYDLPKTSWYKKAQLFFNAFNLLNTNYYEPAGLVNGANNANVLMVYPGEPINVFGGITTTF

SEQ ID NO: 2325 - protein, 559 aa, Francisella philomiragia
MKLKNAFLPAMGNALGDVVRARAPPFWDNTPTDESRRALQNSAREVNSLLEQQSLQRLEKQRQARPSAAAPAQLREDTSCLPIDGVYLTGITLLSLRDLRALDPLPTHCIRSRDVNHLAKQLTALYLEKGYITARVQFLRPNARGELGVRVTERFIERIEGGDRGVNRRWLFPGAVGKPLRLASLDQGLDQANRLRSNHVSMDILPGERVGGSVIRLYNRRERPWQVSGSLDNYGQQSTGEWVARGSATLDSPLGLSDFVSLSASTTLAQPSARYSRAYMLFYSLPYGDLTFSGFASFSDYQMHQSLPHIRILLDGQASQYGLRGDAVLQRSQRQINTLGVQLTYKRIRSYLQDDLLRVSSPTLSVAELGLSHLHILSGGVATGNLSVERGLSILGADRGRQRTGAEAQYTKLKLSAGVSQRVTLADDVYLFNAQWYGQYSRDPLPGVEWVSLTERTAVRGFKRGTLSADNGWYWQNTLSRPLRWRAFTVTPRIGLDVGRVLSNAGDQGWQSGVGAVAGVTLSSASAQLDIEVGRARAISNNNFPSQSTQLLTRFSYSF

SEQ ID NO: 2326 - protein, 1021 aa, Pasteurella haemolytica
MRKILSISFTLALMLCAVALAQGQSRILKGVVTAEGLPMPGVTILDKSTQTGTTTNVDGEYSISVGPNSVLVFSFIGYASQEFPVGNRTELNVNLVEDASELSEVVVTALGISKEKETLGYSLTEVDSESLTKARETNVANSLAGRVAGLVVKGTSSGPGGTSKVLLRGTPSINGSGSPLYVINGVPMDNTQRGGAGQWGGSDNGDGIGNLSPDDIETMTVLKGQAASALYGTRASNGVILITTKSGSKGGDWSASYNLNYMVENPVDFTDFQNEYGQGTGGQRPTTATDAQTTGRLAWGEPMGGNVIGFDGNQYPYSPTNDGYLEFYRTGSNFTNTVSVSKGLGSDGSFRMSVSNLNSKSIVPNSDMDRLSLNLNVDQNITDKLNVTAMVNYIDQKSDNIPNLSDGPKNPNNFLFLAPNVSQSIFAPGYNTDTGAETVFSDDIYVTNPYFIVNQGINDLGRKRTISALSTKYSFTDNIYAMVRIGNDVSNDDFFSIDPYGLAYSANLQGNLNSRGQSTRSELNIDGIFGAKVDLTEGLVMDALVGGNIRKNKFESVSVGGSRFVLPYLYSPFNVEAFSRGYSFSELEVHSGFYSLDFGIKDFLTLSTTGRYDVYSTLTSPVSDDNSIFSPSVSAAFLFDKFLNIPSMDFGKLRLSYAVTSGDPGVAYSNQFYYSSANSFAGVPAGSAPTSLPNLFLKPYTTDEFEIGLDMNFFNNRLGFDLAYYTKTTNNEIMNASLSIASGFNSAVVATGSIENKGLEVLVTGKPIQTNNFTWSTSFNLTKVQNKVLSTDENNNPINLGQNRATLGNAVTAFVVGEAGPQIRAYDYAYNSDGSIMVDEAGLPVRGELINMGTVIPTLYGGWNNEFNYKGISFSFLIDYNYGNKVLSATEFYSTFRGLNQVTLEGRESGVTNGGVTAPAEDYYKALAQNVTSTSVVDGDFIKLRQLTLGYSLPASLFGNTPVIKGLDISFVARNLGYLMRKAKNIDPEASFGSNINYAGIEGTALPSTRSFGFNLNFKLN

SEQ ID NO: 2327 - protein, 197 aa, Wolbachia endosymbiont of Ixodus ricinus
GPISDEETSYYVRLQYNGEFLPLFTKVDGITNATGKEKDSPLKASFIAGGGAFGYKMDDIRVDVEGLYSWLNKDADVVGDTVADNLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 2328 - protein, 197 aa, Wolbachia endosymbiont of Ixodus ricinus
GPISDEETSYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDKSGGEKDKGGYTVLYSTVGAEAGVAFNF

SEQ ID NO: 2329 - protein, 203 aa, Wolbachia endosymbiont of Ixodus ricinus
GPISDEETSYYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVNAGVSYDVTPEVKLYAGARYFGSFGAHFDKDTAAASKDKGELKVLYSTVGAEAGVAFNF

SEQ ID NO: 2330 - protein, 209 aa, Wolbachia endosymbiont of Ixodus ricinus
GPISDEETSYYVRLQYNGEILPLFTKIEGIEYKKATDIHNPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEIKLYAGARYFGSYGANFDGKKTDPKDSTKQVTDAGAYKVLYSTVGAEAGVAFNF

SEQ ID NO: 2331 - protein, 385 aa, Chlamydophila abortus
TVSGVILDKEFNNEPLPFANVLIKGTTIGTSTDDLGKYSLSVKPGSYVLEIGYLGYETKEIPFTIKAGEKKVINHTLEASGVQLADVVVTHTVTKESETALLQEQQKAVEIKQAIGAEEISKKGISDVAAAVAKTTGISKQEGSGSIYVRGLGDSSSDYNFDLKWEYFPKNGEVISVTGFGKYILNPINEATVASATNDISWVNSGEKAIGIGAEFELRKNIINIENSTNEQKTNLSGGLNISYLHTNQDLDTEKVLKETERAITVAFTNTESRLTGASDLLINADLSFNKDFSEEKSLTATLAGTYFSDRIYALGVTGKGDLVDSDVIALDFVLKYKFNKNLGIGFSAKNITDPTIERKQDIQNVIVDSYKKGRNFSISLKYTF

SEQ ID NO: 2332 - protein, 120 aa, Wolbachia endosymbiont of Bemisia tabaci
GPISDEETSYYVRLQYNGEILPFYTKVDGITNATGKEKDSPLTRSFIAGGGAFGYKMDDIRVDVEGLYSQLAKDTAVVNTSETNVADSLTAFSGLANVYYDIAIEDMPITPYVGVGVGAA

SEQ ID NO: 2333 - protein, 199 aa, Wolbachia endosymbiont of Bemisia tabaci
GPISDEVTSYYVRLQYNGEILPFYTKVDGITNAKDKEKDSPLTRSFIAGGGAFGYKMDDIRVDVEGLYSQLAKDKAVVDTSETNVADSLAAFSGLVNVYYDIAIEDMPITPYVGVGVGAAYISNPSKADAVKDQKGFGFAYQAKVGASYDVTPEIKLFAGARYFGSYGASFDKAAKDDTGIKNVVYSTVGAEAGVAFNF

SEQ ID NO: 2334 - protein, 395 aa, Wolbachia endosymbiont of Bemisia tabaci
CGLTNSPLQGTGTLYFTGSNSYSGNTIIENGTLVIGNELTQSAVEIQSQGTLLTKNLVNTEKEVKIVKNVDNKGSLEVYGKGLIIEGNYTTSNNARTVIDIDKSKLTVKGNVNLQSSYIVADVENINEVVPREPQTKTIIESQNPIQNYNGDYKISDRATPYIDLKEIKLNNENKEIIATYKRNDTEFVLNAANESSLKNVYTARSLDLILDRASDSGNTNGNLRSAALSFINAKPQAVASAVDSLSGEIYPAVHQVALNSIKTLNRQIAKQQFLNIQDIKPYHIYTQLATQNLKLYQNDNFGFANLKNSADSQLVGIDKQFNAFTFGMGLQRVHQKLSPLSSQNQQVGKVDLKQHSFALYGKYDWNKWYYLNQISFTDIKGKLDRTRANSRPLN

SEQ ID NO: 2335 - protein, 199 aa, Wolbachia endosymbiont of Bemisia tabaci
GPISDEETSYYVRLQYNGEILPFYTKVDGITNATGKEKDSPLPKSFIAGGGAFGYKMDDIRVDVEGLYSQLAKDTSVVNASETNVADSSTAFSGLVNVYYDIAIEDMPITPYVGVGVGAAYISNPSKANKVKDQKGFGFAYQAKAGVSYDVTPEIKLFAGARYFGSYGASFDKEAKDDTGIKNVVYSTVGAEAGVAFNF

SEQ ID NO: 2336 - protein, 428 aa, Vibrio cholerae NCTC 8457
MNNMRLFKKSLLAVTVTLATQQAFAAGFQLNAQSATGLGRAFAGDAVIADNAAVMSRNPAAMALFDEMALSLGFETITTMIDVKDVSYRGVLGNSVSVQDTDDVGGTSVAPNIHLIVPVNEQFAWGVNAYSNFGTKTEFSDSYPASEYGGLTDVKSFNLGLAGSYRVNKEWSFGAGLDLIYGQGTMKRIAGTSFPASTIVVNPTTVIPARSTSLLNVDKADGWAVGFNLGTVYEMDENNRFGLSYRYSPEFKAKDDYGQEITLPLPDIAEFSGFHKIENTQFAVHYSVQWIGWSAFDKIEFRNLVTSRSSVGALTKGSYDKMYEWQDGWHYSIGGTYYLNSDWTLRAGYMYDTSAQDSRTSISVPDSDRQWLSAGFTYNIDDKSNVDFGFTYLMGKDVAVSENDAGSKLTATTHADAILLGLQYSRTF

SEQ ID NO: 2337 - protein, 592 aa, Vibrio cholerae NCTC 8457
MQKSALAIALASLLTPISYLHANEAQPQETVVVTANRFEQKASSTLADVEIITRQDIEQTQAKTLPELLRRLTGVQITQNGGRGQLASLFVRGTSSDQVLVLVDGIRFARAAKGAVDFNQIPLTYVDRIEYVRGARASLYGSEAIGGVINIITKARSQQQGTTVSAGLGSLDYQELSIASGVAIGEKGQMNVALGTESDKGYNVRPVPGVNDGDRHGFRSDNALLGYVHQFDESWSLFANARAYENIYQYDNSYGTRDYKEAEKDDLSFTIGTQYQSERWVSELQLTTQKQKSWDYTQSKGKYSDTSDNLEQRNIQWINRYLVNDVWTFAGGVDWRDESYIDKTADKEFDRSNTAAFAVVAAEWQQWLLEASLRFDDNQEYGSQTTHNIALGYQFIPEFGVKASYGSAFKAPNLYQQYDPSYGNVNLQPEDADSAELSFYGLFSGIKWSITGYDYKINNLIDYNSTTKNYQNVIGESNIKGVEFTAEFATGIVQHQLSVDLKDADDSKGKTLQRRAEHMYKWNALVAFEQVDWSIGYQYVGKRPDLDYNTYPTQNITLDAYSLVDTSVSYYVTDSTTISARIDNLLDKEYEP

SEQ ID NO: 2338 - protein, 380 aa, Vibrio cholerae NCTC 8457
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDNQQGSLTVYGQLSETVDAMVYGQGISRDNFEDGAGKETFGVKGDTYNVLAKVGFEPAVGHRFQVSYDVYRDQGDYSPRPDMAGSANLGLSKNRLVPTHYDRDTITGSYELKQDKHRGKVTLYSSQTEIDRDESVMAGVWPGNRLSRNTATNRNVGINALFQSDYELAAHRNQVSYGMDYVDQTSKATYGSTPFMEESAVSTAVFAENKLY

SEQ ID NO: 2339 - protein, 185 aa, Vibrio cholerae NCTC 8457
FMRAGPATVRPTEGAGGTLGHLNGFDVSNNTQLGLTFTYMATDNIGVELLAATPFRHKVGTGATGDIATVHLLPPTLMAQWYFGDSSSKVRPYVGVGVNYTTFFDNDFNDNGKNAGLSDLSFKDSWGAAGQVGVDYLINRDWLIGASVWYMDIDTTANYKMGGVQHHDSVRLDPWVFMFSAGYRF

SEQ ID NO: 2340 - protein, 620 aa, Vibrio cholerae NCTC 8457
ADIEQSFGSYNSKITRGTVTGPISDTVSYRVSGNRNTRDGYIDNLQPGRDAVNDRNRYALRGQLLIEPSDELTIRVIADTSSIEEDCCGAPFYYNDPGNAATTTALGATILPDDIYKREIKFDRAMETDQAQSGYSMQLDWEPGSYSFTSLTAFRDFEETNDIDADFIDIELSGVLQNNVDRQVFTQEFRLQSTGDNKVDWLLGYYYYDADQDSGGNNRLGEFARPFFDSRIGGIVSLVESIAGAPTGSYIESGTGRTSEFNLLTTSHSVFGKLDWHINDKLTASLGTRWTTEDKEIDARMTTDAPYSAIDFTDSSDPVVATLAGFNPAFPTFAGFVQLFRPVSDFSEKRSEQEPTGELIISYEYSDDVSLYASGKRGYKAGGFNVGAGAGGADFDKELADAWEVGAKIRAFDNKLQFNVAAFSQRLRDFQTNAFNGTNFTLTNAGVIQIDGLEFDTLYAPTPNLFLSFAGSYLDAEYESYVGGPQLVRPAGSTPPLPPVQDLSGKPLSGVPEWTFSSSINYVKSFGAVEGFANLAARYRGSRNVTSEQNPIADQDSYVTANATVGIRDADGFWTVTLWGKNITDEEYTDALFNSVIQAGSFNAYPGDPRTYGVTLRLQF

SEQ ID NO: 2341 - protein, 284 aa, Vibrio cholerae NCTC 8457
MGINMCSKKIRNLILCFGFMLGLHAEENTTEGNMTEENISKDAPILLEEKRAQTLEFKEEKEAKKNIDEKSLLEEIHKKKRQLYMLKGELHEKNESLLFQRMAKNKSGFFIGVILGDIGVSAHSYEKFELLSNIQASPLLYGLRSGYQKYFANGISALRFYGEYLGGAMKGFKSDSLASYQTASLNIDLLMDKPIDKEKRFALGIFGGVGVGWNGMYQNLKEVKGYSQPNAFGLVLNLGVSMTLNLKHRFELALKMPPLKETSQTFLYYFKSTNIYYISYNYLL

SEQ ID NO: 2342 - protein, 341 aa, Vibrio cholerae NCTC 8457
MNKTLIALAVSAAAVATGAYADGINQSGDKAGSTVYSAKGTSLEVGGRAEARLSLKDGKAQDNSRVRLNFLGKAEINDSLYGVGFYEGEFTTNDQGKNASNNSLDNRYTYAGIGGTYGEVTYGKNDGALGVITDFTDIMSYHGNTAAEKIAVADRVDNMLAYKGQFGDLGVKASYRFADRNAVDAMGNVVTETNAAKYSDNGEDGYSLSAIYTFGDTGFNVGAGYADQDDQNEYMLAASYRMENLYFAGLFTDGELAKDVDYTGYELAAGYKLGQAAFTATYNNAETAKKTSADNFAIDATYYFKPNFRSYISYQFNLLDSDKASKVASEDELAIGLRYDF

SEQ ID NO: 2343 - protein, 667 aa, Vibrio cholerae B33
MRDLYLIRCLCVFSVWLFSLGVAFGQQIDTTAYHELSGVEVVEKVRPSVTREGTPLQIMDRAGIDRLGVQDLSEAVKRFSGVTVQDYGGIGGLKTVSVRSLGAKHTAVSYDGVTITDAQSGQVDISRFSLDNVEMVSLSIGQSDDIFQTARVYASAGALNIQTGKPTFKDKSFHTYLKVKGGSFGLFNPVLHYDQKLGKRWSASLHGDFVRADGQYPYTLINGELETKEKRRNSDIHAYHLEGNLFGDFGRGGELSFKAYYFDSERGLPGSVNLYNKNTSERLWDNNFFVQSGYKNVLNEKFTLRAMAKYNYAFTRYLDVNDKYAAGEQVDLNTQNEYYGSVGLLYTPIKYVSATLTTDLTRSMLDNNFVNGPNPKRMASQSVLAVQYKNSRFTATGSLLGTYITDKVEQGEKPDDKRRLSPAVSLSWRPFSESTLRIRASYKDIFRVPTFTDLYYLRMGNTNLKPEETSQYNVGVTWSSSCGDWLRHFSISADGYYNTVKDKIVALPTMYVWKMMNMGEVDIKGVDVNLSTQFRLPLRMSLFLASTYSFQYAVDVTDPEAKNYKDQIPYTPRHSGTVSVTLENPWVNVSYILTAVGDRYALPQNIDRNRIDSYIEQSISINRDFRFRYFGLRLQGELLNLTNVNYDVIQYYPMPGRSWRLSVCLSY

SEQ ID NO: 2344 - protein, 444 aa, Vibrio cholerae B33
FTNGGSVSGVVGTAANSVGDITTAGTTNFASSVNAKGAATLGGTTSFADTFTNTGAVTLAKASITNFAKNVAATSFAANNATINFGNSLAFNSNITGSGTTLTLGASQVTYTGTGSFTDTLTLNTTFDGAAKSGGNILIKSCSTLDLSGVSTLALVVTATNFDINNISPDTKYTVIFAEAAGGLKPTPAGNVKVTVNNENRFVNFTFDESTLTLFAKDVSQEVIDNDFKPGGPLANIPNAANIKKSLELMEQAPIGSDARLVFGNWGKLTPIQEADAVTHLMQDVVKPSDTIAAINNQVILSNISSSLINLNARMDVIQPAAVAAGDKDRDAKFGAWISPFVGNATQKMRNNISGYKSDTTGGTIGFDGLVNDDLALGLAYTRADTDIKLKNNKTGYKNKVESNIYSVYGLYNVPYENLFVEAIASYSDNRIKSKSRRVIATAL

SEQ ID NO: 2345 - protein, 249 aa, Vibrio cholerae B33
TGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPS

SEQ ID NO: 2346 - protein, 707 aa, Algoriphagus sp. PR1
MLSKPSLHALALTPLAAFFLSAQAQAESAAQPTTVLEEIVITSTRSATGEKDSPQVITIITREEIEEQLALTSDSSQILSNLLPAYSPNRQKLTSSGETFRGRAVLFMIDGVPQSNPLRNASRSGHTIDLSMVERIEVIHGANAIHGLGATGGIINFITRRPSGVELKQHAGVQVTTPARKLDSDTLSYKLDYLVEGAQQDFEYLAGLSYETQGLYLDGNGAPVGVDNTQGDLMDSHAYDLFIKLGYWIDDDQNIELEVNHYLAAGDMNYVSVTGDRSEGIPTTSEKGRPEGEAPRNRVITASMKYQHHDLAGMNFTAQAYSQQFEGRFGATLTSTFQDEDIAPAGTLYDQSQNESDKLGAKFTLSKQDLFDNKLKLTGGLDLLRDTTQQRLVLTNRSWVPETSYNNYAPFLQAQAQPMDNLVLHAGVRYEYAELDVDSFETLASANGVTVEGGNPDFSETLYNAGVVVTPLTWLSVFANYSEGFGMPDVGRVLRGINQPNQDVDDFLNLQPILTDNREIGVRIDFKPVDFELSYYQSDSDLGSRLENIDGVYFVKRERTEIDGLEATLGVQVHERHRVKLAYSRINGEYDSDADGELDSKLDGLNLPPNRLTAGWNARWTPTLSTSLQASHSFDRSFDDPEKEFDGYTLVDATLDYQLSVGKLSFAVANLFDEDYFTYYSQSALVNDDRNFKGRGRTFTLGYGVDF

SEQ ID NO: 2347 - protein, 656 aa, Algoriphagus sp. PR1
MAIQTAALRARLLCGTALTLLSALPAVAQELEGDVISLDPILVRQQDEKGNAADRASSVYVADAELERARMGDVKDLFAGIASVSVGGAIPVAQKIFVNGIDMLNLAIQVDGVSQNNRVFHHLSANAFDPGLMKFVRVDPGVAPADAGPRAMAGRVVMETVDAADILTEGQSVGGTARMSYGDNGGTTQGSLTLAGESNGFEIVAYAKRATGDNFEDGDGTEMTGTAANMTAGLLKLGYESEQGHRVEFSAQQIEDEEWRNDKPNFGPSSGGTYAYLIKRYNYSLRYENVNNTGLWDPSATLGYSGTDVDRPNDAWAGSTNSTSRTYSLVLQNEFHLSYSNSITAGVDFQNRKTSISGSWVTPDSASEESDNIGIFAQARLEPTDRLSLSAGMRYDWQDFTGYQWLPTDTIHSSSHSGASGNLSVVYDLTDDVSLRAGYSNVFGGLDLGDSFEFWLTRDYSGLRPSRAQNIIIGADWTPGAWTISGELFKTKFNDARDGTAVVDFESQGANIGATYGWGSGFARLTYAYSDASLDGAPSSNFDLRDFGAPLGHVLAVEVQQELAQYNTLVGGSIEAAASYDAGGSYAGQELPSYVVANVFAEYSPPAWNGVTIRGSINNLLDETYADRATYGGEFAGFQTLNEPGRSFVVEAVMKF

SEQ ID NO: 2348 - protein, 865 aa, Algoriphagus sp. PR1
MDIHFKKLLLPILALFAMTAHAQSLSGLVTDEETGQPLEAVMISVLRNGTMIDYALTDARGRYSLPWKYNGSLQVSVSLLGYRREIRNISAAETLHIRLHSEAIALKEVQIRPGRIHGRKDTVRYNLAEFASSKDVHIKDVLKKLPGVDIDDNGQVKYKGKAIDHYFVEGMDVTGGRYSQINNNLSAKAVKSAEIMENYQSVKALKGKLSSDEIALNLKLDPQARDQWIINGTLGAGWSDGTQETTGTAQTKRDKGTLLWENAANALQLGKGKQSIYGYKSNNNGTDLSREQHILTNNTSQQIPLHGFLVKPGISAPLDKQRLLFNETHTLNANRMYKWNDERSLRLQAGYTHNRITQQRGNSQVYYQPDDTIRMDETYHYCLQNDATHMEIHYEDNKAIHYLSNRFLAESETNRGTSHELQQTMRTSQFTAKNFFSLIRNGEKYTWEFNSATQYAYLPSSLSLHDGKDKFIQHSLYNDNKASHLRKHNGFTRQYTAGIKGEWASVKHHSTRMETFGASSFSPYLSPYFQLEQGKWQGSLSLPLSYKRYFSQQRSFLFFNPSLYLRYQPDYHWKIFLYGSLHRSAGDVTDLCPFTYRTDYRTWKNTDGLFPVSTRQQYNLYGEYKNTVQEFFATATLSYRHVHYNTLNEQSISENRIVHTLRLHSNSTQSWFLLSTLSKGFFDWNLKTSLDLQLSRNTGWQLTRVSDTDALTPQTETAGNGPPQKYRYDYLKMEPKLIWSPAEAFEAEYHATISYGGSKIGNDTHLAPLLDFVQRMHLTFSIGHVDLCLSGEHYRNDLNSDTHLNTLFVDASLIYKTRKWRVEASLSNLFNKKEYAYTTYSATQSYTSRLNIRPREVMVTAGYQF

SEQ ID NO: 2349 - protein, 146 aa, Algoriphagus sp. PR1
MKRLLILTALLPFVGFAQPINTLNNPNQPGYQIPSQQRMQTQMQTQQIQQKGMLNQQLKTQTQLQQQHLENQINNNSQRVLQSQPGERNPARQQMLPNTNGGMLNSNRNPDSSLNQQHMLPERRNGDMLNQPSTPQPDIPLKTIGP

SEQ ID NO: 2350 - protein, 856 aa, Algoriphagus sp. PR1
MPKKRHKQFLIVLSFLLLSFYPKNIIAQEDVGDSQNLVTYLQILEQRFEIKFSFVDEDIDKINIVIPENQNLQEILLNLQEQTQIKIQKLNTRYYTLTKSTTVDICATVLDNFKENTVNGSTIEVLGSSVAGITDENGAFNFENIPRDAIIQIKHIGFKPLFIAAKELTGANPCKTLLLDEKFEQLEEVIVHQFLTTGLSKEPDASIQLQTNDFGILPGLIEPDVLQTIQALPGIKSIDETVSNINIRGGTNDQNLILWDGIRMYQSGHFFGLISAFNPYLTEKVTLIKNGTSAEYGGGVSGILDIKTNNQITDYLAGGAGFNLINGDIYGQVPIAHNAAFQFSGRRSLTDFFNTPTYDEFFKRAFQDTQIKGGTGQSDEINRTEDFYFYDFTGKLLYDINENHKIRVSFININNHLDYTEQNITSLRETNSRLNQTNLSIGGSLESNWSDVFSTKINTYYTHYDLDSENTTVNSPQILSQENEVIETALVLNTRFQLSDALHWLNGYNLRETGVFNFSEVSQPPYFNKIKNVLRSHSVFSEVEYRSPDEKLFARGGARVNYVENLDTFSEYIVEPRLNVNYELSQDFNIELQGEFKSQSTHQVVDLEQNFLGIEKRRWYIADPENALVPLPITKSKQGSIGLNYDHHSLYVGAEAFYKQVNGISARTQGFQSKDQFNEEIGSYDVKGIEFLINKKTADYSAWLSYTYNVNNYTFDDVVPSTFPNNLDVRHTLTFAGNYTYNDFRIGVGLNYRSGKPFTKPEENNPVNTNFFPSRITFQEPNSSRLPEFLRVDTSALYDFDLLPKIKATVGVSILNVTNRKNILNTYYRLNSNDEVETVESVSLGLTPNFSFRLKF

SEQ ID NO: 2351 - protein, 675 aa, Algoriphagus sp. PR1
MLFLLPFFKAQAMDDAVALEALVVTADPLGRSEEDILQPTSVLMGKALSIKDKRNIGEAVAGELGVTSSDFGPAVGRPIIRGLGGTRVRVLEDGIGAMDVSAISPDHAVAVQPFFADQIEIFKGPATLLYGSGAIGGVVNIVDHRILDYVPEAIEGDVYGHYDSVADDATGVFRFNAGAGDFAFHLAGLLRDTEDYGIPGFAQVNPEPGAKSGTLANSDVHTKNFTGGLSLVRDEGFLGLAVSRLTNEYGVPGEHGHEDEAGQAHEEGGVRIDQAQTRLDIKGTLYLPLAGIQTIKTRWGHNDHTHQEFEPSGLASTILNNKEWEGRVEFLHTPFGEWEGVAGLQYRNRDLSARGEEAFMPPSSRMDSISVFILEERAWRRWHFEMGGRFEHQVAKKSEGGPHASHNLFSISGGAMWDFWKDYAVGFNVSHSERAPALEELFSEGPHLATNTFEIGNPFLNKEISNNLDLSLRKTRSHWHWKLNLFANFISDFIFLQEQDKNGDGIADRVNLEGEPSMDPDGLLLVNEKQADAEFFGVEFETVIGLFEDHRGKLDLRLWTDYVRGKLKNGANLPRITPLRFGSELDYERGPGYAGINLMRVQAQDETAALETETGGYTLLKVYMGYRFALGPVQYAVFLRGTNLLNEKARRHTSFLKNQAPLPGRSAMVGVNATF

SEQ ID NO: 2352 - protein, 499 aa, Algoriphagus sp. PR1
MKVVKVASLLLLGLVLLAPASWSAESAAVPENTDEQAVSEEKKDDALKSSDQASGVETSDPSTASAATEKDPDDEPVTQGDLNGLRTELETLRDQFQTNYDQKTATTSRSLKFGGSATTKFVVSDDPAVKEGFGTPSLNLKFSGNLRKDYEDGKNVDYVFGTNAGGSDLTLRIQDAYLSYSILPSNDVTKPYLYVYVGQQKKIFGLEATASEEYKPTINGAQFTKALSLDERDIGLVLSGDLFPHNDYGFSKYRVPAIAYSIGVVNGSGPNKADDNDNKDVFARVAFNAPVDYNDFLRGLTLGVSGYWGVKTATATRTSTTTVNVPNATPPPATISVTTNTTDTTLSQKGDKNRYGGDLSYVNTPVGFTLEYVRGEDPSLSKEKIKNGTITTPSTFRSVKSEGITFTLFYNFGEQFQKSYKEQTRYGDWYPQTIQPFLRFDRFDPDLDAEDDRKDIYTIGFNWFFAPTTKLQLNYNIVSGQIPKAQKNNEFLAQFQYGF

SEQ ID NO: 2353 - protein, 985 aa, Algoriphagus sp. PR1
  misc_feature (278)..(278): Xaa can be any naturally occurring amino acid
MVKKEHADGSVTQSQFDAVGRLRAQTDAAGRTTEYSPDVVTGLITRITTPDGRASAFYYNHHSQLTSATGPDGLEIRREYDEWGRLIQETAPDGDITRYRYDNPHSDLPCATEDATGSRKTMTWSRYGQLLSFTDCSGYVTRYDHDRFGQMTAVHREEGLSQYRAYDSRGQLIAVKDTQGHETRYEYNAAGDLTTVIAPDGSRNGTQYDAWGKAICTTQGGLTRSMEYDAAGRVIRLTSENGSHTTFRYDVLDRLIQETGFDGRTQRYHHHLTGKLIXSEDEGLVTHWHYDEADRLTHRTVKGETAERWQYDERGWLTDISHISEGHRVTVHYGYDEKGRLTGERQTVHHPQTEALLWQHETRHAYNAQGLANRCIPDSLPAVEWLTYGSGWLAGMKLGDTPLVDFTRDRLHRKTLRRFGRYELTTAYTPAGQLQSQHLNSLQYDRDYTWNDNGELIRISSPRQTRSYSYSDSGRLTGVHTTAANLDIRIPYATDPAGNRLPDPELHPDSTLSMWPDNRIARDAHYLYRYDRHGRLTEKTDLIPEGVIRTDDERTHRYHYDSQHRLVHYTRTQYEEPLVESRYLYDPLGRRVAKRVWRRERDLTGWMSLSRKPQVTWYGWDGDRLTTIQNDRTRIQTIYQPGSFTPLIRVETATGELAKTQRRSLADALQQSGGEDGGSVVFPPVLVQMLDRLESEILADRVSEESRRWLASCGLTVAQMQSQMDPVYTPARKIHLYHCDHRGLPLALISKEGATEWCAEYDEWGNLLNEENPHQLQQLIRLPGQQYDEESGLYYNRHRYYDPLQGRYITQDPIGLKGGWNLYTYPLSPVNGMDPLGLYEFKSKNIDDIGIFALAMCNGESINENKEYGGLICKKQGEYFPMNPISSNDNDSVDLRNIKCPEGSERVGDYHTHGFYSDDKGNKVTKENDVYDSLNFSSKDLTNSYMNGMGKKECSSYLGTPNNTYLKYNPKAKGNGVTIIRQGSN

SEQ ID NO: 2354 - protein, 418 aa, Algoriphagus sp. PR1
MPRLFHPATAVLIICAGTFGPFSGIWAAENPATRGNGPIPDTTGLSPKYLPAYRHLIDGISWAGHADSELFSNLSGGIRRGSEGNLAGQIGGEYDTEKAGLWKGGKFSLSLMGIYSSKVQQNYSGDIQTASNIWAPDAIRFYDAAFRQRWTDWLNTRVGYMDVNYYFDVTANALQLINSSFGITPTMTVNVPGTATYPYSGLGFLVGIHNEHLSSKVAVFQGDPQHQTSAFDRGYMALWEGGLHWGKKDDEDLEDNTDNYGRYILKIGGWHYQQSNPDLYGLSPTTSGIYAVAEGNWDLSGERELGAFIQMGGAPQNFNPVPWYLGIGLRLGHPFASRPDDSLSVGMAKAWLRSGPVADALGVKPADIRGAETSYELTYVAKLTEHVSLQPDLQYIQHPNGYYPDSTVGLLRVHVEFF

SEQ ID NO: 2355 - protein, 134 aa, Algoriphagus sp. PR1
MSVMLQSLNNIRTLRAMAREFSIDVLEEMLEKFRVVTKERREEEEQQQRELAERQEKISTWLELMKADGINPEELLGNSSAAAPRAGKKRQPRPAKYKFTDVNGETKTWTGQGRTPKPIAQALAEGKSLDDFLI

SEQ ID NO: 2356 - protein, 565 aa, Algoriphagus sp. PR1
MSRTILHLGLLSPFLLGITAIMGSGAIAETSPTPAENPEFAESQTDEPTQQFAQVSNSNRLDQLNEYTSESQTQSQVTSVNQLSDVQPTDWAFQALQSLVERYGCIAGYPDGTFKGNRALTRYEFAAGLNACLDQVTELLGAATSNLVTREDLALLQRLQEEFAAELASIRGRVLALESRTAELEANQFSTTTKLTGEVIFQIGDTFGDRSLYNVAGGPNTEDSDDPTQTYFGYRARLNFDTSFTGEDLLRTRLEAKDIPNLSDVGLNNSLMTRTGTDGITDGFELDDLYYRFPLANGRAQAYIGVNSLDLDDIQDPVTPFQSTGAGAVSRFGRYNPTSFRGPEGTGAAVKYALNDKVQVNVGYLASDEDAPDATEGRGLFNGSNTASAQVLFEPSDRIGIGLEYNRRYFRDGDVNVSGGTGSFIANRPFGENATTSDNLGVQVNWKLLKNFELGGWFGSSWAHQETGGEDEATILNWAVTLAFPDAIREGDLGGVIVGMPPKVVDHDINNLEDRDTSVHLEAFYRFQLNDNVGIIPGFYMVTDPDHNSDNDTTWVGTLRTQFRF

SEQ ID NO: 2357 - protein, 322 aa, Algoriphagus sp. PR1
MKKVLLATTALVFTAGFAAAEGHGASITISGEAVAGLKYVEDADEETTQFVELDFGVAGKTTTDGGLEVGASFDLDIDTGSSIEDGNLDSKDGALITDEEFYVSAGGITVTIGEPGAADDNVVGTLSDVGFDGIGIDDTAETFFDNNSQNILVKGEFGAITVAASADMSENGDEASEDYGVAAGYDAGTFSVGVSFTNDEVGPLGNSDVETFAIGGSLTAGGADIDLFFHNASSDDFDANPAIDADSISGYGASVAYPVGALTIVGTIGATDLDEDEVDFGVGIEYDLGGGVTLAGGIGQVDSPILDDDSNTVADMGIKVKF

SEQ ID NO: 2358 - protein, 821 aa, Algoriphagus sp. PR1
MKAPLRVVLTSVVFLASGSFFSSPFLYPQVLENLKKSSPLASTLPEEIVPEYLDSLLADQPENPSQDGDSTASSDQTGIAPGTQSIKILSQSSLKNINFQNVNELSAYQVGINQTQITGSPQAEPILRGLPATRYRNGILVGFSRDAQYGPLLNPNMDENMDMVMGPSNIIFGPQELAGGYLNEITKLPYFDQFKGEASYTVGMYGTNFWNLDLGGPIKNNLAYRLDYFGQDGSSYYNYYYGSYLRRESGFIALSYQPYENFSIDYNAEIDSNSLNPPAGLNRPTQQLINNRLYLTGPFAGWYDQNGIFHSGIGTSPPGEGYAVNWGPLVSIDPRTNLLNNPINSTEQLYAVSQLIETLKISSNFKIVNNSMFEYYSTFIDQMIPGDFWSVLPAGYNFDDRMECLGNFSTSLGNLSIDNNFDGGVEIRYYSDREYSGVWHSPINTWDLTKPLLDNDFSPLVSYSQALLFSNPYLTDIPVPGYPGFYFNSHNFLSTASTFYKLSPFYQHKMDLTKKLNIVVGARSDLYIVHASSPPGTPAPLFLENNMTAILPQVYTGVVYDPFSWMNTHFSYFFGQNPFPSAYGSFAPDFTATYYHLTNQYFEIGTNFTLYKDKLSVSVSGFYQDGFIPAYVLPEGSVATTQAYLKGGQLQATWNPIHNLSLNAGYAFIDAHENWTGSPIGPFTTQPYPSNVAKQLGLHVDPYVFLAPLDYPFIGFPRNYGNATLSYQSKKGYGFSLWAIIQSGQFLNYDYTVRIPTWYTLNARLFYTTSKWEISLYFYNLTDEKYWAAGAPGFISARSFNYDFITPQLPFWIQGTLRIFF

SEQ ID NO: 2359 - protein, 307 aa, Algoriphagus sp. PR1
MKKVLLLTLSLSLSFWLHAERNGFYLGLNFAEGSYIQGQGSIGEKASAENALNQAINNAKNSLFPNTKAIRDVQNALNAVKDSNKIANRFAGNGGSGGIFNELSLGYKYFLGKKRIIGFRHSLFFGYQLGGVGSVPGSGLIAFLPYGFNTDLLINWTNDKRASQEYVERRVKGLSIFYKDMTGRTLDADTLKRASRHIIRKSSGLVIGMELGASTWFASNNLTPFNQVKSRTIFQLQGKFGVRFSSDEYDIDRYGDENYLGGSSVELGVKVPAFKVNYYSDDYGDKLDYKRVVSVYLNYTYNFKNKH

SEQ ID NO: 2360 - protein, 824 aa, Algoriphagus sp. PR1
MKQFLMGSAAVLAVAIPGAALAQSTGSQDFEDTIVVTGATVDQGVGGVKIPDSPKAKVVLTQEIIERQRPGQSVNEIINLVPGVSFTNNDPWGSSGGSFTIRGFSSDRIAQILDGIPLNDSGNYAIYTNQQVDPEIVESINVNLGATDVDSPTAAAVGGTVNINTMVPKDDFGGMGSVSYGNIVADGSGDRPFHRVFGMIQTGDFTGHGTKAWVSASRAYNKASFADYGKIEKAQYNGKIWQDIGANGDFISLAGHYNVNRNNFGGSPASAAAFSGDKSARFYNVSGGIPCEINTEANPAIADQTNSCGTQFERRYNPSNTGNARLSTRLTLTDRLIFSADAAYQYVKANGGGTTSAYEAPFYSGTDALTGYFNGSAYFGRDLNGDGTLGVDANGNGRIDPAESDRVLINNPSQTQTKRYVAIANLSYEIDENNRVRLSYSFDRARHRQTGEGARVLFNGEPTDVFPVNDPLTDADGNVLQKRDRKSYATLNQVAGEYRGTFFDDLLTVNLGVRAPFFKRELNQYCFTSAPNGNVNCVAGGDVAAYAAANPTFAAPQSRNYKYDKLLPNVGAIFKITPEISIAGSYAANISVPGTDTLYNSIYLPAENAASKPVAETSDSFDLALRYQNNIVQAAVTGWYAKYKNRIASAYSIECDCSIDTNLGGVKKYGIDANVSVRPTPGLLVYAFGSWIESEIGSDVQTGPTDFAATKGNRERGAPSYLVGGRIQGTLGPVDLGAQIKRTGSRYLNDINTFKVAGYTVVDLDLRYNLANLGLEKSFVQFNVSNLFDKFYIGSFSGGLTTASSTFVNYGAPRAISGSLVVAF

SEQ ID NO: 2361 - protein, 919 aa, Algoriphagus sp. PR1
MKSSSLHAARLLRTTAMGVSIVIASMAAPALAQDSGADTATDDSGDAPIVVTAQGRSQLLSDVPVAISAVSAETLQNSGANDIRQLNQVAPSLLVSSTGSEANGSARIRGIGTVGDNPGLESSVPVFIDGVYRSRSGIGLNELGEIDRVEVQRGPQGTLGGRNSSAGLISIYSKKPDFQFGASGEITYGNYDYWRLGGSVTGPISDTLAARIDGIWVKRDGFYRDATNNTDVNDRDRYFTRGQLLFEPTDALSIRLIADYTFRDEKCCAATYVDSSVNPFIGNLNNPGVPVTPTTNNIIRVLADLGQPLSAFNQGYSRDISVTPGRSYAGETKDYGFSGQIDYDFGGATLTSITAYREYRSSQASDTDYGTVDILYRAPDDDAYRQFHTFTQELRLNGEAFDGKLDWLVGGFFANEKLTVRDNLRFGSQYGRFANCRIISGGGLAGLYSPTSPLCVVPGVGPATIAAASGASGPDIVAAFTALDGLNDRGTINDRYRQNGTNWALFTHNIVHITDQLDFTFGVRYTHDKKKFSAAFTNDNTACTTIQGLVLDDLASPNATARALAGALIGLGCQGNSTAELNGVSIRDSRSEDEWTGTGILSYKPMDDLLLYASYSRGYKAGGFNLDRSALKSPILPFGGQAGAQSLVGNLQFDPELVDAYEIGAKYSTGPFSLSLSAFRSDFSNFQLNTFNGSVFIVQTVNGCGGDLVGGPDADTDTSNTTGACATDDVSWGVRAQGFELEASLVPARNFRMAAGLTYARTKYRKDLVGNKNGDPLDAALRKLPGDNLSNAPELVATGSISWTPDIGSSGLTGLVYIDGRMTSDYNTGSDLFPQKEQDGYALFNARLGVRGPDEKWAVELWAQNLFNKQYAQVAFNSPFQAGASSAPFTDPQFPGGRQIFSQFLAEPRTYGVTLRGKF

SEQ ID NO: 2362 - protein, 376 aa, Algoriphagus sp. PR1
MKTTLLVALMACLGAMSEAAAVEVTVGGRLHLDYARYNADVRQLDNGMLLRRARLDMDGKLTSDWSFELAYDFANVYALTNTGTVKDGDFKEGFTDIALHYDGWKQADLNVGQTKVPFGLEELNSSNAISFIERALSTDAFAPSRRLGAEVSRNRDHYSVSVMGFGSSFDGRERGRGLAARATVTPIYAGGGNTVLHLGIAAVVERPTGEVKFTARPESRALDVRFLNTGKLADVTHVGRLGLEAAAKSGPLSLQAEWMQTAIKREGIGTDATLEGWYVMGSWVLTGESRQYSSGRFKGVPVQRPGGAWEVTARYSHLDLDNANVRGGEEDNLTLGVNYYASKHLRIMLNYIDVHSERRGKADSPQILLMRAQLAF

SEQ ID NO: 2363 - protein, 363 aa, Algoriphagus sp. PR1
MKSQLQRRNRRWLRELGGFALAGSACALAGTAHAQSSVQLYGIVDMWAGVQKLPSQASAAVAAGNGMSTSFWGLGGKEDLGGGLQTVFAIEGFFRPNNGAVGSFDGDPMFSRNAYVGLQSSTYGALTFGRQSSPLYLQSTLFNPFYASFTFSPTVNHLYGGVGTYPAFKTDQGVFGGTAWANAIQFATPDFNGLTGKAIYAFGNTAGENGSRKWSAQMAYTHGAWSISGVYQYLNFSSTPGDLAHFIAGEKSQSVAEIATWYDFGFVKLYGEYTWTGNDRTADSFHVNSYQAGAAVPVGLGRVLASWGYSRNAGGLDLTRQTATIGYDYPLSKRTDLYANYMYDHLTNTSSGYTTGVGLRTRF

SEQ ID NO: 2364 - protein, 128 aa, Algoriphagus sp. PR1
MAASLRLKNGLIMKKINAIILLSSLTSASVFAGAYVENREAYNLASDQGEVMLRVGYNFDMGAGIMLTNTYTFQREDELKHGYNEIEGWYPLFKPTDKLTIQPGGLINDKSISSGGAVYLDVVMTPTY

SEQ ID NO: 2365 - protein, 479 aa, Algoriphagus sp. PR1
MKNSTPLKNQVFCGLYVLSLSASLQAFDYKIEVSAESFSKVGFNKKKIDIARGIYPTETFVTAVGQGNIYADFLPKGLKDQGHVLEGKIGGTLGGVAYDSTKFNQGGSVIYNYIGYWDGYLGGKRALLDGTSIHECALGSDGKVIDSIACGNARANKIRRNYLMNNAFLEYRYKDIFLAKGGRYQSNAPYMSGYTQGFEISAKVKDKNEGIHKLWWFSSWGRAFAYGEWIYDFYSPRTVVKNGRTLNYGIHLVNYTYERKGVSVSPFFQFSPGTYYSPGVVVGYDSNPNFNGVGFRSETKAYILLPVHDPLRRDTYRYAIKAGTAGQSLLIRQRFDYNEFNFGGAFYKVWKNANAYIGTTGNPLGIDFWTNSVYDIGQALSHVVTADAVSGWVFGGGVHKKWLWGTLWRWTSGTLANEASAAVNVGYKISKSLTASVKLEYLGVMTHAGFTVGSYRPTPGSKALYSDRSHLMTTLSAKF

SEQ ID NO: 2366 - protein, 785 aa, Algoriphagus sp. PR1
MTTYKKTSALPFPINKVLNSVVAALCALSAPVAFAQQDTSDELERIEVTAQKRVQSINDVPASISAFEGSRLDELGLNELDMISDLTPGLVIQEQSPNNPGFVIRGITSDSGSAQASPRVSVYYNGVDVSRSRGSYFELFDIERVEVVKGPQATLFGTAASVGAISVITRKPEPGFSAELSAGAGNESQKRLGGFINGGSELVSGRLAFSYRERDGFIENIAPGQDDMNGIDRQALRGSLRFQPSDAVTADLIYSYEKNEDTGTSFKNGIFAPTGGDTSPYSFVEMTGSPYSASVLGREKLGLDRTVDDINLTVDWTISPRLSFTSVSGYRSFDSLEVFDADGTQAWFLEFGEDAEGDQFSQEFRFNYAGDNLLMLWGINYFTEDGSQRVPFSTEESIFLNCAGALPSGLPCINADGSVNQLTPVLTGGALQEIPYAGEFTNFGDNESWSAFVDFTYQLNDKTEVAAGIRYVSEDRESGFAATMPNSQLLPLLGLPTQTLLPTVSTDGEVFTASNSSDAWLPRFNILYKLNDNNNWFATISKGRRSEVVDVSSTLDADGEAAGDFGLIPAEVIWNYETGLKGNLTENRVRYSASVFYQDYSDFQVTLQDDSGNFYTANAGSATNFGVETEINANLGAGIELFGHLAYLDAKIDDDSTNGSLAGNRFRLQPEWTSSLGVIYEAALSSQYALRGSVVGTYRSEVFFEPENAPVAGLDISQDSVSLVNASLGLYNDSADWSLALKATNLFDKEYLVDAGNTGGSFGNPTFISGPPRLFYLEFTKKFGM

SEQ ID NO: 2367 - protein, 218 aa, Algoriphagus sp. PR1
MLRGLSLGLLSSAISVAALSASAQEVSADFPKLYITGAAGANNPTTRTNTGEAGTFEEYTNPGASAELGLGLDFDGFRVEVTYAIDASQLRGYTNVSGVDFDYISGGETRKQSAFLSGYWDVLRQKSWTPYFGAGIGYSNLDVRNFSDAGLSYDAFNRSLWGYQFKAGMSIDVSSRSKLFAEGIYRATSRFNTNDGFNDWNNASWSSWGGQLGIRVEL

SEQ ID NO: 2368 - protein, 282 aa, Algoriphagus sp. PR1
MRKALLCCAAPLCAAAAFGAENNDENAAREGLWNNLHVYRAFNQRGGPYLTDDSYLEWEFGGRKGVLDLYGYIDYKNLFDDASSDVPDGENWFVDIEPRLSIDRLLGRDFSIGPIREWFVAFDYYYADARQGPGLNVLWSGIGTNTELPWLGTVGLNLYARYIDKNYGASNENAWDGYVAHMNWFKPLAQFGGKRFIAFQGFFDYEFGSKLPDKDDAFEREYRTDNGFQAYLGLWYHTEHWKFGYGAKVYRNMTQWRDGEQLDGRRTDSSGIGHYFNVGYAF

SEQ ID NO: 2369 - protein, 728 aa, Algoriphagus sp. PR1
MLKWRLFACASATSLALSAGAAMAQEIEEVIVTAQKREESLQEVPVAVTALSAEAMAKAGVTESRELMYITPGLVFTQGSFVSRPQVRGVGTRAVGPGDEATVPLYIDGVYQSSQHAGFFDFNNIQRVEVLRGPQGTLFGRNAVGGAINIVTYDPSPNPEMRLAASYGRFNERKGDIYLNGGLSENLAANIAIHANADDGYVKDLVSGDSVARTSSFGVRSKLLWRPIENTKVIVGAAYINSHDDTALKTHPIDGITAAKLVDPNVLIPTGYNSALSVDSYFGMHQTSAWANSVSTFSGFDLTFLGSWQKTELGSSGDSDGTVVDSSYSAFSVDDRSYTAELRASSNGEGPFQWIAGLFYFQGQARYGFGDTYFLVRGGPTAATQILQSDSDATSYAVFAEGSYDLTERLSLTAGLRYSTETRDFRQWNDRRVLAPGQTPPPPPPNGPPVSSEFDKLSPRLSVKYAFSDRVRGYFTYSQGFKSGLYNASAAALPLTPVKPEVLDSYEVGLKTEPARGVRLNAVAFYYDYKDLQVSARNVSGGLTLQNAATAEIYGSEVELAWAPRPNWSVNAAVAYNHARFKDFPGAQIFQLRPPTVVNGVTVTTPGYLQVLGDASGNHLPKAPDWTFNLSTLYTTPLWGGELALSGLLYWSDEYYSDNGNSYKEPSYENLNAQVAWTDPGERWRFTLWGENLTNTKRLRTNSLSGGGNIGILAPPRRYGVSIEYMFR

SEQ ID NO: 2370 - protein, 1036 aa, Algoriphagus sp. PR1
MILLCCFSASQVNAQTKIRLTGIVTDNTNLGIPGATIFSGTPLKSLTATNNKGEYSVSVDDGAEIVIRSIGYTEQRIKLKAGQTVLNVVLKDNAKEMDEVVVRGYVARSKKLTTGSSNKVDGSVLQGSPSSNVESLLQGKVPGLNIQVNTGAPGFRGSTSIRGLSSLSVTGSGSEAFLQPTSPLYVIDGIPLDADQASQFGFQQQGPGVSPLSMIPQEDIESIEILKDAQATSLYGSRAAYGVIIITTKRGNSPIPRIRYTLNSFMQKPPKLRETLGGNLERQLKLRRIIENAITQGDIDRISGTAFLSDSLNAYYNNSTNWQGVFYRTTFNQQHNLAIDGGDSKFNYKTNLNYYSENGIIQNTGFDRYNLTMRMEYQPSPKFQFVGSVFGGVGKTNKGDGLGLFQTGVANNGQASSLLPGPSFFQSSGGVVSALDTKNDNNARNLRTNVEVAYSAFEGFRASTNVSYNFNSNTEDTFTPAAANGQFAKVYAFTGRDDRLYNRSALTYSKRFWGDKHGIFVNAFSEVYVEGRQSSISRQERTPNDQFQGPLGYDAYNSRGGGVLTDYRNFRSAAFAGAITYDFSSKYVMDLTYRFDGNSGNGIDNPYSKNPSIGLRWNFKDENWFKDAKWLGSGALRMTWGKVISPNSSLVDIYGRYNISGNYNGNQGIGIDFGLIPNPTLKPTTSTTYNVAFEASMFDNFVDFVYETYYKSVDNMVLARGLSNITGFGVLKSNDAGIVNYGHELSVNFRPLRKGKWTLAINVNGAYNNDVLTKLPADYNGQMIQFDGSKYLQHTVFRVGANTLSNYLRVNQGVYSRDTDVPVDPMTGLLYRTNGTFFEGGDPIWRDMNGDYILDGRDYMIAGNSQPLLVGGLGFNLTYNDFRLDVYGSFTSNRTILNNALADRLGLMRDPFGDRSVVPLSDLDMWLRPGDVAKYPYAYSYARINSIDPFRADQTLWEENGTYLKINTITFSYTFKKQFVRRIGLNNLRVYVSGENLKTFTNYTGPNPENVTNMGRDASEGYPVPRKYNLGLNVEF

SEQ ID NO: 2371 - protein, 901 aa, Algoriphagus sp. PR1
MKKQEISQRRKVGSLQLSRVKFVSESEINSNRKLMAPELDLTQIRGRYFKQRVLVAAIASTCTLMMSRLACAETEPDNLGQRLLVAKADNTAPQRVAQTANFNNSFLVGQARSVDLGMFSRGNPVIAGLYRADLYVNGQWKGRRDMEFRNTKDDKEAVTCMTLAMLDELGIDTSALTDSAADMQACKTIDQWLPDAYARFDVATQRLDVSIPQAAMRRSARGYVSPSLWDHGVNAGFIGYAFNWYGGRNANAINSRRRSDSAYLGINSGLNLGDWQFRHNSSYSWHSNEGSLWQNISTYAQRAFPNTSSMLTVGDAYTSGELFDSIGFRGISLATDDRMLPDSLRGYAPIVRGIAQSNARVEIHQNGQLIYSTTVAPGAFVIDDLYPTGYGGDLQVTVYETDGRQQQFSVPYGSVPQMLRAGSQRYSLTAGKIRNNNLSHTPYLLEGTYQRGISNALTAYAGSTISQRYIAAIAGAGLSTPVGAFSLDGTVARTKLRNDTFSGTSLRLSYSKLLSPTNTNITLAAYRYSTSGFYGLQEAIMAMDYERRGLSTASIYRQRSQLQLTVSQQLGQYGSLYLTGSARQYWNQRGNTIQYQGGYNVSYKGVSYGLSALRSQIPSMPSDTQMLFTVSVPLGKANPVIVTSQIGSRDGRYDNSRVSLVGASGKDSALTYGIAASDARNSATMIDGNVQYRSRYAALSGSYSHNRNYNQMSLGASGSIVLHSGVATLAPQRGDTMVIIEAPAAKGARVSNISGVRIDSRGYAVVPYVSPYRMNTITLDPEGTDPDVELETSSQLIAPYAGAISKVTFGTRKGRALIVNARTPTGKALPFGAQVIDAEGQSVGLVAQGSLIYIRAKDPQGRLTIKWGDQAAQQCHLEYQLPANEASTRPSSFTTLEAICR

SEQ ID NO: 2372 - protein, 435 aa, Algoriphagus sp. PR1
MRKVLASAAILAVAGSAMATNGDNMIGVTPASEAMGGLGVGMPIGSVDSIFRNPAWMNSEKGFTVSFGGILFMPDVKGRYNGQNSGDTGYVSSRANFFTVPEIGITNRINDQVVVGIAAYGVSGMGVDYRDKDPRLANMHTTLQFMRIIPAVSYQVNPNLSVGVGLDLAWGSLDMGANMCVDLNQNGLIDPNECFNAGGGQSSSYGVGAQLGIGYKVGDLTVGFNYQSPVSMKYKHVFDTNGDGSYEDLKLQQPQEVAAGIGYKVLPNLKVGLDLRWINWSDADGYKQFKWKDQTVIAVGGEYQVTPALKLRAGYNYGKSPIRSYSGLNGMMPTNNIPSLAQPFPDFNVQWFNLIGFPAITEHHITLGGSYQVSKHFAIDLAYVHAFEKKVESSGQSYTVDATSGNPPTRYTLENATVGAKNSQNEVGIALRWSF

SEQ ID NO: 2373 - protein, 739 aa, Algoriphagus sp. PR1
MKKHLISICALVAMANAATIKDIKFIGLNHLSNTSAINIAGLKIGEEINPAKINTAILNLYKQNYFENIAVENNNGILEIIVTEKPTIAKVTITGIASNDRKQVESILGIKRGTLLDEGNIKEAIERIKAYYEAKSYFDTIVEYKKKTLENTDGLELEFIVNRGENIIIDNVHLSGAKKFSYSDIEPAVVNKEKEFMGWMWGRNDGKLKVFELSNDSSRIADEYMKKGYLDVQVSSPYLKTYTDTYQANLTYFIKEGKPYKIKSISIENPLFDDKQNAQTVKDLRSSAGKTINIEDIRKDVKTIETQSADLGYAFVEVYPDIQKNDQTQEATVVFKVIPHDKVYIRNVIISGNSRTVDRVIRRELYITEGNLYNRTDLSESKNALKRTSYFDDVNIKEEKVDDTHIDLIVDVKEASTGAISGGIGYGSSDGILLNASLSDTNIFGSGIKSSVSVDKSDDTLSGRISLVNPRVLDSQYSLGGTLYSNDYEWDNYSEKNYGFDITIGRQFARYYNVSLTYNLEQSDIYHLSPTLLRTGYELGKSIKSSITPAITFNDTDDYYLPRSGIIASTSLEYAGLGGDQEFISSSSKFNFYQGLQDYIGYDLIYRYKASFYKVWDEGYLPINQRIYLGGIRSIRGFESRTVSPKNQWGDEIGGTIAFANSVELSFPLIDRIKLRGSVFFDYGMIGRKNLDEIKRMSTGIGIEWITPIGPLQLVFAKPLNDKKGDDTNSFEFNLGTRF

SEQ ID NO: 2374 - protein, 742 aa, Algoriphagus sp. PR1
MNSLASSLAAAMVVPAFCLAPQAAAQSNVPQLTPVQVEGDSSPYDVPVSQSPKMTAPLLDTPRTVQVVPQQVIQDQAATSLQDVLRNSPGITMGAGEGGRPGGDLPIIRGQNSAGSIFVDGVRDTSTQVRDTFNVEQVEIIKGPDSVYSGRGGAGGSINLVTKKPKAYDFAEGTVQVGTDNNYRATADGNWRLGDQAAFRLNLMGNKGDVPGRDNAVDFERWGVAPSLMLGLGTPTRITLSFQHYQDDSMPDYSIPYDPESGQPVTETRGVSRKTFYGLTGRDFMRQRDDTGTLDIQHDFSDSLQLRNVTRYSRSTMDYAATNPDDSKGNVVNGLVYRGLKSGYFATKTFTNQTDLTGEFRTGSLEHSFDVGFEYTNVVQDKDGYNELGKPGASNDTNCSTGAVAGSAWCTSLWDADPHTYYPGRLERKDDPATYTTNTMAVYGFDTIKFNEQWQASVGLRWDNYKISGKNIAPGRGAPAGSPHYNAEREDNLFNYQLGLAYKPLPNGTIYATYGTSSTPSAVAANNVNDVVTNDSADLEPEKSRTVEVGTKWQLFDNRLMVSAALFQDIRKNTSVEISSGETAQVGKAKVRGLELGFSGSITPKWNVYGGYTFMDSELVKGAYDSGAVGQDLPNTPRNAFSLWTTYKMLPQLTVGGGAYYVDKVYGNADASHNSNGTPKARWVPSYWRFDAMAAYEFNDHLTAQLNVLNVFDKTYYTKAYGAHYAALGTGRAALLSFNVKY

SEQ ID NO: 2375 - protein, 742 aa, Algoriphagus sp. PR1
MLFIPCARIPMSTSIAPPAPTPRPSLLLALAISMASLSLPAQSVEQDEENEEETVVLDTLDVSAKGVTVGAAGLEAGAGFRSRNAEFGLLGDRDIRDTPLSISVINSDMIRNTQATGLSDLLKYLPSTQMQARGGMEIGRPQTRGFQGGVVSNSHLDGFNVAITTAYPMEQVERLEVINGLSGALYGPAAPAGDFNLVHKRPTATPLQHVRLGFADDSRLLGHVDLSDTLGFFGYRLNLLNEQGDSYSGKSDTQRSLVDLALDFHLSPATVLEVNASHYEYEAWGLPNQFSYGDNRRLPHAPDPEDSGLGQGFTGAYLETNTGTLRLRHDFNEDWKMVAGVSRQIADRDMYNGTNRLDNDRGDYTTLVNASQAASRFIVTSDQLRFNGKLQSGPFSHDLVLGTTGFDWDIYGVENPPRQANQILGTANIDSPRNFPEIDLFHTDDRYRSGTTEYRTVTLGDTIGYGRWSLMAMFSKTWIQSRSYDRNSQRTNDSSDDGINPTYSISYKPRDDMTFYVSYAESLEVGDTAPTGALNEGETLSPYESEQWEAGFKWRARGIDLAAAIFRIERPFAYLDNGVFSEQGTQVNRGLELSANGEILPGLSVYGGATWLDPRLRDTAREDTSDKRIVSVPKIQANLLFEYDVPRLPGLVLITNLHHTGKRAANQTNTQWVGAYSTFDIGTRYTHKVMGRNVVWRADLYNLTDRHYWASIFANSVDGSATSNGAYLGAPREFRASVSFDL

SEQ ID NO: 2376 - protein, 759 aa, Algoriphagus sp. PR1
MRGTGLSFRKISNGNVVLERQTASNVIALQQVTVSATRSAQDVSQVPSTVSVQTREQLDRQNVNNIQDLVRYEPGVSVSGTGQRSGLNGYNIRGIDGERILTQVDGVSIPDSFFYGPYAQTQRNYVDPEIVKRVEILRGPASVLYGSNAIGGAVSYFTLDPDDIIKPGKDVGARLKTGYSSADESWLTSATVAGRQGDFDGLLHLSQRNGHETETHGSHSGDGLSRTEANPMDARTTNVLAKLGWNYADDARLGFTYERYKDDRDQNILSAVGGPFIPGFGGMNSYRMRQGNDTITRERFGLNHEFDLDSVVADHVKWSFNYQIAKTDQRTDELYVASGRQVFRDRQTTYKDRQWVFDAQLDKAFSIGQTDHLFTYGTTLKQEKVTGSRSGTGTCLNIGGTCTAIGQDSARDGQALVSDFPDPTVNTYSLFAQDEIRWNNWTFMPGARYDYTRMEPKFTEEFLRGLESSGTAPTAQDDSDKKWHRVSPKFGLTYAFNDNYTWYGQYAEGFRTPTAKAMYGRFQNLDQGYRVEGNPNLEPEKSKSYETGLRGNFDAGNFDVAVFYNKYRDFIDEDAVQSANLEQTFQANNIKHATIKGAEFKGRLNLDHFGAPQGLYTQTSIAYTYGRNDDTGQPLNSVNPLKGVFGLGYEQQNYGGLLSWTLVKRKTRVDDSTFYSPDGSTSKFRTPGYGVLDLTGYYKVTDDVTINAGLYNLTDKKYWQWDSVRSYDGQGEAAVTQPANIDRLTMPGRNFGINVVWDI

SEQ ID NO: 2377 - protein, 1371 aa, Algoriphagus sp. PR1
MNCQRYFCFVNGIVEIRTAPEEYQNKPVLVGSQSDGLLIIDNHADIEDGIFSTLHIGNGYNGAVDVINGAALHMDNRSGSAPLIVGAFGNDIAGKLNISGRNSIVSYRDTPSSSGHNESIYVGFGPGATGWINIFNGGVFEVLNSTNIYVGSDTPGGGDGSIVIDGSNSKMTADFSEAYVGLYGNGDISLKNGGQLSASNLYIGGNGRAIVNISGTDSRLIANMITISGSSGAPGIYIADQGILNVDNYINITTANDTKGKLFINSDMPGTIESKGILFGVGKAELIFKHNSDNYAFSSPLISKNTGNGIINAESGETHLTGDNTDYSGLLNILPTASIDISSQKNIGKSVIVNNGVLQITSQDDWTFNNNMTGNGYLNVHTGGHNFAFQNSTNTQEFTGTLALSDTLFDLSDDNTTALTSALVLAGVGSVITAGTGTQVINGFSFDGGAVNFGAVTQGAQQTESQIQVTDNLYINGNGAVRVSTPTDVNGIPQVINSSLSLLEQDDSNATIKLVDASSAVVKGNGGNLQLQDASGQVISSGKQRNIVQQGKNVAKGVYDYRLTSGPHNDGLYIGYALTQLDLLASGVDALVLDAAGTTGNAADMSARITGAGDLAFNSQKGETVSLSNQDNDYTGVTAIRGGNVLMNSNSVLGQTSEIRLATDTRLDMNGHSQTVGKLNGAAGSVLNINGGNLTLTDDGVSAGTLTGGGFLNISGGVLDITGGNHTFAVSTIIAKDATVRMNDVSGLGTGNISNAGTLSLTHASGLLSNNLSGSGTVSLINSDTQISGNNSNYSGLFVVDTSSQLTATGAQNLGIASVSNRGILQLNNTTDWQLINNVTGTGNVRKTGSGSLTVRSNAAWSGQTDIDDGSLILGQSDAPVMLASSLVNIAKNGKLTGFGGVVGNVTNSGSLDLRSAAPGNILTIGGNYTGNNGTLLINTVLDDSSSATDKLVIKGDASGKTRVAVTNVGGSGANTLNSIEVIHVDGNAANAEFIQAGRIAAGAYDYTLGRGPGSNYGNWYLSSSKNTPEPRPDPEPTPEGHDNNLRPEASSYTANIAAANTMFVTRLHERLGQTQYVDAITGEPKATSMWMRHEGGHNRWRDGSGQLKTQSNRYVIQLGGDIAQWDWGGTNRWHLGVMAGYGNNHSSTGAVRTGYHSKGSVNGYSTGLYATWYADDETHNGAYLDTWAQYGWFDNHVKGDGLPGESWKSKGLTASLETGYAWKIGEFSSNYGNLNEWYVQPQAQLVWMGVKADELYESNGTLIESTGDGNVHTRLGVKTWIKRLNKMDDGKSREFSPFVEVNWLHNTRDFGVRMNGEPVYQDGTRNIGEVKTGVEGQINPHLNLWGNVRVQVGDKGYNDTSAMLGVKYTF

SEQ ID NO: 2378 - protein, 692 aa, Algoriphagus sp. PR1
  misc_feature (11)..(11): Xaa can be any naturally occurring amino acid
  misc_feature (18)..(19): Xaa can be any naturally occurring amino acid
  misc_feature (588)..(589): Xaa can be any naturally occurring amino acid
  misc_feature (684)..(684): Xaa can be any naturally occurring amino acid
  misc_feature (686)..(686): Xaa can be any naturally occurring amino acid
MKKTFSIRQHXLAVCLRXXTGISHKRTAVLDEVSVVSSGSMYKMGEVPVHQAKSAVAISREDLDKQDVKKADEIGRYQAGFANQVFGNDTNTNWFRVRGAEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHTDGEWKDTDNKTVYIAPSLEWDISERTRLSILTSYQKDSGTPSSNFYPQEGTLRALPDGSYYSRNLNFGDPVNDHEENKQYGIGYELSHDFGNGLRANSSYRYNHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIAEKYLLGFGIRHDRARQNEYTSDQTVKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQADVNLTENWNATLAYTYTKAESKAATGEXXRQSLIPTNALAARTAYNFTDGVLNGLTVGAGVRYLGHSVTSKGSLYSHARLPSATVVDLMARYNINQNWSAQLNVDNVGNRKYVASCDYYCYYGXAXVKSMPQ

SEQ ID NO: 2379 - protein, 803 aa, Algoriphagus sp. PR1
MKNFIPKGGLYLSFLCGVFQYPYTVLAADKNNITVNNGDAIIVTGTRETGKKASESISPIDIISAKQLTQTGMPSLRDALTQLLPSLSVPNAGFDSGALTDSLSLRGLNSNETLVLVDGKRRHTTANLSAVAGPQQGTTPVDIDMIPMAAIDHIEVLRDGASAQYGSDAVAGVVNVILKKQDHGFHAQTLTGITAAKDGFQQGVYLDGGTKLGSRGYLHVSGDFLHQNHTYRSSKDLRTNSKDKFLGQPEQTRESFAIKGGYEITDNIEAYGLVTYAHRYAEANEITRLASTLTDYPAYAAIYPNGYLPVDTINENDWEITGGLKGQIKGWNWDVSSVYGRDYDSIGVKNSANLQLSKDTGLAPTNFKNAQRFNNQQWSNSIDFSKAFHINGWPHVINVAGGATHRYESYTIGAGSFESAYGSGSEALPGIPAQSAGKFSRNVFGGYFDVATHLVKQLQIDVAGRYEHYSDVGDTKTGKVALRYDPFKWLGFRGTISNAFHAPTLAQEYYSAVTFYPTQAGGIISPSSVGALANGSEKLKPEHSTNITAGVTFEPIKRLHITADVYQIKLRGQILPGGNIYGDQASSALALDGFNLPAAAASWTPASIYAHWFANVANTRTRGIDITASYPTYLGDIGHIDWSVAANINRTILTHQGKDADGNDLLTKQSIAYITSAYPRSKIIWGGQFTSGDKKWIVGLHEIRWGHTTSQLSYYGGAANTNLLSNYEFFPFHNRVKYTTNLDITYRVNAKLALTAGANNLFNRYPTRLPLAHRYIGIHKYDMNTSQLGMNGGFYYFKVDVSL

SEQ ID NO: 2380 - protein, 781 aa, Algoriphagus sp. PR1
MFMFLVGLFSANACPVYIHIEDNLGNPASGFTILVNNKPMGTSNNSGILELSLTDGNYTIEIVKNDLIKSRQTVSVACGQDNHFTFRLDSSNSESANLKEVTVQNKSVKKQIEESPFSVQVIDFKKQYDKAGDVGDFLNRASGVKIRTNGNIGSQVQVNLGGLQGKAVRIFKDGIPIELFGHGFSLGTIPVNMLDRVEIYKGVMPVYLASDALGGGVNLVTRTSNKDFAEVSYEVASFNTHRATANLYLQNKKNFYGGFNGSFNYSDNNYKVRVPIENVERDVKRFHDMTRSNYGEAFIGLKEKSWADDIRLTLIYSDFYKQIQNDAGMVSVYGKAFSKEQNYTGMINYRKKFFNDKLKVSFLTNYSHFNTKFIDTTRLRYNWLGETYNLKFQPGEIRTGNDQRMKFNFVSSRLNMEYELSDRNFLEFSELYYSQRRKGSDPLGAVSIVTGIDVLTVPATYRKDNMAFAWRSLFLDKKLESIVAAKYYHYNAEGYTTDKFGFAWQSSKEDSQFGYLGGLKWEQNNYLLKFSYEYATRLPDEYEIFGDARLVKENLDLNPEKSHNLNLSGQYSILKENSSLTFSANLFYRKVQDIIFLQLDIPFNRYINYENSTVKGFEFETNYAPVKWLNIGFNMTYQDLRRIESESRYAYLNDSRVPNIPFLFGNFWANTFFKNVFKNEDSLNFTWNANYTHRFFLVEIPKSQEPSLFGPVKDFQTSLIIPDDGRIGQFSNDVGVYYHFADKKTTVSAECRNVGDVRLYDNFNVQRPGRSFHLKLVYNFF

SEQ ID NO: 2381 - protein, 209 aa, Algoriphagus sp. PR1
MKKILLITAAVLVSVPAASAADLAPRPYTKAPPYVPAPIYNWTGFYLGGHIGGAFSNGRDGVFLGGVQSGWDLQFAPNWVFGLEGSYSFLDSGIAGANLGLGSATARLGYTWGGPALFYVKGGYGTAVLRGNNAIFGINPNIGLDGYTVGAGLEYMFTQNWAGKVEYQYFDFGRIAGTNINLDTHTVKVGLNYRFNLGAPAAAPYAPGY

SEQ ID NO: 2382 - protein, 706 aa, Algoriphagus sp. PR1
MLFKYSVLGLAVGSALMAMPVLAEVASDANIERINVTGRTFNDYKVGTASGAMRGDIDLMDTPQSVNVIPDFVTDEQLATNLAEVLVNDSSITAGTQRWNRQVFSIRGFELDSGNGYLINGHQQWSHYVQPIETLQQVEVLKGPSSMLYGQSGPGGLVNMVTKKPTYDSMLNLGFDTDGYGSTRAQLDAGGSLNEAQSIRYRGVLVKQDTKYWREYSANDENQERDRWLGYLNMEFDLSDDLLLSVKYDHTQDKADIDAGGWLDKQGNVIGERKTVWDAPWAFTDNTVSNLGADLTWHMSDNWKVKAGYNDQQFNRQRFDSAPSLIEGSEDPFKDGYKIKPFDRYDDWQHKTAYADFTGEFALAGMQHQLLIGANYLDYFYQQQIHRGAAQTVIPGQPITQPALDYHTKPKGNASTYKYYGFYLQDLMTLNEQWKLLAGVRYDEQKKDAIGGNSYAVSPKFGVIYSPMANGSIYINYSKSFTPQGSVTSSEDVNEGDNLKPEYGTQYELGTKWELFDDSLLLTAALFDITVSNVTIEQDIPETSDGKKTITTQGGEQHHRGFEVGAQGQLGESWFVTSSMMYLDAEYKTGAGKIDGKILDGKTPVDAPEWSANIWTRYEVTDNFAMNFGAIYVGDRFADKDNSITKGGYVRFDIGAAYTMDIMGKDVSLRANVRNLFDTEYLDGGSDKMVTIGQGRNFSVAVEAKF

SEQ ID NO: 2383 - protein, 835 aa, Algoriphagus sp. PR1
MSKRFGPKAFLMGGAALSTLVSLCPPVSGSSALAKTPTHSTTKPHRHPTGPTSTVTPGHTISPARRTSIISRSGPEEMRVTGTTPTGQSVMNPSTPVHSTTQVTVVSGSQLLATGQTNVMQALAQASASITSPPQSGVGNSGFIQTMQLRGQSADDTLILVNGHRRHIGANFNANAGPNWGTEPTDISLIPISAIDHIEVITEGASALYGQDALAGAVNIVLKQRTHGGSINFQNSGFYAGDGQALNGYADWATALGKNGGYLDLAAQVTHQLPTNRSGLFVGQLYPVGDSRNETASRDVQRGLGIPKSTLETLSENMSVPLGENLNLYSTSTFSHRKAHVAETYRSAGNSLTDINLWPNGAQPYIGMDQYDFETDNGIKAHKFGFAWDAYVNYGRDDQAYSTLDSNNISLGDASPRDFYDGKTITSELSTGLRGSRFFHTSWLPKPIALRFGGEYRRDTFQMTGGEEASWIGLGATDHAGNVPLAVTNRGRDIYDGNVNLDFYVTKKWEWSLGGRATSYSHLASVTTGSIGTRYNFNKHWAIRASINTGYRPPTLGQTYYFYNAPFANYAVDQLPNSSNAAKALGAGHIKGEYSRNYSIGIDATPLKDWNVTANLYYIAINDRLASTTTLGGTGVADILAASGLNNVTYASYYTNPVNTQTYGGDVDTNYTLHTKRAGTFRFDFTFNYSDNEIRSRNKTPSVLANMGLSTFNTYAEEMLLHSAPKNRENLTVNWNYGKWNVMVQEQRYGSIIFLASPTAAPMEQRPAFLTNMSVSYKILPKWSVTVGANNLGNKYPTRVPKATAAPLFNEYKYAYYSPYGFNGGMYYIQTGLTF

SEQ ID NO: 2384 - protein, 1039 aa, Algoriphagus sp. PR1
MKPNLFHTQFFRLFFLILLAGISIQTYAAKDSQAAPKKRTITGTVISEGDNMPIIGANVWLKNSSTGAITDLDGKYSITIDNSVVGGVLVFSYIGMSTQEVAIGNQNVINVTLKFDTEKIDEVVVVGYGHQKKASVIGSISTIDMAGVKVPGSSISSVLAGQLAGVVAMNRTGEPGKASAADFYIRGVSSFTGGNTPLVLVDGIERDLDLVDVEDIASFSILKDASASAVYGVRGANGVILITTKKGAEGKPVINARVEAGFTQPTKMPEFVNSAQWAELYNEMKGYEYYTPEQIGYFQNGTDPDLYPDVDWMHELYKNMASNQRVNLNVSGGGDICKYFVSGSLYNEGSIFRNAGQRYDYDTSLRYNKYSFRANMDFNVTKSTVLNVNLANIYEKFYGPGVEKDKIWSRAFEASPGVYPKEYSDGTLSYPSMQGGENPWNLLVHSGYREQFWNSAQSLIGINQDLGDLVTKGLTASIKFSWDAVNTNTIVRSKTPNQYYAKGRDEDGNLIFGSPIVTGTDELGLSESGSGSITTYLEGSINYNRLFAEKHRVGAMLLYNHKVTNKKLTYSKTLSLPYKYQGLAGRVTYAFKDTYFAEFNMGYNGSENFAKGHRFGFFPAYAVGWMISNEKFWEPILPVVSELKLKASYGSVGNDAIGGDRWIYQSTISTNNGWNYGENGSEGGGGIQVGNVENLNVSWEKAYKTNLGFEMRLFDRIKIQADYFHEKREGVFINRQGLPAIVGLTTKPKTNIGASVNRGVDATLEYEEKVGEVFLTGRANFTFNRNKLLNNDEVEHLYKYQNSIGKTFGTGGNHTFGLIAEGLFQSQEEIDNAPEQNFGTYRVGDVRYRDVNGDGVVDTYDKVALGYTNIPEITYGFGLTAQWRSWDINAFFQGIAHCTFYIGGTAMRPFSTGNINQSAINADIYDHVWKTTNTPEQNLAAYYPRLSEAGGEGSTNNNQTSTLTMRDGRFLRLKNFEIGYTIPKSILEKTFIKSTRIYVSGSNLLTFSKFKLWDPETGSSDGGIYPPLRVFTIGLNAKF

SEQ ID NO: 2385 - protein, 1040 aa, Algoriphagus sp. PR1
MRKILKGMLTLFLAFIVQLAIAQEKTVTGTISDSSGSLPGVSVLVKGTKVGSETDFSGKYSISAKKGDVLIFRYLGYKVVEKVIGNSNLVNVLLEQKIDSLDEVIVIAYGTTTKEAFTGSASVITTADLALRNVTSPIAAIEGKATGVQFTSASGQPGSSPGIIIRGVGTLNGSSDPLYIVDGMQYEGALNTINQNDIASLTILKGGASTSLYGARAANGVVLITTKSGVKGKTRVNISSQFGMVTRGVSAYDYVNPGEYYELMWEGYKNSLSGSDTAAQASAGIYSRLGYNPFNVPNDQIVGTDGQLNPNAKVIYKSLDWYDALDQVGARSNHSVSIASGGDNHKVFFSTSYLEEEGYVITSKFDRLTTRINADFDVNKWLSLGGSANISISESKGPPSRGGSIANPFGFAKNMGSIYPVYMNDLEGNLILDASGNPIYDVGEGDFSLNQGSRPNNPGRHAIAEAILNDELNRDNTYGFRYYAAFEIMEGLNLRLNYGRDINEGINKSYENPIVGDGQPTARYGETRFRRDVQNISQVLTYSKSFNDVHNFDLTLGHESYDRAFSSNNGLSTTETASGIYEFDNFAIPVRVGGSSTKKTVEGYFGRLNYNFDNKYYISGSARRDASSVFSTDARWGTFYSVGASWRLDQEDFIKNVPFVNRLKLRASYGQVGNDNLGNFFISQPVYTITSNAGAPALALSNLGNNELTWETVGSYDVALEFSLFNNFLEGSVEYYKKNSTDLLYNLPIPLSNGINTAPFNTGDIFNSGVELGLTGHLINNKDFKWDLTLQGSTFKNEITDLPDPFVSGSKRWEEGRSRYDFFIFQSAGVDPANGDALYFKYKDNEDGKRVPVLDAEGVHETTNDWQDAERAYADASTIPDILGSVSNNFSYKGFTLDLLFTYGIGGDFLDNGYSAMMHSGSFGDSYHPNALNAWKQPGDITDVPRLEVGNTEQVQTQSTRFLTDASFLALKNANIGYTFDETVSDKLGVKTLKLYVAGENLFLKSKRTGLDPQYNLAGTGSGNDYNPSRIITFGLNVSF

SEQ ID NO: 2386 - protein, 404 aa, Algoriphagus sp. PR1
MRKVLLVLCLALCPLQAWAAGYGVYEWSARGNALGGAMVARDADPSSVAYNPAAITDLEGAQIQMGATAIAPTAKMTSNTPGKRDAEFSDSIWGLPTFYYTQQLSDNYWFGFGMFSRVGLGTDYKDTDTWPGRYNCSYAAIHSVSLNPNLAMKLTDELSVAFGLDATYLRFMYDTTISPVDVMQQIDADGWAYGLNLGARYKPYDWLAFGVAWRSEMQLTVNGNVDFTQKGAVPAPAARDVRGTEPIPESITFGVMVKPFDKLSLEVDAVWTRWSAYNTLVINYDPALYGKSSVSAEKNWKNTWRLQFGAEYALTDSIDLRAGYVYDQTPVDDAHEDYAVPCSDRQIATTGIGWKINEAWVLDASYSYLWMTDREYEARSGGIYDSTREDAHAHMAGLSLTYKF

SEQ ID NO: 2387 - protein, 521 aa, Algoriphagus sp. PR1
MIERRRTRILGQETIRRLLSEATRAALARRPARTGFARRAGMPFAATQSLITSYDKSDVRFTYDLGGPGATDNDITMINGNDQSFKQVSQELRLQSTGKGPLRWIAGFYYFHESSLLGQNMGFGPFNGGTGAGGAAALLLLAGDPYSNQAAFSIARLKNEVLSPYGQVEYDISRKVTVSFGLRYTDDKKRAPSLFVGNVGTGTLGRDQFRSNEVIGSLAGGLPLCDLDGDGNLAGGTPDNRGKPCSQILSPDDIRAKEWGGKVGIDFKLADDTLLYVSASRGFRSGKHDIEFFHGPQTGFAREDQQVETLDAFEVGLKSELFDRTLVLNAAVFYYIWKDQQFFDVNPNTGPVFINVPESQLKGAEIELRWNPGSGFSAQLSGGFLDSEVTDAGTDPSGLVQKGHALPFAPKYSANALVAKEFEIGDNKLRLQADLQYLSKSKGFLRDVNYVDAIGSSVFLNTRATWSFGADHRYDLSVYATNLTGQTRCEYKRDLFAFSGAAYCLPNSGRTLFGAEARVKF

SEQ ID NO: 2388 - protein, 587 aa, Algoriphagus sp. PR1
MKNFSPLYCLKKLKKRHLIALSLPLLSYANGFKIQEQSLNGTALGSAYVAGARGADASFYNPANMGFTNDWGENRSEFEMTTTVINIPAFSFKVPTTNQGLYSVTSLEIDKSQQNILGIINTIGLGNILKALGNTAATNGLSQAINRVQGLMNLTNQKVVTLASKPDTQIVNGWTGTTNFVLPKFFYKTRTHNGFTFGGSFTAPSGLGMKWNGKGGEFLHDVFIMMVELAPSMSYTINKRFSVGVGLRGLYATGSFNNTVYVPLEGASVLSAEQILNLPNNVFADQVPSNMMTLLGNIGYQPALNCQKAGGDMSDQSCQEFYNGLKKIMGYSGLIKASANLYGTTQVVQKSNGQGVSGGYRVGSSLRVFDHGMFSVVYNSSVTFNMKGGLVAITELGPSLGSVLTKGSLNINVSLPQTLSLAYAHQFFKDRLRVEGVFERTFWSQGNKFLVTPDFANATYKGLSGTVASLDSETLKKMVGLANFKSVMNMGAGWRDTNTFRLGVTYMGKSLRLMGAIDYDQAPSPQDAIGIPDSNGYTVAFGTKYNFRGFDLGVAGSFTFKSNRSSLYQSPTIGQLRIFSASLGYRW

SEQ ID NO: 2389 - protein, 898 aa, Algoriphagus sp. PR1
MLFPRSFQWSVESTCTAAHRQPPRRVPLSAAVRALLIGGVTVSGALALPALAQQQPAAAPAQPPSPAVAQDAAPTNPSVSTLDEVKVVGYQASLGKALNVKRNADAIVDAISAEDIGKFPDTNVAESLSRLSGITVDRQFGEGEKVSILGTDPALNRVLLNGQTIASTSWGGDPNDPDSRSFNYSTLAPEVVGLMEVYKTPEARIDEGSIGGTVIVHTRKPLELERNTLTGTVSYGYNDRSEEGKPNASALYSWKNQDETLGVLTSVMHSQRVLRRDGVEIFGYDDVAGAGFPAAVVGNNTGVFPTSINTALFQQTRKRDGVSAALQWKPDADFELNLTGLYVKESFDNYNQSRYGYWGSTPGDAQALGFENGIATSGTFGDQSTTFLDGYLRNSEVSTGSIHLRADWHGDGWNASSQVGYTSSQGGAERIYGIQFRNLAGYSYNIDGRRTAMDYSTDPTNAAAMQLNNASASHSPQYDKERYLQLDFDHAVEWGPFTQILTGIKLTNHATGQSSYSRTWNPNDGSTLAAFSPGTTPSGYLDGLSTSADMQRWSTINSGAISQYIGGLEGDEGLPISYAGNYSIEEQNRAWFLQGNFSGERYRGNIGVRYVHTRDSTDGYSYAPGGGYTPVNFLSSYGKWLPAFNIAYDLRDDLIMRFAASKVIARPRYTNMTPYVATDDTTLTASTGNPGLSPYESTNLGASLEWYFTDSSVLSGEFFSRDISNYILTTVQDRVFFNNATGGSSTYQTSVPTNAGDAKVRGVAVNLQHNFGNGFGVVANYTYSDSNTDGDYSLPYNSRNAYNISPYYEQGKWSARVNLGWRSEYFTQIGRLNGQQMTDAFTQVDASVGYQATERLRVALEATNLLDETYFSYIGNKNQPYYLYKNGRAFMLSLNFKL

SEQ ID NO: 2390 - protein, 224 aa, Algoriphagus sp. PR1
MKKLLLIATTSATILSSSISFADDMGNEWYLRVDAGAAMFNKEQDKATSVKLKSNTTVPVDLGIGYYIFENFRADLTLGTIIGGKLKASGSATHAPFTGTNVSVSHKPTITRLLINGYVDLTNFDLFDVFAGAGVGPALVKEKITYNGITGLSSNTKNRTNISYRLTLGTSAQIADGVKAELAYSWIYDGRTKSKNVIYQGTSVLTGGMRYQSHNLTAGIRFDI

SEQ ID NO: 2391 - protein, 169 aa, Algoriphagus sp. PR1
MYTSGYAHRSSSFSSAASKIARVSTENTTAGLISEVVYREDQPMMTQLLLLPLLQQLGQQSRWQLWLTPQQKLSREWVQASGLPLTKVMQISQLSPCHTVESMVRALRTGNYSVVIGWLADDLTEEEHAELVDAANEGNAMGFIMRPVSASSHATRQLSGLKIHSNLYH

SEQ ID NO: 2392 - protein, 882 aa, Algoriphagus sp. PR1
MWGRMRTGNELLSCLCLGAVLSILIAHQSARAEDQQKVTHSSIVQSNKLAQTPATGVITGVELNLTNQELEIILQTKNADKLETVNRSEGNSFIADIPNAQLNLPSGREFRQENPGSGISLVTVTNIDANTIRVTVTGETSLPKVELFDNDESLIFAVFLPDSTRTNISPTPTPPTSETPSEQPTADSDDPIELVVTATRREEDIQNVPRSVTVITREQLEQQTTVNRDLTSILGNTVPGLGASAESQQSFAQTLRGRPPLILVDGVPISSNIDNDTSVANLRRIDVGAIERIEVVRGPSAVYGDGAAGGVINIITRRPDQDRVVSNAEIGIRSVGNFKSGSFGNFVNYGISGQQGGVDFIASFTRDSFGTPFDAEGDRIPLFGDAEANSASINVLGKLGFQLGSEQRLQITANYFNDDQSNDVDYDLTVGQIPGIQKARALDQPVEFINSTNPFNRGTVIQLDYTHNNILNSQLQAQAYYRQTKTAATLFDNRIFDPDSILDIGRSVVTSERFGGRLQLDTPLSSNLNLLWGADYSSEDSKGDYDLFDVDEFDNSGRRIARKIGSSIRIAPFTIQNLGLFSQVKWEASENVSLSGGVRYENINVSVIDNWVDGQTALSYRGGEKTLDDVVFNAGVVYKATPTISLFANFAQGFSLPNISRIVQRPQPGFNFAEDVELSAPQKVDSYELGIRGQWRNFQASLAGFYSYSSLGTTVQFEDFGSDFRILRAPQRNYGIELAVDWQPSDKWKLGSTLTWSEGEREDSETGEFVAITGYEISPLKLTAYLENETLPGWNNRLQALYIGNRDRAFDAGIDPIGIDSYLVMDLISSLKLGNGTLSLGVRNLLNNQYLNVVSQINGGYDDSYAVASRGRTFTLNYRWSW

SEQ ID NO: 2393 - protein, 546 aa, Algoriphagus sp. PR1
MYLFLLLTIAGVPLRAGAADWRTLTQPVGTQNTPFLVDPALLNAGYAAGRGPWALTTSVTSITTTTPQFFIRFYNPSASSNASGQEGSWVMRISSVRGLSAQKIRNFFALPNTPSMMTLGLSVTGESFYTGLAGPIEGWGDGGGQQSQANGGPYTIFFNAQPVPEAVLYWPDMADTDNSRAVATYLAGDTPAAYSDMESVYNTLDVLCNPASRDLFNSALGTLTAQRFDNLASSAYYAVELHNQAIDDRIDRFAVRSSMPGFWIKAARSFQHSPDSGYDGDINAMILGFDQKSSDRTLSGISLAWMHGSVYWADNGGQAVTDYYRAAAYSAVVIDRAFLQGEVSVGSTADETSRNITIGTLYLPSPHGPLLSPLSGIARTATADYKGWNADIGLRAGVLVNAGMLNIRPSFGFGWLYQSRNSFTETGAESLNLTVAAAHTETLHCRADVRFERAITMHEQKTITPYVVIGWACAGRLDAQEVRASMNGRSDSFTTSSATGGAQMFTGRAGIETALSKELFFVAECFRQAQSGDRQSGFALAMNYLF

SEQ ID NO: 2394 - protein, 323 aa, Algoriphagus sp. PR1
MTKYSVPLMIAATAASFSAFANNDDSLTVYGRANVSFQSNDYGFGSETEVVSNSSRFGFKGASELESDLEVFYQIEFGVDLADSDDEEDAVTNRNQVVGLRGNFGEVMIGRYDTFLKDSQGSVDEFKDFEADLKSLFKGENRPDNTLTYYSPSYKGFSFGVTYIASENDNVDDGLSFGLLYGDSKLKKTNYYAALAFDRDVNGYDVTQLTGATKFGKTRVGVVLQQFETINGSNDSDGYLISAAHPYANWVFKAQYQAIDDDTDNDASLSVGADYFFSGDTRVYAWYTGRECDISLYSTKGCGATPGIEQDFVAVGIRHDFSW

SEQ ID NO: 2395 - protein, 314 aa, Cyanothece sp. CCY0110
MLKFKYGLIYIALILGLQATDYDNLEEENQQLDEKINHLKQQLTEKGVSPKEMDKDKFEEEYINRSYPKISSKRKEKLLKSFSIADDKSGVFLGGGYAYGGLNLSYQGEMLDRYGANAPSAFKNNININAPVSMISAKFGYQKYFVPYFGTRFYGDLLLGGGALKENASKQPVGSFFYVLGAMNTDLLFDMPLDFKTKKHFLGVYAGFGIGLMLYQDKPNQNGMNLVVGGYSSPNFLWKSLIEVDYTFNVGVSLTLYRKHRLEIGTKLPISYLRMGVEEGALYQNKEDDERLLISANNQFKRSSFLLVNYAFIF

SEQ ID NO: 2396 - protein, 1059 aa, Cyanothece sp. CCY0110
MWILLLATSISFSQIKISGTVTDKSSGMGIPSVAIATSSENGTTSDINGSYTIFVTDNNQVLTFSYLGYKTQKITIGTQRIINVQLEEIETNLDEIVVTALGLNRKTKELGYVVQELKSKEVTSVKTVNFLDNLAGKLAGVTISQGATGVGSSSKITIRGEASFSNNNPLFVVDGTPINNNSVFNFTNEAAAGFQEIDFGNGAMEVNPDDIESVTVLKGPSAAALYGTRASNGVIVINTKDGSKKQGLGVSINSSITFDSAFRLPDFQNEYGQGNSGNFEYVDGLGGGVNDNITYSWGPRLDAGNLIAQFDSPVTLADGTVVRGGDTSLYSGNTITPTLFQSNPDNLKDFYQTGVTTINNIAINDSFERGSYRLSITDLDSESIIPGVNLERKTAALKLNFNPSEKTRITSSVNYVNSSSNNRPANGYGSENANYSLVAWGPRSLNIDSLRDYWQPGLEGVQQYSFNYTFFDNPFFILKENTNAFNRDRVFGNIAVKHQFTDNLSVSLRSGMDYSSEKRELKRNFSSNRFKNGAYAEHDVFYREVNTDFLVNYNNTFGDVSFDVSFGGNRLDQNASTKQTQTTNLAQPGIFSLNNAASPLEVFEFTSKKRINSLYGIAKFGYKDFLFVDITGRNDWSSALATPFSIDGTSFFYPSVSSSFILSNYTELPSAISFAKLRASIAQVGNDTNPYQTSGAFVSQTPFNGQPTFSNQEFIPNSNLRPEITTSYELGADLRFFKDRLNIDFTYYNATTKDQIISLPIPISSGYNQQVINGGKVNTSGVEIILGGTPIQTENFTWNTTFNFASNKSVIKDLPQNDGRLTLAYSRIYNSANQTVWFQVEEGGQIGDMYGTGYEKNAEGEFLLDDNGRYIANNDLIKIGNYNPDFTLGWNNSFRYKNWNSSFLFDWRQGGEIVSRTRALGNVGGQLAETAFRPDAGIVAQGVNINTGLPNTVAVTAESYYRQFYDRNHEENNVYDASFLKLRQVSIGYVLNLEEGFLGLKDTSSMSFSFIGNNLFVLTENPHFDPEQLAVQGNGFVSGVEDMSYATSRSLGFKVGFNF

SEQ ID NO: 2397 - protein, 583 aa, Cyanothece sp. CCY0110
MWKLFSQCLKMTSGVAALSVIAAQSAIAAPDESQMNTTQGDVMSPDEALGILQNRPTLKTPLNRDTSKQFTDATTGNGMSQVTSISELRDVSPTDWAYEALRSLVERYGCIVGYPDRTFRGNRATSRWEFAAGLNACLNTMERLIQENVAVLREDIERLKRLAQEFEQELIALGARVDNLEERVAFLEDHQFSTTTKLSGEVLFTVSSASGERAIDSRQRDLFEQGMLDPAARRRIDDNATLGFRTRLNFDTSFTGNDRLRTRIETGNIVNYSPATGTVMARLGHDIFNDADVAIGDLYYRFSVGELTTWVGTSSLDIDDIFDVGTPFLASSGTGALSRFIRRNPLVFRGPEGIGGGFSYNMFNDLVAIRGLYLSADGNSPDLGEGLFNGSYSAGGQLGLYPTDSLDFTFTYLLSYFPEGDVNTSSSNGSRVASDPFLEAPTLRDSYGIQGDWRINEMFHLTAWGGYALARAQGQDEDGVDRSGYGADLWTWSAALSVIDIFKEGAVFSVAGGQFVTAERIDAYPGDLRVPDKDTPYIIEAQYQYPLNDNILLTPGFYVVINPEGDEFNNSIWVGALRTTFKF

SEQ ID NO: 2398 - protein, 586 aa, Cyanothece sp. CCY0110
MWKLFSQCLKMTSGVAALSVIAAQSAIAAPDENQMNTTQGDVMSPDEALGILQNRPTLKTPLNRDTSKQFRDGTTGNGMSQVTSISELRDVSPTDWAYEALRSLVERYGCIVGYPDRTFRGNRATSRWEFAAGLNACLNTMERLIQENVAVLREDIERLKRLAQEFEQELIALGARVSNLEERVAFLEEHQFSTTTKLNGEVLFTFSTAAGERAIDSRQSDAIDNFGRAMPNATRRPDDNATLAFRTRLNFDTAFYGKDRLRVRFQAGTIPRWDRATGTTMARLGHDASTDADVEFDDVYYRFPIGNFRGFVGTSALDIDNIFDVGNPFLASSGTGALSRFVRRNPLIFRGPEGIGAGAEYKLFDDLFVVRGLYLSEDGNSPDLGEGLFNGSYSAGGQLGVYPTDSLSFSFTYLLSYFSEGNVNTTSSNGSRVASDPFFDAATLRDSYGITGDWRINDTFHLYATGAYALARAQGYANPANGDDRRGLGADLWTWTAILSMVDLFKEGAVLSVGGGQYVTAERVETLPGDLQSIDKDTPYIIEAQYQYPLNDNILLTPGFYVVINPEGDEDNNSIWVGALRTTFKF

SEQ ID NO: 2399 - protein, 175 aa, Cyanothece sp. CCY0110
MLKDLFGLFILVLLVSAPVFAKEQDPFVAGGVTFMDDHEVLSVEIGAEVLPNLNWSIGFNAPLDSGEKEENGIYSAEKQVWGLHTALGYEIRLSDMLAITPRIGVNYNDVEIEYFNEETSEHVESLNQNNITPTLGVKVDIARVGLIVEGYKIDEDLSLSEEEETAIRVMAAYNF

SEQ ID NO: 2400 - protein, 583 aa, Cyanothece sp. CCY0110
MINRCFFFNNVILVLGMILFSTSPSQALPTQDLSLKESRGDFLRRQGTVSLEKEETSPLPQLPKIDRDFHLRQSRDGFLNPGSRQQRSMSQVTSVSELQDISPTDWAYEALRSLVERYGCIVGYPDRTFRGNRALSRYEFAAGLNACLNTMERLIQENVAVLREDIEKLKRLAQEFEQELIALGARLSNLEERVAYLEDHQFSTTTKLTGEFVVGLTGITSGERNGGTEEINKITNFGYRGRLELNTTFDGNDLLYTRLATGTVPAYSDITGTFEGELGFSQPDDSDLAVELIIYEFDLAENIRMFVEPVGGAFDDFVPTVNFLDGDGAFGAISAFGSRNPLYYMGEGPGIGFQGRLFEVFEWSGGYLATDGNDPSLGAGMFNGPYGLIGQFAYEPSDRLKVAFTYVHGYNNLDSGTGTLRSNFQTFVEEEFEESVNTVNNSYGVEFTWRIFDRFVLGGWGGFTSTRTLNAIDAGDEFDVIQRGKLDIWNWAATLAFPDAFKEGDTGAIIVGMEPWVSKADINFPDDVRRTDQDSSFHIEAIYQYPINDNIVITPGIIVITEPDFDDRNEALVIGTIRTTFTF

SEQ ID NO: 2401 - protein, 921 aa, Cyanothece sp. CCY0110
MINQRTTRRDWLMASAASTLALSMTLAAPASAQDDADDQASDVITVTGFRSAIENSIAVKRESTSIVEAISAEDIGRLPDNSIAESLARLPGLAAQRLRGRAQVISVRGLGPDFTTALLNGREQVTAGDNRGVEFDQYPSELLSSVVVYKTPDAQLVGQGLAGTADLRTVRPLDRDEQTIALSARYEWNNYGALNAGSEDSGHRLTGFYIDQFADDTIGLAIGFATQSSPTQSERWDAWGYPTVGAGDLLLGGAKPYVESRELERTAFVGTLEFEPNANSHTTIDAFYSQFEDTGILRGIELPLAWSGASLQPGYTTEDGLVTAGTFSGVQGVVRNDTRFREADVMSFGINHEQTLNEHWTGSLDLSYSSVSRDDTDYESYAGTGSGYGTGASDTMAFELGGSGGFVFGSSLDYADPSLMLLTDPQGWGQVGFIKRPSTEDTLTALRVEAEREISQGFFSSVEVGLYTTDREKTKRSVEDFIDLANGGATNTTAIPSNLLLEPTSLDFIGIAGMVSYDPISLLNSGVYSLRPNLNADVLTKSWDVEEQQVIGYLQANVDSFLGDTPVRGNFGLQIVHTEQSSTGPRAGQGALLSYTESESYSHILPSANFSFEVAENTFVRVGAARTMARPRMDELRASQEIGINNQVCTTNDGTGNPAFNAANYDIAGGQSCLTVSGGSPRLRPVTADAIDLSVEHYFADGGGYISAAIFNKDIDNYVFGSSARQIDMTDAANAIFDSAFIAANPDITTGILYEPVNTDGGYIRGIEVATNIPGDAVAPWLDGFGLLASYSYTESEVQPDPNQAPIAIPGLSENVGNLTVYYERGGFEARVSNRWRSEFLGEVTGFGANREFRNIEAESVIDAQIGYEFGPGQFEGLSIFAQGNNLTDEAFVSYLNDDPRQVKDYQQYGATYLIGFSWRR

SEQ ID NO: 2402 - protein, 724 aa, Cyanothece sp. CCY0110
MKLNMFCTTRLYRCVQLILGTGVTTFAVVAHATEQQTQQLSTITLEAEHVDSLYNRKNANLDGFGVQDIAKIPASISVISTERIADQQAKVLTDVIKNDASLGDGYAAIGYYPNFMSRGFGLALGSSYLMNGFVIRGEQNVALENKDRVEILKGISAIQSGMSTPGGVVNYVTKRPEDIHAVSMGVNSEGGASIGLDMGGFAGSDQRLGYRVNLAQEQIHPYVEHANGKRLFGSVALDLQLDEKSQIQFDIESQRQKQRSVPGYQLLDGTTVPTDVTWDRLLGYQSWSKPVTNTSLNSSLKYNYQINSDWKASLGAAYSHVKIDDYIAFPYGSYKGLKPIENTFDENGNYDIYDYRNPDDIRITTQFKSTLVGQLQTGELVHHLNFELAKTLKSQKRYVEVNIPIGTGNIDQETNDFDPAAEDLGNRYKPLESDQVSFALSDRIEFNPQWSTLLGGKWIHLNERAYDAESIENRHTQIDKFLPQLALMYSPFESTNVYVSYAKGLADGATAPWYTSNSNEVLAPVNSTQYEIGVKQQYKNALFTLALFDLKQDNQYVRPNDDGTSTFVSGGKQHNQGIELNVQGRITPHLDLISSLALIKSQWEDSGVDIYENHQTQNVPKLRFATHASYQVAQIEGLRILGGMQYSASKYANKEGTVKVAGYWVFDLGAAYRFNLYGYDTTMRLSVDNLFNKKYWRDVGGFMGDDYLFLGAPRTAQFSINFKF

SEQ ID NO: 2403 - protein, 314 aa, Cyanothece sp. CCY0110
MLKLKYCLIYLVLIMGLQATDYDNLEEENQQLDEKIKNLKQQLTEKGVSPKEMDKDKFEEEYLDRTYPKLSSKKKEKLLKAYSIADDKSGVFFGGGYAYGVFNLSYQGEMDDKYGVNSPSAFKNNININAPVSMISVKFGYQKYFVPYFGTRFYGDLLLGGGVLKESALKQSVGSFIYVLGAVNTDLLFDMPLDFKTKKHFLGVYAGFGIGLMLYQDKPNQNGRDLVVGGYSSPNFLWKSLIEVDYTFNVGVSLTLYRKHRLEIGTKFPISYLRMGVEEGAIYQNKEDDKRLLISANNQFKRSSFLLVNYAFIF

SEQ ID NO: 2404 - protein, 1118 aa, Flavobacteria bacterium BAL38
MNKKEHKNQAERSSRRLWITLLFFCFTVTGFMQAANAVFAQTTVTATFKNATLNEVLWEVQRQTDFTFVYSTEEVKNVKVEKLIVNHEKIADVLDKCLKGSGLTYTVHEGVIAIKPASKVEAVAAPQQEVKVNGSVVDETGESVIGANVLVKGTTNGCTTDLDGHFSLDVDHLPVTLIVSYVGYIRQEVKVISAKMVKVEMVPDNNLMDEVVVTGYGTFKKSAYAGSASSVKGETLKDVPAISFKDLLQGNAPGVQFTSSSGQPGASSSLRIRGMGSFNASNSPLYVIDGVPMRSGTINTMSSDAGLDIMSTINSSDIESVTVIKDAAAASLYGSRAANGVVLITTKKGKAGKASISLKADWGSSDFAMDYRPVMGGEERRQYIYDGLVAGQIKKGKSEADAMAYADGKIDNYAPVPWCGYVDWDDIMFQKGNHQSYEASLSGGTDRFKYYSSLSYLKQDGIAINSGLERISGRLNVDFRATDKLKLGANVLFATVNQDVYSEGTSYSSPFYTSRNAVVPSDPVYNEDGSWNRDFIRNSDRNPALAATYDYQREYVTRTFNTIYGEYEFIKDLKFKSTLSYDYVNTKGNDWKDPRTSNGDDINGGMSKKFYEYKKMVWANQLSYKMSIAADHHLDALAGYEIDDQYRDYLSGYATNFATYDKNQISNGMKTESVGGSDTRTRMVSYLFRLNYDYKNKYYLGGSFRMDGSSRFLKDNRWGSFWSISAAWRVIEESFMDSVKDWLTDLKIRASYGVNGTLPTDYFGYRGLSSLTNGYLEQPGIIQSQLKNDDLQWETNYNLNLGLDFSLWNRLNVTLEYYTRTTKNLLMDRPISMTTGFGSYLMNIGKVSNKGVELEINSTNIRTKDFSWNTTFNISHNKNEIVTLDGMQTEIIKGTQIRKVGKSFRTFYMKEFAGINPETGAPQFYTNDVDENGNYKKEITEVIDEAHAIVLDKHAEPNVIGGLSNTLRYKWFDFNFMFSYQFGGYSYDTWAQKTEHGGNDLEANIPTYYKNSWRKPGDVTKYELFYEKPNVAMNKVTTTRRLHSTDFIRLKTLTFGVTIPKEWTRTIGIENVRLYASANNLWTWAAYDYYDPEAVSGGTAIWGTPPLKTVTFGVNINF

SEQ ID NO: 2405 - protein, 360 aa, Flavobacteria bacterium BAL38
MKKLNGLFGAVIAVFTVAAHAQSSVTLYGSIDEGVTYTSNIKGHGTASVGPVAVPDFYGIRGSEDLGGQFKAIFALQNGFLSSTGAGTIAGEAFSHFAWVGLSSNRYGALTLGRQLDLTTETLRLDSDGSVQYTFYLFHPANLDNLGIRGDSINNSVKYATADFHGLKAAVLYGFDDTSTQPGRVVSADVIYTNGPLRASAVYSSWRNHSIDVGSQLGYASFLGQSLAKGSVFLAKKQDIGGLSATWSVNQNLALHGVLTQVNLSSDYGSGRMRTVELGADVHTSVANMVTLGGYASWLTGTRYTEVGVGDVYSLSKRTIVYAQAVYQHAQGSGNAAIPLLSPSNSPNQTALRVGVHQFF

SEQ ID NO: 2406 - protein, 833 aa, Flavobacteria bacterium BAL38
MSFAKKDYFAIFLLLSMLPLLMTSSNALAMQDIEFNTDTLDLEDKENINLGYFSRANYLMPGSYSLEIKVNNNNLSEEEVVFLAPEDDPKDSVACLSPELTDKLGLTDKYQKQLTWWHDNQCLNFDSLPGIQAKPDLASSSLHISIPQAYLEYSAIDWDPPSRWDNGIPAILLDYNINGNISRFGKEKRYALNGTGVLGLNLGAWRLRADWYGHLDNNSSVFEQMNNERVIQWNRFYAFRALTNLSARLTLGQDYLNSNLFDSFRFLGAGLESDLNMLPPNLRGYAPEITGIAKSNATVNISQKGHVIHTEKVAAGPFRIQNLYDGVRGKLDVKVEEEDGSVQQYQVDTANLPYLTRPGQIQYKLALGQPNVERDYQRQNFAMGELSFGGGNGWSLFGGAIVSNNYHAISAGIGRDLLAFGTLSFDITQSFARLAEENKKLRGSSYRVNYAKYFDSIDSQIQFSSYRFSEQNFMNLLDFLEVNHTGIRYGSSKNQYVVSMSKNFNNIGMSMVLNYNYETYWDQESTNFYSLTLSKAFDIGKLKNVNVNLSINRNIYNNVIDNSIYLSTSFALSNGGNMSYSLSNSRYETSNRLTYSDIFDERTNYQLSVDASGKYKSGSAYLNYQGDTAHFSTSASFSNNQSSFSMAASGGVTLTTEGVAMHRMGSPGGTRLLLDTDGVANVPVRGFGAPVKTNLFGKAVVGDVSSYYRNNVQIDLNTLSDDIDVQQSVVQATLTEGAVGYRKFSVVSGQKVMTTLQTAEGNSIPFGAQVLNKKGLNTGIVDDNGNAYITGVEPGSIMTVQWSNEDKCEIKFPKTIDVNIPSLLLQCAPMVKH

SEQ ID NO: 2407 - protein, 728 aa, Flavobacteria bacterium BAL38
MKKYIFSLVCLCCALLPALEGQAHEYPNHPELRKSDANIVGHILDKNTKEHLPYITVALKGTTIGTVTDATGHYFLKNLPEGNFVLEVSSVGYKTVRRNVTLKKGRTLEEDFEIEEDAVALDGVVVSANRNETTRRLAPTLVNVVDLKIFENTNSTTLAQGLSFQPGVRVESNCQNCGFQQVRINGLDGPYTQILLDSRPIFSALSGVYGIEQIPASMIERVEVMRGGGSALFGSSAIAGTINIITKEPMRNSGMLSHTITGIGDGDAFDNSTALNASLVTDDQRAGLYIFGQNRHRSAYDHDGDGYSEIPKIHGQTIGFRSFLKTTTYSKLTFEYHHMEEFRRGGDLLNRPPHEANVAEQTEHSINGGGLKFDYFSPNEKHRFNVFASAQHINRDSYYGGGQDPNAYGNTTDLNWMAGSQYVYSFGKCIFMPADLTAGIEFNQDKLEDNMWGYHRTVDQKVNIGSAFFQNEWKNEHWGFLIGGRLDKHNLIDHVIFSPRANLRYNPTENINLRFSYSSGFRAPQAFDEDLHVENVGGNVAMVELADNLKEERSQSLSASADIYHRFGAFQVNFLVEGFYTKLSDVFALTDGEVVDGILTRTRYNAPGARVMGLTLEGKMAYLTKFQVQAGVTLQQSHYSEPHVWNKEAPAVKKMMRTPNTYGYFTATYTPIKPLSIALSGTYTGSMLVPHEPVPGFLEKPITVNTKDFFDIGLKAAYDFKLYKSMNL

SEQ ID NO: 2408 - protein, 124 aa, Flavobacteria bacterium BAL38
MKTLPVLPGQAASSRPSPVEIWQILLSRLLDQHYGLTLNDTPFADERVIEQHIEAGISLCDAVNFLVEKYALVRTDQPGFSACTRSQLINSIDILRARRATGLMTRDNYRTVNNITLGKYPEAK

SEQ ID NO: 2409 - protein, 807 aa, Flavobacteria bacterium BAL38
MVGFASSLSCLALALALAGQPPETSAVEPPVLVEFAAAERPLERPRETVVVLLTLEIDAAGQVVRVEVVESGGLAFDAAAVAAARRFAFEPARERGVPIAVEIGYRYEFPPDPEPEPTPEPEPEPEPEPEPEPDEATVIDESEVVRATRVDPPVSTTRMDRARAELVPGAQGDVGKALETVGGVARPDLSGGELVIWGAPPSDTRTYVDWIPVPRLFHLGGARSNLPGTMIAGVELTPAGFDGAWGRAIGGMVRVETRPARAPTEARALGGHARVDPIDAGAGFDARLGERGWIGLGLRRSLLRQTFGPLLPAGSRELVPLPDTWDYQTKATIQLDARDELALLVFGVHDTLERGIPSQTPDYAFRERRVAGFHRLGVGLTRRRADGSSLRVSTWFGYDHDRNEQRLFDARALDQGRGFAGGLRVDERRRVAPLVLIVGGIDLEHRSTRTSREGALSLPAREGDLAVFGQHPGDRVASDRWRVHQTGLAAYLGVRVGPRGGAWAIEPSVRVEPMITVGDRVLPVRPIEPEIGYSDIEVPVDPRLSLRWSPAEAVELFAAGGRYHQQPNPGELSPIFGNPRLRTIEAAHALAGLRAEPLPWLSLGLQGFWIHSWRVPVRSASPTPPVSALVVSEGRGRSYGGQLSARVYPGHGLSLSAAYTLQRAERSLPGSGDPRSWRLFDGDQTHVLQALLGWVHRSGVELGARASLSSGNPRTPVEDAVFDGFSGRYDPIFGAQNSIRLPLFFELSARLGWRRSWAWGGLRTWLDVRNATNRNNAVELVYNADFSARGQVSGLPVVPVLGLEVTL

SEQ ID NO: 2410 - protein, 515 aa, Flavobacteria bacterium BAL38
MSNLNGKVWEQYMGANASLVSSDNSYGIALYQSYRNRNPYDADGDGFSELGKLNMNTFGLRAYYRPTQFSRISLEYHTTNEFRRGGNKFDLQPHETDITEQTKHIINSGGLTYDVFFNEYKHKLSVYASAQHTDRNSYYGADKAENAYGKTKDLTAVGGAMYVGNMDNCLFSPATFTGGLEYQYNSLHDVMTGYGRDLRQDVKIASGFVQNEWKLDYFTILAGFRLDKHNLVDNVIFSPRINTLWKPSDKFQGRLTWSTGFRAPQAYDEDLHVAAVGGEAMEVRLAKGLKPERSNSFSGSVDWSFNFGHFQSNLLIEGFYTALNDVFYLESLGKDPVSGTLVQERRNGNGARVYGANIDYKIAHGKEAQLQLGFTVQRSRYTEAVRWSEDEDVAAIKRMPRTPDYYGYFTFSSAPLKNFDFSLSGVYTGRMIVPHFAGYIEKDRLEHTPDFMDFNLKLNYTFVLNDHLKLQVNGGVQNIFNAFQKDLDKGMNRDSKYFYGPTQPRTYFIGIKFFN

SEQ ID NO: 2411 - protein, 194 aa, Flavobacteria bacterium BAL38
MKKLVLAALTIASVTGIASTSAFASNEMYTLGGVGMDSGDVGAQFTLGSQIVQSNWYIESTLLVISTDDKSTSYNGDKVLQTEQEFDSLMLSLTPMYKHSFSENFAVYGKAGAFYAHSDTKLVFRSSDNNEVHKGSHGDFGLTYGIGAEYKSLKPVFGHSKFVTRAGFDWYEFGGSTGWYTAESVLNIQAGFTF

SEQ ID NO: 2412 - protein, 674 aa, Flavobacteria bacterium BAL38
MKYIVCSWMMLIGCAVQCYGSQEIDTTKVYSIPEVVVSDRYQTREVRSAVPLQIFSHEELKNLNVMQVSDAVKHFSGVTVKDYGGIGGLKTVSIRSLGAQHTVVGYDGIAVTDCQTGQVDIGRFSLENVDRLMLSNGQSDQIFQPARFFASAGILNIQTLTPVFQNNKSVNLNASVKSGSWGLVNPSVLYEQKLGEKWALTADAEWMSSDGHYPYTLYYGEEGDQSSREKRKNTEVQTFRAEAGLFGNFSDTEQWKLKAYYCQSLRGLPNATTLYYDYSSQHLWDKNIFIQSQYKKEFSRKWVFQASGKWNWTYQHYLDPDYKGTTGQSENSYFQQEYYLSTAVLFRALDCLSFSLSTDGIVNRMNCDLKDFAKPVRYSWLTALAGKYVNDWMTLSASVLSTVIYEDVAKGNSAGGHRKLSPYASVSFKPFASEEFRIRFFYKDIFRLPSFNDLYYGQTGNIRLKPENASQLNVGLTYSKRISDWLPYVSATVDAYSNRITDKIVAIPTKNLFIWSMVNLGKVDIKGIDFTASVSVQPAEKYVLSLSGNYTYQRALDVTNSDPSTLEGKTYKHQIAYTPRVSGSGQAVLETPWVDLSYSMLFSGKRYALGQNIAKNRLDGYTDHSVSVRRGFRWKKTNLSLALEMLNLADKNYEIVKNFPMPGRSFRITVGVKY

SEQ ID NO: 2413 - protein, 994 aa, Flavobacteria bacterium BAL38
MKNKVFAQCVMMLTFLLASMIVRAQTKVLTGRVVDETDGPLIGATIKVKGSTAATLTDKNGAFSLNVPVSAQTLEVSFIGYEVKLVPITGNDLKISLKPSSNQGLNEVVVIGYGTARKKDLTGSLVTISETKFNKGIMTSPDQLIQGKTPGVMVINNTGQPGGAVTVRIRGNSSIRASNNPLFVLDGVPMSGNSPLPEGRGGFSSDRGNPLSYLNPGDISSMDILKDASATAIYGSRGANGVVIITTKKGKEGPPVLSVGASGGVSNMREYPDVLDAGRFREALQYYTPTEAANADFGTSEDAFKAITRDAATQNYYADVSGGTEHGKYRLSGGYLNQNGVIRTSQLKKYTANFTGNFRFLENKRLGVDFSLFLTQMDNKYAPINATVGSEGNVISQALQWNPTRPLRDENGNLTFVSATTRNPLTSLEAFKDQAVTNTTVVNVAPYYKITDDLEYRFIYSVMRQTGMREGMYRAGLIDPSALNNEQAFISNNGETNMQLTHMLSYNKQVSKDWNINAVAGYEYLDYKYNNNISFGGGFRYAGLDYFDYLQYSPISTREVSSYRNPTNQLQSLFLRGGVNYLDRYLFTATVRRDGSTKFGANNKYAAFPSLAVAWNIAEEEFLKSNTKINQLKVRLGWGKTGNQEFPSGASLNRLVFSNQSISQANYGNPDLKWETSTTINAGVDFALFDNRIYGSVDYFNKKTTDALFEQTLAQPAPAGRIWVNLDGEIVNKGVEVSLTGTIVKNTDWTWDLTGNATFLKNSVSGLVGYYETGALRGQGFSGVLGQRMVNGQPLNVWYLAVHDGIDPQTGRSMYRGLDGSSSTANDPAINKFYSNSPNPTTLLGISSNVSYKKLSLAVNMNGALGHYLFNNTAATTMGLSNLSSRNIGSAFFNQSVKESTSNSAAPSTRFLEKGDYLKLANLTLSYRFGDIGGALKNLNVSLTGQNLFIITSYTGFDPEVNTDGTTNGIPSLGIEYLPYPPSRNVLLGVNFSL

SEQ ID NO: 2414 - protein, 362 aa, Flavobacteria bacterium BAL38
MKLRFGVVAMLAIAPGAYAQSSVTLFGLIDSGISYVSNEGGGKNVKFDDGIFTPNLFGLRGTEDLGGGYHATFALVNQFSMANGSIVGTGLFARNAYVGIESERFGSVRLGNQYDFMVDSLFAKGNAISMDITGLYGFRNGPFQRLALPNNPTGAFDWDRTAGSKPVANSVKYSSPTIGGLSGGVMYAFGGVAGSVGANNTVSVGLNYEAGALGIGAAYTNEKYGSTPGTPSTSVRNWGVGMHYDFGAVTAKALLTTVRNSFNEAGVWMAEAGAVWRIRPDVFLGAKYMYMKGNEAVNDNHAHQVSGALQYLLSKRTMVYVSADYQRANSGANAQINGVLDPNGASGSASQAVARIGVHTMF

SEQ ID NO: 2415 - protein, 200 aa, Flavobacteria bacterium BAL38
MKTLAVTALASLAAAPAFAGGLDTTAPQPVLTSPAPAPAPVTMATRDWSGAYGGVQLGYGQTDGDVFAEEEEGALYGGFVGYQRDFGSIVAGAELDYLGTDITNDATGTDIDSLARAKLRVGYDAGNFLPYATGGYAMANTSGGLEADADGYFYGVGADYMVTDRIAVGGEITKNEFEDFDGSGDDFGMTTASARVSFRF

SEQ ID NO: 2416 - protein, 910 aa, Flavobacteria bacterium BAL38
MRKLLLLAMLFASATIFAQGTVTGTVMDSEMDGPLPGANVKVVGTQQGAMTDFDGNFSLNVEDATGQIRISFVGYEPKTVKFNVSNGQTQDLGQIVLNPDANALSEVVITGVADLAKDRQTPVAVSTIRAAEIQEKLGNQEFPEILNTTPSIYATKQGGGFGDARITIRGFDTQNSAVMINGIPVNDMENGQVYWSNWAGLSDVTTAIQVQRGLGSSKLAVSSVGGTINVVTRSSQMSEGGLVKAGVGNDGYIKTLASYNTGLNDNGLSASFLLSRTSGDGYVNGTEFEGYNYYIGVGYRANENHDFNFMLTGAPQQHNQRGFFTSLESYLEYGEDGEPNEKYNPDFGYRNGEEFTFSGNFYHKPVISLSWDWDLSSISKLSTSAYASFGRGGSIGAIGRINGSQSFALPKTEDGLLPIDDIFAWNSGANVPAFGDPRQPYSGDGQFQGDFVNTGNGDRSGENGISQRSSVNSHNWFGIITNFETEVTDQITLDFGADLRSYKGFHYRRLVDLMGADIYVSNADDNNPNRFLSETYEPTAGNALNVFSNIDDEEKIDYYNEGLVRWAGAFGQLEYVGDQISAFVQGSISNQGFKRVEYFGEAPGNQETDWENILGGNIKGGMNFNIDENHNVFGNVGYYSKQPLFDAVYVNFGNTLNPNLTNEQVFGLELGYGFRSQFFNANVNIYRTSWADRFESESATFFRDTPEEIRGSANLLGITQVHKGIEFDFYGRVSNKFKWNAMLSLGDWEYKDDVTATYFDDNQNPISGVEQAVLNLDGVKVGNAAQFTASAGVDYQIVDNLSVDATYRYADNLYADYDATDALNNPDFDVFELPSFGLLDLGASYGLDLGENRLSFRVNVNNVTDNIYISESNTNRLAGPDDTTYDGINVRNNVFFGWGRTWNASVAFRF

SEQ ID NO: 2417 - protein, 403 aa, Flavobacteria bacterium BAL38
MKKIVLAVGSASILAFGAAYKIPEQSARSIALAGAYVAAPKDADAAYFNPANMAFMDDANYMELSFTGAYLSKVDFDGQQVTNPGPPPTLIPASAKSQSQQYLIPHFHYVSQKFGKFRFGMSVTTPAGFAKKWDKAPQTWSAREFTLRTAQVMPSFSYLVNENFAVGGGIRVVFTDGKIRFDHPVLGTYDMDGDIQTRYGYELAATYRLEGLTLAATFNSKIDLKEKGNVVHNGTTKTKGRTEVPLPATLALAAAVEVNEKATVEFVYERTFWSSYEKLIMTFEDPTVPTVVSEKNWDDTNTFRLGLTYKNSAKLTTMYGIAYDQAPIPAQTLGYELPDSDAIVFSLGALYEIQKDLKLGISYLADYKIGRTLSLGENKNGIVGTFGDGVAAQLLNLSLNYKF

SEQ ID NO: 2418 - protein, 833 aa, Flavobacteria bacterium BAL38
MFKKHYLVLSCWLAGSLSMPAMAAIEEVVVTATKREANIQDIPIAVTALSAVQLKRAGVDTLRDLNRLSTSFSMNTTDTEAGSGTLRLRGVGTTGNNIGLEQSVGVFLDGVYLSRTGMSLGDLTDIEQIEILRGPQGTLFGRNTSAGALSVKTKKANVSGSEGYATFGVENYNGYKVEAGYSAPIIQDELGFRLSANYRKRDGYLKAVMTDDESYNVDRYSIRGQLQWEIDDSSSLRVIADYSSTDENCCDPMIMGESPFAANFEWAGLPAHGGNPAGNANRDDLKSPAAGFGSKVEKSGISVEYNRELSNYNLFYQGSYRQFDADLVRQDMVGINIYEMPGNNGFPQKDSIESTSHEFRLQGEAGKLDWLFGAYYSKEDITQNLTLELGSDFQAMGSAIYFRSLFLPAIAAASDDLPLALGGTVGDLRSSNNPARVMANNIDANGNFASNYYSQKGASWSLFTHNTFSVTDNLDIVLGMRWVDESKDGKHDQLGANSPACSAATVNTQNLALALGMPATSFAAAATFSGCFAFAVEADQVVDQGMVSLAPQTWDESFSDDELVYTSKLVYRPSESVSTYVSFSHGYKAGGFNLDATAGILGADPTFRAELLDSFELGFKSELLDNRLRLNVALFDMEMEDFQILEFTGAAFKTFNVDKAVSKGFEIESLWAPTDEFQMAASWTRADARYPDDCDSDNPNAPASVKTLCGYALTSAPKDSASLSLTYNSLIDSADLAYSVSISGQWQDDKRTGTQAIGAAGPLAFDIQKAHTKVGARFTLSDIEASWILELWGNNLTNEITTAFALNTPLRIAARGIWVEEPRSYGLTLRTNF

SEQ ID NO: 2419 - protein, 887 aa, Flavobacteria bacterium BAL38
MRSIVVWLIGILLLPGWMGHLYAQMPEPTPTVTLDMRQVPLLDILMELEKQTGLFFSYESSLLKELPEVSLSVRDESLSYCLKRLFSPLPIIYRVTGQYIILKRKPRQYTISGFVRDSASYESLLGASVLVKSSRGGTMSNNYGFYSLILPPGKVRLRASYVGFKAMEIEIDLQRDTMIDFPLRSLASLGEVVIRGTRPRYEILSSRAGVIDVPAERVKSMPALLGEADLVKTLQQLPGVAVGTEGMTGLYVRGGGADENLYLLDGNPVYHVNHLLGFFSAFNPDAIKNTRFYKGSFPAEYGGRLSSVVDVRMNDGNRQEYHGNISVGLLSARANLEGPIVKDRSSFNVSVRRTWLDLITGTALAIINKNSDTKESFGYHFFDINAKVNHSFSERSRAYLSFYMGQDAFRQGSKEKHEDSDDMFLWRWGNLIGSAGWNYVFGQKLFGNLMVGYSRFRSHIRQEAKGYEIEGNRAERQSIKRDSRYKSEMEDLSVRLSVDYSPSMNHRIRMGTDYLYHNFRPENSQQRSWVNDSLVNPVYELLYDYSLIKGHEFSLFAEDEMRVTDRLRVNAGLRYTLFHVENEIYHSFQPRLSARYLLRPDLSAKISYSKMNQYVHLLSNTYVNQPTDIWVPVTEQVPPMSSHQITAGLYYNLKRMYDFSIEGYYKRLNNLIDYKDHWPVETHFSGWEDRVGLGKGKTYGVEFMAQKTNGKTTGWIGYTLSWSDRWFPDGSVNKGRHFPFRFDNRHKVNVVVSRKLSRKVELTGAWVFASGNHISLPEYKYLSPIYQKENGYAGVDSYRPMNSGLSARNNYQLSPYHRLDLGVNFYRYKKKGRMGIWNISIYNTYLKPNPFMTEVMVNQDINQRYQVVLQETILFYCMPSVSYTYKF

SEQ ID NO: 2420 - protein, 563 aa, Flavobacteria bacterium BAL38
FALATPLSAYTFDSLTVFGDSLSDTGNNGHWTWDSGENKLYDEQLAGRYGLTFRPSREGGSNYAAGGATATPDLNPQDNTANQVQQWLAKNGGRADRNGLYIHWVGGNDLAAALMQPAMAWQIAGNSAVSAAAQVGQLLDAGAGLVVAPNVPNIGAAPMLLEAVITAGLGAAAPPALKAALEALAATQTIDSASRQQAIRNALLAAAATISSNPLIQQLILEQLLAGYHAAAEQASELTDHYNQSEEKGLEQHGGNIARADINGLFKEILANPRAFGLTNTVGMACPPGVPASECSSAMPGFNLSQDYLFADHFHPGPQVHTIIAQYIQSIIVAPVQVTYLNQSIQSMVQDSRATLDSRYQQLRQGENPVGSLGMFGGYRGGYQRYDDNGADGHGNRNNLTVGVDYQLHEQILLGGLIAGSLDKQRSDENYRYNAGGFQAAVFSHLRAGQAWLDGDIHYLSATFSDIQRSITLGALRRVEAGEANGRLWGARLTSGYDFSVMSWLTTGPMLQYTWDYSHVNGYSEKSATSTSMRFGDQNAHSQVGGAGWRLDIRDTTIRSWAQ

SEQ ID NO: 2421 - protein, 795 aa, Flavobacteria bacterium BAL38
MKKVLLNLAFCLIAISSWAQENLSGKVLDANSGEPLVGASVWTGKQGRGAVTDEYGAFTITKLTAGEIQLRVSYVGYSSLEKNLAVPYAGDLTLELQPTELLTEEFIVSATRASSTTPTTFQTIDKEELAKRNLGQDIPILLNFTPSVVTNSDAGAGIGYTGMRIRGSDQTRINVTVNGIPMNDAESHGVFWVNMPDFASSVNSLQIQRGVGTSTNGAATFGASVNIQTDTRNEEAYAEIDNSVGSFNSWKHTVKAGTGLLNNRFAVDARLSKISSDGYVDRATSDLRSYFVSAGFYGENHVLKLNVFSGKEKTYQSWWGLPESKLEDDRTDNYYTYENETDNYQQDHYQLIYSGTIGDNWKTNAALHYTYGRGYYEQYREDDDFASYNLPDVVIGDSTISSTDIIRRRWLDNDFYGAVASINYISDNGQWDVVLGGGANRYDGDHFGEIIWARIAGDTDIRDRYYDNNAVKDDRNVYLKATYEVSSGLNLFGDLQVRSIDYSFIGVNDDGRIVDGEEKYTFFNPKFGLSYEKNGKVWYASYAVANREPTRSDFTDNPITEVPRPEKLNNIEAGIRAKSGNFSYNANFYLMDYKDQLIQTGQINDVGAYIRENVPDSYRAGIELDGAFQLSKAWMIGANIALSQNKIKEFTEYIDDYSTAEFTQESFTYTDTDIAFSPNIVSSLMIEFKPVKNLSLNWLSKYVGKQYLDNTSNDARSLDAFFTNDFRVSYSVQPRYFKSIDINLMVNNVFNEMYEPNGYTFSYFLPGESQKELVTENYYYPMAGTNFMLGISMKF

SEQ ID NO: 2422 - protein, 387 aa, Flavobacteria bacterium BAL38
MYKLSRLLILIGIGMSVSACSVMLPSTKSPVSGVKVYAQGGPLDAQKAVDAYLITPSLVKQLAPSIPFARANPPLDQKIKAYQYRVGPGDVLNITVWDHPELTTPAGAYRSAAESGSQVHANGTIFYPYVGSIHVSGLTVSQIRNKLTKRLANYISEPQIEVSVATYQSKKAYITGEVNRPGQQYLTNVPLTLLDAINHAGGLSEHADWHNVTLNSKGKDEKISVEALIQRGDLSQNRLLVDGDIVHVPRNDANKVFVIGEVAQPQMLKIMHYGMTLTEAITASGGIDKLAADATGIFVIRGQRSPSTTRQATSPEENIEKIADIYQLDVTDATSYLLGTEFYLKPYDVVYVTTAPVARWNRVISQIVPTLSGFDSITESMLRIRNW

SEQ ID NO: 2423 - protein, 675 aa, Flavobacteria bacterium BAL38
MLKQALTITTVLVTATGLSARISAAQDATALEAITVLGTGLPTSVFESPSSVTVIDDGQLRRIAPEKIGSYLESVPGVIIGEQGIQRIQIRGEAERRVLIKVDGQALTDHTTYGQPVLVDPLNIERIEVIRGASSVVSGSRAIGGVVNIVTKRGAPDTAAEVTFGAGYFGGSDGYRASGSVGGTIGAFDYRITAGTADFGDRETPDRTLVPSESASDSLAVHLGYQIDPNQYVMFKAQRYDQSADVFTDDPDFTITLPNRDLTKYSAFYEGTDLAPWMPKLNADVYYQTVDRVFENDVNTGVPPFVPNAPTNIQGLSDDEGRTWGLNVTAELSIFDIGRSFVGFEYEDDRLDTARSSIVTANPPPGPPGPPVVSVDSREEDASIKTTSLYALQEFDLSDTVTGFLGGRYYAVDAELIRSTRSAPRSNDDDRFLGSAGLVWTPNPETALRLNISQGYSYPSLGQLFLETSAGGQTVIGNPDLEPETATTLELGARYDGAGATIDATFFYTDSSDYIELTGAGGGTLSYTNIAAAEAFGLEVLAETRIGASNWSPYASLTYVRREFDFGNGFKTKDSGTPELFGRVGVKYDFDWFGMTGVLDAHVRGETSATLRDETGAVVRSGDGFGLLEVDAFVNISENASLTVALNNLLNTTYDPIDQIEGQKRSVDVFLTWTF

SEQ ID NO: 2424 - protein, 750 aa, Flavobacteria bacterium BAL38
MKKIVWSVVALLGVGITVHARTSAESDSLKVINLQEVQVVSTRATAKTPMAFTNIGKAELKKVNFGQDIPYLLSMTPSTLTTSDAGAGIGYTTLRVRGTDGTRINITVNGIPMNDAESHNLFWVNMPDFSSSVKDMQVQRGAGTSTNGAGAFGASVNMQTEGAAMKPYAEFNGSYGSFNTHKETVKVGTGLLNNHWTFDARLSNIGTDGYIDRASVDLNSYYLQGGYFAENTSVKLIAFAGKEKTYHAWGYATKEEMEKFGRRYNPCGEMYTDADGNKHYYTDQTDNYLQKNYQLLLNHSFSTAWNLNVALHYTKGDGYYEEYKPGSSLVEYGLKPFNPDGTETNESDLVRQKKMDNKFGGGVFSLNYTGNRLTASLGGGLNQYRGNNFGKVTWVKNYIGNLSPEHEYYRNKSKKTDGNIYLKANYDLTSTLSAYADLQYRHIDYTIDGVNDKYDWNKNALRPLAVDKKFDFFNPKVGLNWNITPNHRLYASFSVAQKEPTRNNYTDGDPDSYPKAEKLLDYEAGYTFANPWLTAGANFYYMDYTDQLVLTGALNDIGEALTENIPDSYRMGIELMLGIKPCKWFQWDINATWSKNRIKDFVESLPGYHYNADETVTSLPTVLIKHKDTHIAFSPDFLLNNRFSFNYKGFEASLQSQFVSKQYMTNAEVEELTLDKYFVSNLNLAYTFRPKKILKEVTLGFTVYNLFNEEYENNGWASSDYTDTVENRGNYAGYAAQAGTNVLGHVSFRF

SEQ ID NO: 2425 - protein, 207 aa, Flavobacteria bacterium BAL38
MKFDLTAACTLSATLLVSSGTVFATTANTANKSLTTIESHTPISYGNNSSSLWEKFNNNVALTWDAPNNELYLPVITWHNRHTYDKEKTDRYNERPWGFGYGKYRYDEDNDWHSLYAMAFMDSHNRLEPIVGYGFQKMWIPGDLEGFRMGIGFTLSVTARHDYYYVPIPLPLPLFSIEYDRLSFQGTYIPGTYNNGNVLFAWLRWQW

SEQ ID NO: 2426 - protein, 234 aa, Flavobacteria bacterium BAL38
MKFKLLSLAVASLISTSAMAVTIDYRHETQDQSGNNHKDRLLMSHRFANGFGLSLEGKWKSGSDKDKPFHEGVSNGTEVVASYVYKIDKTFSIEPGFSLDSSSTANSYRPYLRGKANITDDLSVSLRYRPYYKRTSANINTKKDTSENGYNLTSVLSYKINKDFQLDYELDYKQANKAGVILSDNENYDWTHDFKLTYKWDKNWSPYMAIGNVSGSKNTDERQTRYRVGIKYSF

SEQ ID NO: 2427 - protein, 662 aa, Flavobacteria bacterium BAL38
MFPPAASALWRALVLSCAIPAIVSIEAHAQQVAVPFAGTPGGAGEAVTLSEISVSATGVPTPVAATGSSVTVLTDTLLQAQQRRTVPDALQQVPGLNVVQSGGPGSQTSVFIRGSNPNQVKVLIDGIDATDPSNGNGAFDFGQLLTSDLSRIEVLRGPQSGLYGSDAIGGVISLSTPRGEGPAQATARVEGGSFGTFNQSGRISGSEEGFDYFVSIQHFRAAATPVTPPNLVPFGRPIHPNYYDNETVSAKFGYQFTDTFRINSVTRFINSRLLLTGDDFSTFPASPSAFRSSADVQQVFTRNEAEWTPFAGFHNIFAINYSNLFNRQQGPLDPLATPEATTGLGQRTRYEYRGDYQLSPGNLMLFGAQRDEESLFASDPNPFGAGNLKARNGNTAGYGEVQLTPFERASLVANIRHDENDAFGPATTFRVAPSYVLPFSDARIKGSVGSGFKAPTLSQLYQSFPAFNFFANPNLKPEESLGYDVGFEQPIGDRILVGATYYANDFRNLINTNASFTSNENVGRAHSYGAEAFVSVRFTDTLSGRVDYTNTVTKNEITNQELLRRPRHKGSATALWNPLPGLILSGTVIVLGHFVDGNRDFSVPRLKNPGFTLVNLAVNYDVSEQMSVFGRIDNLFDRRYENPTGFLGPGLAVYGGVRVTTF

SEQ ID NO: 2428 - protein, 547 aa, Flavobacteria bacterium BAL38
MNKKLLCLLISSFLLSGCANFKKINANELAAERDAQKATEYAKKIRNNPVIQDSTKQWINTTPIIEKQVKQSAPPCPIVINTRSDIELRQIAQRITQTCHIPVRISADVWTYLNGTGTGSTQQMTGSIPAPDANGMVPLASVGSQPVKVSSGGTSLPELNISGLPALLQTVSSRLGISWKYDKGRITFFYLETRSFPITYMDSNVAYNSKVVSGTMSSSGSTGSTSSGGMTGDASNTQTTTVEMKSSLYNDLKSEVSSMLTPGTGRMYLSTGSLTVTDTPDVLDSVQEIVNKRNNEMSRQVVLNVEILSIKKSSQEQAGIDWNAVFNDGHLGLSLGGSFGDAAENVITSGVSIVDGKLAGSKAFLKALSSQGSVSVVTQNSAVTKNLTPVPMQIANQQGFIESVTTDSTANVGSSTSLNAATITTGFNMTLLPYIQPDSQNLQLLFSMSLSDKPTFEVFESGGSKAQTPNVDLKTINQTIDLKSGQTVILSGFQQSNRKTSKQGVITPSFFGLGGGVNSEDGDTILVVLITPNVLNSGSSAVIKNVN

SEQ ID NO: 2429 - protein, 420 aa, Marinobacter sp. ELB17
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 2430 - protein, 252 aa, Marinobacter sp. ELB17
MKLLQKILLAACVFTTFAPVAHAEKFFGSSSVSLLYSDDYEIFGSQKESATVFTFENATAHNWGDTFFFIDRYQVQGDSGNADSTYGEFAPRLSLSWLSGQDLGFGPVKDVYLATQYEFDGGVEANNYMYGLGLGWDIPGFQYFNTNAYYVENNTAFDTPDDWQLTVTWGVPFELGSAAFLFDGFVDYSSGVSGGQSADLHINPQFKLDLGHFTGEAGVLYAGIEYSYWRNKFGSPNIDTENAVSALVKFHF

SEQ ID NO: 2431 - protein, 266 aa, Marinobacter sp. ELB17
MNVFGSIDAALQIRDKFNLQRVIIVPDGEHAGKRDDTKLMRTRLSRAGGMYLNQVIENGDVLGVAWGRTIHQMSKTMTPKSCKNVTVIQMLGSMPSQPDLTIIESSSQIAYKLSGRVASLHVPAVVSSARLAMELQAEPIIRSNFDVLTRCTKAFFVVGNALDENPLIRVGVLNKKEMQTYRDLGAVGVICGRFYDKEGMPVVADVDQRILGISLAQLRQIERKIFLAGGERGYDATLGALLGGYVTDLIVDEGTAEFLLACELPH

SEQ ID NO: 2432 - protein, 828 aa, Marinobacter sp. ELB17
MLIPYSPHTIWKTICATLLLSLAFFSQAEQDDSVEFNIHMLDAEDRDNVDLSRFSTSNYIIPGMYYLDIRLNGRDFPRQNINYIEVADNHSVACIDPTLLKKLTINQENQKYIKQISPDCFDISQLPGISIKNDGGVLDITLPRSLMKYEESDWTPPELWDSGVSGLIFDYTLTGTSTRPNKGNNNNTLTGYGQAGLNLGEWRLRAEYQGNYSSEYSSNNRFDWNQIYAYKPLPDLAAKLTVGETYLNSQIFDSFRFTGANLQSDERMLPPSLQGYAPEIHGIANTNAKVTVTQNGRLIYETTVPAGPFVINHLQNTVQGQLDVRVEEQNGKINEFQVQTANLPYMTRPGSVRFNTSLGQSSVNNHKMQGPLFYQGDFSWGMNNTWSLYGGTLLTAKDYNAWSLGIGHDMGRFGTLSGDITQSYSKTYDNEKINGMSFKLNYAKTFDEYHSTITFAGYRFSEKTFRSFSQYIDERYNGINNNGYEKEMYTITGNKTFWADDAEKSTTLYLSYRHQNYWDKNTQEQYGVTVSRNFSIMGIEQINTNLSAFRTQYKGNTDDTLSFNISLPLGSGRNIGYNLQDNNGKVTQMASYADNRDYNNLWRIRAGLSSDKKANTDGYYQHRSQYAEINANASYQQDNYLAVGATIKGGFTATRYGAALHSSSMTSSTARIMVDTDGVAGVPFNGQSTTTNRFGIGVLTDLTSYNNVDARIDVDKMDQDIETRKAIASTTLTEGAIGYYQFPVRQGERLMAVLQTTDNKYPPFGAEVTNQKGESIGMVMEEGLVYIAGVNLNESLNVIWNGKTQCSITIPAEITDPLKHQSLVCQDR

SEQ ID NO: 2433 - protein, 398 aa, Marinobacter sp. ELB17
MQVAEQRIQLAEAQAKAVATQDGPQIDFSADMERQKMSAEGLMGPFALNDPAAGTTGPWYTNGTFGLTAGWHLDIWGKNRAEVTARLGTVKARAAEREQTRQLLAGSVARLYWEWQTQAALNTVLQQIEKEQNTIIATDRQLYQNGITSSVEGVETDINASKTRQQLNDVAGKMKIIEARLSALTNNQTKSLKLKPVALPKVASQLPDELGYSLLARRADLQAAHWYVESSLSTIDAAKAAFYPDINLMAFLQQDALHLSDLFRHSAQQMGVTAGLTLPIFDSGRLNANLDIAKAESNLSIASYNKAVVEAVNDVARAASQVQTLAEKNQHQAQIERDALRVVGLAQARFNAGIIAGSRVSEARIPALRERANGLLLQGQWLDASIQLTGALGGGYKR

SEQ ID NO: 2434 - protein, 255 aa, Marinobacter sp. ELB17
MSELIVSRQQRVLLLTLNRPAARNALNNALLMQLVNELEAAATDTSISVCVITGNARFFAAGADLNEMAEKDLAATLNDTRPQLWARLQAFNKPLIAAVNGYALGAGCELALLCDVVVAGENARFGLPEITLGIMPGAGGTQRLIRSVGKSLASKMVLSGESITAQQAQQAGLVSDVFPSDLTLEYALQLASKMARHSPLALQAAKQALRQSQEVALQAGLAQERQLFTLLAATEDRHEGISAFLQKRTPDFKGR

SEQ ID NO: 2435 - protein, 1154 aa, Marinobacter sp. ELB17
MGTYWSQNALTRCPKRLCLLLLLIAGIFPLASHAQNAGINIKLTDKPLSAFIQSIEQQTDFKFFYEQQQVDVKQHVTVNVRNASINAALEQALRNTNIAYSISEKRILLTQKQDNAPSQSGKVILAKGQVTDKNSIPVIGANILVKGSTLGCITDIDGNYSLEVPTGSTLVVSYIGYTTQEVTLKNNKFRQIVLEEDSKMLDDVVVVGYGTVKKRDLTGSVSSVKGDDLNLNGVSSIGHALEGKAAGLYIRQNSAQPGGGLDILVRGAGSVNASNDPLYIVDGFPIAKLDQASGGDAKMDPGTQGILNFLNPNDVESIEVLKDASATSIYGARAANGVVIITTKRGKEGKARVNYSYNYSFQKYTDNYDLLSLQEWMVEKNSTTWESWLWNNNVSPWGNRTLEEAQANPANGVAYSRPYSDNDIAGAGPGTDWLGLITRDGQIQEHNVNLQGGSESTQYMVSFNYYDHQGIVKNSGMTRYTAKANIDQKFLNIFKAGLNLTLTRIDNDNTQLGSGQFENSGIIRSAIQMGPNIQAYDEATGTYPINPLLGQQPNPYSLLNNTDKGRTDRLLGNIFIEAKPIAGLTLRVNAGLDHANVDRKTYQPRSTLNGKNLNGVAYIYNTDNNQYLMEATATYQRTFADIHSINLLAGTSYEKFNYDASELGNNNFITDAFLWNNMDAGTGTKITKSTSTENKMMSYFFRAGYILKNRYLLTATLRADGASVFAKNNKWGYFPSVAAGWTMSEENFMRNIDWLSNLKLRLSWGQTGNADISTNAFASYGAQGSWINSDYKTVSGVMKSRLENPDLKWETTTEWNLGLDFGFLKSRITGSVELYQRVISDLLNYKPLNTYQEVKQVMANIGKTQSRGIEVTLNTRNIVTKDFFWETSLTYTKYKDRWKERTPDWKPNVYEKETDPIRAIYSRRADHIMQIGEEAPTAQPDLRPGQIVIKDLDGYVRDENGNPKVDENGRFMLLGRPDGIIDEADTELIGTLDPGWMASMTNTFKYKGFDLNIMFNGMFDRIMQDPTEMDFGVNGGGIAQSGYNMLRTIKDRWTFDNPSTTRPSSYYITGTNYTAGDFFYQKAWFIRLQNISLGYTLPKSLLAKTKVLSNVRFHASVNNLFVITPYKGLDPETDAYAAAYPNARTFSFGVDVSF

SEQ ID NO: 2436 - protein, 340 aa, Marinobacter sp. ELB17
MKKTLIALSVSAAAVATGVNAAELYNQDGTSLDMGGRAEARLSMKDGKVADNSRIRLNFLGKVEIQDGLYGVGFYEGEFTTADNADGSDLDNRYTYAGLGGKFGEVTYGKNDGALGVITDFTDIMAYHGNSAADKIAVADRVDNMMSYKGQFDALSVKASYRFADRADSSKNNVDNTYIDNGKDGYSLSAIYAIGQTGLTLGGGYADQDKSNEYMLAASYTMGDLYFAGVFTDGEKDYGTNGDYSHRGFSSVEDYTGYELAAKYTMGQTVFTTTYNNAETDGYTSTDNFAVDATYYFKPNFRGYVSYNFNLLDAGDKIGTSTISKADAEDELALGLRYDF

SEQ ID NO: 2437 - protein, 812 aa, Marinobacter sp. ELB17
MPTQRLRPHALALVIRRSLRLAAPMAVGLAGLPAIAQAQQVQFNVPAQPLASALLAFGSQSNLQVLYSPQDVEGKRSSALTGAMEPAAALSRLLQGTGVSYQIQGNQVTIHTREGGAAVELGATNIDGKGLGQTTENTGSYTTGSMQTATKLPLTLRETPQAVTVITRQRMDDQSMRSLDDVVQATPGLRMSAARPANSEYFSRGFPINNLMFDGLPTTYNADWVAAADMAPYDRVEIVRGATGMMQGAGNPSAAINMVRKRPTKDFQGSVTGSAGSWDNYRGELDLSGPLNDNGSVRGRFVGAYNDKDSYQDYAGRERGLFYGITEFDLTDDTTLTVGASNQNDNNNINWGGLPVNRDGSHVGYSRSRNMGYDWSYQDIDNTTVFAEVDHRFDNDWRLHLAASKNWSDFAMQGAVFERTGSATNEGFRQRVFNQRRDYDQSTYDVYANGPFQLFDRQHELVVGASKREVKTSAHGGTVFIPVDSLFSVNPSGIDKPNVDDIYNLSEHVEQEGAYVTTRLNIADPLKVILGARLDWYDNKSVYSEINDGYYTNSDYKVTRNVTRYAGVIYDLDDHHSVYASYTDIFMPQSELARDRSIIRPIEGKNYEIGIKGEYFDGALNASAAIFQIDQENRAAEASNQEGCVDITCYEASGKVRTHGIDLELMGALTPNWQVGAGYTYSQTKYRKDADKNKEGTKFDTDLPEHLFKLSTTYTLPGELNQWRVGGNVYGQSSIFNKGSNSFGNYHIDQGAYAVVGLMVGYKVNKNLDTRLNLNNVFDKKYYQGIASNNSWSPYDVYGDPRNFTITAKYSF

SEQ ID NO: 2438 - protein, 391 aa, Marinobacter sp. ELB17
MKNSMRGFLAVTASLSASLAFATNGTMPHGYGIQAQGMGGVSVALPTDSLAAANNPAGMAFIGNRADLGMVWLKADRGADVPGLGYVSANEKTNYFLPEFGYNRDIGNGLSIGFSLVGNGVGTKYGRPIGPPTNSNAGSELMQLMALPTLSYRVNETNAFGVSLVGAYQRLKVNGVQHIGLDDQGFDSSFGYGIGVGWTGKVANIVTLGASYFSKTKMGKLDKYKTLLAGEGEFDIPERISVGVAVEATKNITIGTDFVRVNWHDVRSLGNSVTSPGALGASNGPGFGWRDQNIYRIGVDYRYSDALSLRAGYSAGDQIIPSDETTLNYLAPVTPRRHVSLGSKWGVSKETELSLVYTRALDEKVDGTGASAGFNPRHSQHWLGIAYGWKY

SEQ ID NO: 2439 - protein, 1043 aa, Marinobacter sp. ELB17
MNYSLLRITLLCFFPLIIFAQETTGRLEGKINDTKNQPIAFADIIVTDTSTNFKYGSISQESGYYLVNNLPPGNTYKIEVRFLGYHTETLENITINLGATTTKDFILKDEDEALDAVVLTIDRTNFKKDNEKLISRKTIAQTPTISRSIQDLTRTLPEANLNSFAGASNRFNNLNIDGVANNDVVGFQEPASGAAGSSANGTPGSLSKTQPIAFGAIKELSVKTTPFDVSIGNFTGANINLVTKNGTNTTKTAIYGFGNNQSLVGKYADGTRQEVNNFYDIQVGASIGGALKKDKLFYFINVEQSLSSLPVLNAPGSATSNIDFETVQLISETLQSRYNYDPGTFTNAELKTVSTKIFARLDYNISDKHKLTLRNNYVNSFSDNLEWNESIFNFGNQGYRHNSIANSLTAEWNANFNNNTSNVLSIGYNKVTEDREFEGRVFPHLLIQDASNRIFAGTYREGSVYNTDLNTFQITNKFNYIKDKHTFTIGALLQYNDIDYGFLSAWNGRWQYNSVENFINDRPSRIRGVYRTSNNTFDFVSNTPSATLDILTTGFYAQDRIRFNDLLTVSAGIRLDNQVLLDELPVSDEVKNTPEFSRFENTINATPQINPRIGFNYYLNDDKKIQIRGGTGLFTGRIPYLWFAYAEYISGTDYFNVDIRPTGETPIVENVEDLASQQPGLTEINLIDNDFDLPREWKSNIAVDFKLPNNFGVTVEGSYTNVINGIFFKSINRKDETATFSGADNRSYFTGTGEAIKINPNFTNVFLLTNTNKGYRYNLTLGLTKRTDQYNGFLGYTYGKSKDISSTVRNSPAANFEWNQSINANNPELSFSNFDLRHKIVSSHSYQFNISNKSDFLVSMLYNGTSGSPFSFVNQGDVNRDGSSRNDLVYVPNDQSEINLIDITDSNGTVITSAEQQWENLNNYINNNDYLRSRRGQYTERNGANTPWNHRFDARLEYGLKLKGSHRISLSLDIFNVLNLMNRNWGKLVFVPNVVNSSFSLLNFQRIENNQPTYQFQIEDATPWVVDTESSRWKAQFGIKYHF

SEQ ID NO: 2440 - protein, 1079 aa, Marinobacter sp. ELB17
SVIVKGTTNGTITGLDGDFSLSNVKKGDIIQISFVGYQTQEIKWTGQPIDVTLKDDTQQLGEVVVTALGLKREEKALGYAVTEVKGDELKAANTISPVAALQGKVAGVEISGSDGGLFGGTKIQIRGASTLSSNNQPIYVVDGVILDNGVSGNTTADWDAGANNASDYGNELKNLNPDDFETVSVLKGAAATALYGSRGLNGAVVITTKSGKGTQGLGISVSQTFGIDHAFKTPDIQTLYGPGYMPGQSDADQNGSIWDAHQFTVNQNGEHTLVGVPNFGFGPKYDGSQIRNYDGTWTTYSPRKNNMLDLYKLGFNTNTNVSIRGGNEKTSFYTSLSYKNAKSTTENNTFERYSMLLKASHKLNDWVDVAASFSFANSKPRNAQLNAGELFVNANTNVINPLFDVDYFRNKYLGEHGGIASTSYGDQYGSVPSSAKNYFFKVDNYDYVRKETVIRPTFEVNVKMTDWLKFKADANMNRYYTSIEDKQLGSGYANEGGYYGITQDIKEQFTVGGTFTASKQIKDFSLGGFARFEYYNTSSKHSKVSTDGGMVVPGEWFVENSKKTKKSEATISGSKRIISTIFALNLGWKNQVYLDVTGRNDWSSALVYANRTGNHSYFYPSVSGSWLINETFRESMPSWINLAKLRASWAQVGNDTDPYTVNQTYSFATMEMYDGNIYTNELDKLMKIADLKPERKNSWEIGLDFRTFNNRLNLDFTYYKENTTDQIMKINVPAISGVTQQLVNAGNIQNSGIEIALNTTPIKTKDWQWDLDFTYTRNRSKIVSLHPNVANYIELSGYVNAYDYHIGSVAKVGESYGVLMSDVTQARNENGVPLLEWDDSWRGAYRAQSKTAEVVGNMTPDFLGSVATTLTWKDLSLNIGLDMRFGGLVASYCNLYGTQAGWTESSLQYRDPEHGGMTWTSQYADSKGIQYTDGMIPEGVFKEGTIATLVDGTKMDVSGLSYAQLVQEGKLEPTHAGSWYGNNYAWGAQTIDDIWVHKLSYIALRNITVNYRLPNSISHKLGAKGLNLSFSARNLGYLYNSLPNNLNPESVRSNSASEFRIRGFEPYTASYIFTINANF

SEQ ID NO: 2441 - protein, 1116 aa, Marinobacter sp. ELB17
MEEKQQHGRWKYLMCIWFGIFCFPLIVIAAQGVIKVKGYFSEVQAIRQIEKNSNYVFFYDAADLDEVKRKNIDCQGTIEKVLSVVFEGSNVNYLVRGDEVVLKVNKQSVQQKGEKRVVTGVVTDAIDGEPLVGVNIVVKGQKSGTITDLNGRYSISVSGDKAVLVFSYIGYQKREAPVEDLGVVNVTMSGEQQTLNEVVVVGSGVQKKVSVTGAITNVKGDILRMPTSQLSTSFAGKLAGVIATTKTGEPGSGADFYIRGISTFGGRTTPLILLDDVEISVADLNYVPAENIESFSILKDASATAIYGARGANGVMIISTKGGDYNMKTKVNVSAENSFNIMSDFPEFVDGPRYMELYNEADLSRNPNKSKDQLLYSDRRIQLTRDGVNPYVYPNVDWQDVIFKKMTMTQRANINVSGGGTKVKYYMSLNVSHDSGLLNTEKAYSWNNNINIMNYTFQNNISYKLTPTTTIRMNMNAQIRQNKGPNINSADLFKMILTTTPVTFPATYPAQPGDTYIRYGSDYQSSDYLYPNPYAQMMTSYKEQNANTLNTVIKVEQDFGFVTKGLKANIWVNFKNWSSSSYNRSITPYLFRAVGYSEDSPLEYDLERIQEGADYIAQSDIARSSDQTFEFQGNISYNRQFGLHNVGGMLMYRQREYRSDVLPNRNQGVSGRFTYDYGQRYLAEINFGYNGTERLAKKKRFGFFPAMSLGWVISNEKFFEPLKNAVNNLKVRASYGLVGSDDLAQAGGSYYLYIDKLTDNKLDQIKWTFGESMNHTLGGPEIAYYANLDAVWEKAKKFDIGVDMTLFDHWNITIDYFYDKRYDIFMERQSWPNSLGYGKAKPWGNVGKMDNKGVEFSLNYHKNFSKDLGASFQANLTYNKNKLVYKDEPDYPTIWKSETGKPYSRLTGYISEGLFQSQEEIDNSPEQMVGNSTPKVGDIKYRDLNGDGKITEDDQCMISKYGSVPRLQYGFGGTINYKKFDFGIFFSGSALRSILINGLDPFLEGNRIPNKNVLKFIADNHWSVDNPNPNAEYPRLGLTTGDIGNNTVNSTYWLRNGSFLRLKNLEIGYKIPYGRIYVSGANLLRFSPFDLWDPELSSWNSYPLQRTVNVGLQLNF

SEQ ID NO: 2442 - protein, 792 aa, Rhodobacterales bacterium HTCC2150
MSAGDFWGSVSLAGVVVAGFATMTPAKAQDRRAASDTLLPDVTVEAPRRSPAARRTPSSAQTVPPTARTAPRRATTASQAAGPSAPSSVSAGTPLNSNTVPAAGSRLGLTAREVPAAVEVVGSETLREQGYHTTVDAVKGASGVSAGDAPNDVGYAMRGFQGNQVNVLYNGINIGPTGFTALTMETFNLDRVEFLKGPSSLSSGQGAVGGTINFVTKTPHTGPVQNEAFVGFDQRGSFRSGFGSGGSTSVQELDYRFDISRTKEVGFIADTEFKNVHVSGQLNYRLSDSFRTFVAAEFKDYKAKPYEGTPLVPAADSGTNATAGIVSGSKISAYNGSTLDAVTIDRRTLSTNYNVVDGHKTIKESWVRSGFEWDLNNAVTLRSQIYNYNASRDWYNNEVSAFNADTNVVDRERFFVHHNHDILGNLTDVTWNGSIFGLANRLIGLVESSHTDFTRPGAANFFHDTVPLVGFDRGVFGSLTTQMQTATIDSVAFNLEDRLKLTDTFALVGGLRYNPFTLDRNSTDMNGVVKNGFPYSKSWQPVTGRIGYTWEALPGTTFYSQYATATDISADSIFLLSPTQNLTLSDSRSYETGVKQLTWNGRAEWTFSAFDIARHNVYSAQAGQQLNFAGKVRSQGVELAAAVRPTPESKLWGNVAYVRARYADYDLAGGGSFSGHTPPNIPAVIVNGGGSYRFLNPAWWPVELGFSVRHVGDRWSTDANTVKLLAYTTADLFAFIDLPKVPLFATATSTRLAFRVRNVTDRRYAAWSDPFYPDQIFLGAPRTYEVEASFKF

SEQ ID NO: 2443 - protein, 807 aa, Rhodobacterales bacterium HTCC2150
MCKKYIYKKNFLLCTIAGTFIFSYFAPTYANTQPPEIPTVQVANGEEKGLNNVFVRGKYDAAVAKKGHITITNSIMRSDFTLLSATSGGQINAKGIVGTAKERGLSLTNGIIHVEDSIINVIGHSKVYGINFGYILSSTIKEGEEVVNKAILNNTKLLVKDGVGIFGPYYSKAVANAVSLKNSEIRSDMLLKNEGSPFTTIGPTTFTLDADNSIMEGRAKTLPQNTTVFTLNNNSKWHLKISLFELENSFSIFDYKLLDLKQRAQSVVSVLNLNNSSIIFDAPHELVHGHYQTLHVGKYPQKEEQNRSSNATAVYNATGNARIYFNTEWSDGLKKEQQKTDRVLVHGDVSGITTIYFNNLSKRVSSNEESKEKKSIPLNVRGLSLIQVSGQANEDSFKLSHGYTTLGGLPYKYILNGYGPTSSRGKADRAQSHLSGISQESQQKDVQNTNASSPGKENNRQAPLEENENFWDFRLQSATLDEEGKIKALVPQMASYLVMSNALFSSGLSDVSNQNTQLDNMHSTVFGLEGHKKKGIFLSTYGNKVTLSSSRSPLEYGYGADVRYAALQAGITLATLENQNITANFGLLGTYGKLSFTPKDMDGSDKSTLDKWSLTTYGNLHHDNGLYINALFSYGIFNGHITTALIDNTTELKDTDTLNISATVGQKLATGVEGLAFEPQAQLIYQHIAFGTLSDVDGFHVNIKPSHQWLVRIGGRLTKTMLPIENDRVLSFYGKLNIIKAFSEKNTIDIVESFHLDSMGSSLEGGLGINAQLSKNIALHADVNYQHKLQRAGFSGVNISGGVRYRF

SEQ ID NO: 2444 - protein, 435 aa, Rhodobacterales bacterium HTCC2150
MIFLKKSLYALLFSGFLTPPLMKAASFVYDLKFMSFNFNLVAPANNPYWNSLTKMQGRLMPQIGVQLDKRQALMFGAWFIQNLHTHYSYFPYSWGVTMYYQYIGKNLRFFLGIVPRSYQIGHYPLSAFKKLFWFIDPTFRGGAFQFKPAYDPNRWWNGWFEGVVDWYGGRNWNNQPKKKNYDFDQFLYFVSSEFQFLKGYLGLGGQLVVFHNASHHSMGDNYPYGGNSYLKPGDVTPQWPNGYPYFSQKNNPQGGEIGKYSNPTILDRVYYHAYLKADFKNLMPYMDNIFMTFGTQSSQTHYCVRYASECKNARFYNSFGGEFYAQAQYKGFGIFNRYYFSNKPQMHFYATYGQSLYTGLPWYRAPNFDMIGLYYVYKNKWVSVRADAFFNFLGGGDGYHLYGKGGKWITTYQQFLTLTIDTRELIDFVKSKTSK

SEQ ID NO: 2445 - protein, 767 aa, Sagittula stellata E-37
MSQFRLCQLTCAVALALPTLALLSGPALAADLAAFTLAPITVTGSPSHISQPLGATAVDPASLAPKLSATSDTASLLQDVPGLSLYGAGGVSSLPAIHGLADDRLRIKVDGMDLIASCPNHMNPALSYIDPTQVGLLKVYAGITPVSAGGDSIGGTIVAQTRAPEFAAPGQAAITKGEVGTFYRSNNKARGANVSATYATEQFNISYSGATSRADNYTAGGDFKNHDFTGRVGHTLGRDEVGSTAYDTRNHSVGLAFKSDNHLLEAKLGYQDMPFQLYPNQRMDMLGNTQNSVNLRYAGQFDWGALEARAYRENVDHVMDFGADKRYWYGAASGGGAALDGTPCSPISATCAAGMPMVTEGKTTGLSVKADVALTPQDVLRVGAEAQQYRLKDWWPPSGGGMFPGTFWNIQDGQRDRTAVFGEWEARKNTQWMTLLGARVEQVKMNAGNVVGYNPAGGGFQGRDASAFNAQDRSKTDNNLDLTALARYSANTNYDIEFGFAHKVRSPNVYERYTWSTWQMAALMNNFVGDGNGYLGDVNLKPEKANTISATFDWHAADSRWGFKATPYYTQVSDYIDAVQWNASTNLAATTLAANKFSVLKYANQSARLYGIDLSGHMPLAKRAWGDFGLKGLLNYTHGTNQDTGDGLYNVMPLNAKLALTQKLKAWDNSFELLMVQAKDSVSGMRNEIKTPGYGLVNLRGSYSWRQVRVDFGVENLFDRFYYLPNGGAYTGQGTTMSNPALPNYPQWGSAVPGIGRSIYMGVNVKF

SEQ ID NO: 2446 - protein, 648 aa, Sagittula stellata E-37
MAVDYVYDNSKLTNEQIDRLKKLRDKSSEYWKQETLNLLKPTNGSSQNSLKVPALYSKTHQFKNINNSKKISFYDKEYTEDYLVGFARGFGVEKRNGEEEKTLQQYFKDCVNTGNSNNDKCEQPSFENSGPRLIKSDIFALAPQIKNSHINSEILSVGNYIEWLRPTLNKLPSWQEHLYSGLDPFHYIEVTDNSHVIGQTISLDEFRLENSLWEPRWDSDVGELKTTNADIRFNTKSESLLVKEDYAGGARFRFAYDLKDKVSETPVLTFEKNITGTSDIIFENPIDDLKSLDGHQIIKVNGTADKHAFRLSGKHQKGIYTLSLQQRPEGFFTKVQERDDISIYAQQAQAANTLFALRLNDKNSDIFDRTLPRKGLWLRVIDGHSNQWVQGKTAPVEGYRKGVQLGGEVFTWQNESNQLSVGLMSGQAEQRSTFRNPDTDNLTTGNVKGFGAGIYATWHQLQDKQTGAYADSWVQYQRFRHRINTEDATERFTSKGITASIEAGYNALLAEHFTKKGNSLRVYLQPQAQLTYLGVNGKFSDSENAHVNLLGSRQLQTRVGVQAKAQFSLYKNIAIEPFAAVNALYHNKPFGVEIDGERRVINNKTAIESQLGVAVKIKSHLTLQASFNRQTSKYHQAKQGALNLQWTF

SEQ ID NO: 2447 - protein, 450 aa, Sagittula stellata E-37
MVGTRSMRTTASVSVDEIQVQVPGMAPQQLLASLPGVKHTRRLLDDRLTMEFGAKGLDVKRDYNGIANLDDFTVGMRRAVTIKNSDWFQPQVGASFQLAEGVQVFANDAENFSSAPRLTLTSGAFHPDIAPEESTHIDIGIRAESTQWSGYIAACKIDDENRIIALTDPALLVVAPTVYANVGDVQTYGAEVSGMWKPAPGWRLGTSLTWNNSEIPGQLFRPGQRQPGTGERQRGAGCAEGDVQRQRRLGRRAFLRQFRRQIHRQALRRHVQDRPGGCHLHRQRQRRVSGRGQWVACRWSAAVVGLHPVRQARYDRCGVSQRKLRLVPVDRTAPAVRQSGRHILRCSRGRQGCRPHAFVHDMRGKCVDARQSHGSDDAAAIADAHRYDRRRRDDVSGDEQPGHGGRIQFQRPAATGWRPQGGVGLDSRCRAGRHERRLRVAQGRLPRAAA

SEQ ID NO: 2448 - protein, 366 aa, Sagittula stellata E-37
MKKILFALPLAAAATAHAQSSVTLYGIVEDGVDYVSNVQGKHLVQLASGVTAGSRWGVRGTEDLGGGLSAIFRLESGFDINSGRLGSGLAFSRNAYVGLNDTKLGTLTLGRQWDSIVDYVEPFTLNGNIGGYYFAHPNDMDNTDNGFPISNAVKYRSPTIAGITFGGLYAFGGQPGRFSDNATFSVGASYAAGPVGFGIGYLRINNPGVSTQGYQNYPGFTNAIYGNYLDAARAQKVFGVGASYQVVQWLKVLADFTNTNFQQGSAGHDATFQNYELSTLVTPTPAVTIGAGYTYTTGRDHATNAEPKYHQFNLSVEYALSKRTSVYVMGAFQKAGGDAPVAQIAGFNPSGNQKQAVGRAGIRHAF

SEQ ID NO: 2449 - protein, 434 aa, Sagittula stellata E-37
MSCIAMTGAAAEEVAPSPVVQPAPAAETTDCARLDALNTRSRSAEVQMPVCQTMLSDIGGWRTWLADRGIGFQASALAGVNYDVLGHARTPQLYGGQSPTYNTSSYALFTYDLTRLGMPGDAQLTVKADWYTNSYFPSIRYSGFTAVAINQRFLNGDVELQYGYFDLSHSFYGTVLGGNPAVASFGPQSNVLYSAGISSESPTPAAQIILRDPATQHFYNNFIVSRSTSPDGQLVENRANPVGLRFSIPGDGALFVDEVGYKRDASVSSRSLWVRGGAVINTSDYPALDKTRSQTSSLHNRAFYGAATAQLTSPYSDARGLYVDAKVDYSPSDVALFAHDYSLTAFILGPFSTRRKDMVSLSWSQSFFSPEERRTLQARGADSAHSTSSLEISYALNLARGVYLISSLTRTWNPVFAPLQPPALFVNESVSVTF

SEQ ID NO: 2450 - protein, 855 aa, Sagittula stellata E-37
MKTLASGAILLLLAGSAFGQSLGNAGTIEGSVVDPSGAAVVQATVTLHNAVTGYHQAAVTTPEGTFRFTNIPPNPYHLEVKAPGFTVFAQDLGVRNAIPIEVKATLALSSAQSSVTVSGAGAAMVEVDPSAHTDADRSLIMKLPAVDPAGGLSQAITYSTGGVAADGNGLFHPLGDHAQSSYVVDGQPISDQQSKVFSTQLPTSAIQSMAVVTGTPDAEFGDKSSLVANITTRSGLGAPRAFGNIDATYGGFGSSGGSAGLGFGSAKAGNFLAVEGIRSGRFLDTPEFTPFHDKGNSESIFDRFDYQPNGQNVFHLNLFGARNWIQIPNTYDGLAQDQHQRVMTWSLAPGFQHTFNAHSLLTINPYIRKDQFTYYASRDPFADSPSTQNQSRQLLNWGVKSDLAIAAGRHDLKFGIDLKQTRLMENFGFGITDSTFNPICLDSNGDPAGAATLINPGNCAAAGFVPNPNVSTGLIPFDLTRGGSLFNFHAAHNINQYAFYAQDAIKAGNFLFKIGFRGEHYDGLVTDNGAEPRAGIAYNVKKTGTVLRVAYARTFETPFNENLLLANATGAGGLSQGVFGADAVAIKPGHRNQFNAGLQQSLGRHLLLDADYFWKFTHSAYDFSTLLNTTLTFPISWHNSKLDGVTGRLSTTNMGGFQAYWTFGHTRARYFPPEIGGLVAQGAPLAGGVFRIDHDQAFQSTAVARYQHKTFEWISLTWRYDSGLVVSGVPDSDAALALTAAQQTSIGLACGGAFATYSSPITSCAGPVTSKLLTLPQAGQENDDHNPDRVKPRHIFNLGIGSDNLFHTERRQHFTASLEVANLTNKVSLYNFLSTFSGTHFLQPRTFVGRFGITF

SEQ ID NO: 2451 - protein, 190 aa, Sagittula stellata E-37
MFKSTLAAMAAVFALSALSPAAMAAKGDPHVLLTTSAGNIELELDKQKAPVSVQNFVDYVNSGFYNNTTFHRVIPGFMIQGGGFTEQMQQKKPNPPIKNEADNGLRNTRGTIAMARTADKDSATSQFFINVADNAFLDHGQRDFGYAVFGKVVKGMDVADKISQVPTHDVGPYQNVPSKPVVILSAKVLP

SEQ ID NO: 2452 - protein, 1156 aa, Sagittula stellata E-37
MGAGRHFRNLSTLFLCTTFLVSAPVSAALYAAETGAKHKPIAKSSLPSDLKSSLAEAVRLGERELIAQAYDSTYRNPGLRNAVVHYASELSPAALRDVTTAADLGVLTSGQRMTLAPNAAQVLSTRTATASGLGATSYQNVAAAVNNSPNLPNPMPSLQAQTWNLDLIGATAAYDRGFTGAGVKVTVADTGFDVANAGLVNRLVTSVGRNYVVKDGTTYDPNELTPLTGTDMHGSHVAGIVAGEKFDNVGAHGVAYDARVIPLRILTAAGYSVAGDGDSSASALNYFAGLTGTMVYNASYGPNFNDFTNLTRWTVGNIADEGNAALNALRAGKLVVAANGNDRGSNPIAARNPSGLALLPFLNPAHAGLGVYDDQGQQLDGTVLQRQNGQIIAVMSVGITKAAAWYSNLCGVAASWCVAAPGGDDRTGAEVYSTVPQNTYAFESGTSMAAPTVSGAIAVLIQANPSYNARDLANLLFSTTEDLGAAGVDAVFGYGLIRLDRATDGPTSLAANSTVDVAAGQTSYWSRLLTTQGDFSKAGDGILTISGRTTAGGNVFAQLGTLAVDGTLTMAAGNRLTVAQPATLAGFGAVVGDTSIAGTLSPGKMANVGDLVANDVVPAGTVLNGNSVGTLTFNGNVTLTSTANTMIDIDGSLLVPGGPGTYDKIYVTGAGNVFYAAGTLTPVLRGSVGTVSNYTPAIGAEFAFVQAQNGASTAGTFSSLVQPTSGLPANGRFDLIYQPTSITLVVTPASFSAVATADQLGPNQRSVARILDNERAASGVMPSASEKALYDALYKLNTEAELDKALTQLAGPGQPAISSAPLHAFAGFLGAIGDRQDMMALGGEQGQNGTAQSFALNYAGRTMMSAETNSAINAFASINPAERVRDGWATWGQGFGRTSRVGDAGDLAGSKTVSAGFTLGADRWFSNNLVAGGAFGYARTTATSTDISGNSDTYAGAAYASWMPGAAVFDWRIAAGPSQMSTSRQILLATNGLQGNSNGVGVGTALEAGYRVALAPDVTLKPFAGLSWQGFRRDGYSESQQPIGLVYAAQTSEKLTTTAGAALSARLRTADGATLMPELKVGWGYDLRDTTLISQAALLDEGFVVSAAQPGRNAALVGAKISGWRAETFRMFAAYNGEYRSNAISHQLSAGARFNW

SEQ ID NO: 2453 - protein, 257 aa, Sagittula stellata E-37
MDFYANAGLGAVFSNTSTSNTSNSNSVLYTPTAIGTSLFTLPNINWQNKFKNGYGINLAVGKYFSSNWHGDLEFLYQNIERDTYGTYNWLEQNSTTGAAYAQQANNLISKISTRANIYSFMTNASYDLMNVGKLQPFLGAGLGLAWLRSSSTQTNNSININDPNTPLVETAPAMQNSPSLYGTAFAWQFKAGINYAVSEKATAILQYRIFKTTDFKASQSTIITNPGMAGQTIFYAGQHDINGLLTHAVELNLRFDV

SEQ ID NO: 2454 - protein, 695 aa, Sagittula stellata E-37
MNAFTPFARMPGAMHPLAWAALLCLTSAAPAWAQADARLPEVTVSSSGLQLGVSEMTQPVSVLEGDALVRQREATLGETLDGEPGITGSHFGAGASRPVIRGMDGPRVRVLSDGSELHDASTVSPDHAVAAEPLLATQVEVLRGPSALVYGGGAVGGVVNVLDGKVPTAVPDKGYEGSAELRAGSAAREKAGAVALTGGAGNLAVHVEAAGRDADDYRVGSGWAEGRRVPGSFNRTGTGSVGLSWVGSRGYLGLAFTRQNAKYGLPGHSHSFEGCHTHGNHLHCGSHDEHDHDDDGHDHDHDHGHEAVPVVDLRSERVDIRGELRDPFTGFSALRLRAGVTDYVHDEVEEGTVATTFKNKAHDLRVELQHEPVAGWRGVLGLQTGQRKFSAAGEEAYVQPTLTRQWGVFLLEEYRLGDWHGDWRIETALRHDRQSAEAQDSGVERRHHGTSASLGAVWRFAPGYAAGASITRAHRAPTAEELYARGLHMATSTYERGDASLRAETSRNIDLSLRKTSGDTTFDVSVFHNRIRNYIYGRTLDELDGLQLLQYSQAGATFTGMEGRVRQRITQRLGVTLFGDSVRARLDGGERLPRIAPARVGLRVDANWRDWGGAVEWVQVARQNRVAAFETATPGYGMLNLGLAYNGRTGSGTPWQVYLKARNLTDRLAYAHTSFIKDAAPLAGRNVTVGVHVSF

SEQ ID NO: 2455 - protein, 255 aa, Pseudomonas aeruginosa C3719
MNRVAASGLLAVLAATGAQAADLPRRAAPPVVAPVPTFTWTGAYFGANVAGLVDGNFLLRSLAPLPGAASRPSAGGFVAGGTVGYNYQFAPENGFVAGLEGDIGYSGVRHTGIIAAAGLGTANGRLQTDTYHATIRGRIGYAWGPVLVYATGGWAFTEFNAEGVAATQRFGLGAGRPFVGAFAGPVRRSIPLDGYTVGGGVAYKITPDWSLKAEYLFAELDRRVAFRAGGTPVRARVGLDAHLMRIGADYRFSLF

SEQ ID NO: 2456 - protein, 429 aa, Pseudomonas aeruginosa C3719
MKTIWFKTSLALTISAVSTYTLANGIAINEQSASGAGTAYAGRASSALDASTIYGNPAGLSKLKRTEVSGGLAIVKAKDDISQAHSTAQGSNKGDSVPLAAVPFGYFSTPINEDFTFGLGIYVPYGIINDYENGFMGSSHGSYSKVQVITVQPTIAWKINDKVSVGFGPTFNRIDGQLKNTLATNALNGGNGDTKISIKGDDTAIGYNVGVMVDLTDDTTWGLTYHSKVKYHLGGNTEVKNSPAFLGLNGKYDAKLDITLPESVDTSITHKFDDKWTGYVGAVWTRWSRLETLDVRNSGLPAGPIGQNFQTLSEDLKWRDTWSFSVGTSYQATPEWVLRTGFAYEPSPTTNEDRNVRIPVGDRKVFTLGAGWSPNQDLTVDVAYAYLWESTASVNQSAKSIGPIDIQPAYSAKYDNSAHGLTAQVTYRF

SEQ ID NO: 2457 - protein, 243 aa, Pseudomonas aeruginosa C3719
PAQEDSSTRANVYISAKYMPTASHFGKMSIKEDSKDTKAVYGIKKDWDGVKSTASTSLFTEKDYSFKYENNPFLGFAGAIGYSMNGPRIEFEVSYETFDVKNPGGKYKNDAYMYCALDTATGSSAAANTSVMVKNENLTDISLMLNACYDIVLDGMPVSPYVCAGIGTDLVSVINATNPKLSYQGKLGISYSINPEASIFIGGHFHRVIGNEFHDITTHKVFFSSGTPANPGFASATLDVCHF

SEQ ID NO: 2458 - protein, 3795 aa, Pseudomonas aeruginosa C3719
MDRRLATAALPRISALSLAIRLGVAGLVMGLASPDVFAACSPASPTAGATVTCTGVPTLPLFLNTFSSAVNSLTVNVNAGAQLNATLGGKALTLTGNNTTLNNAGTIDPALLGLVTLLSGGVVIGNTTASVLNITNAVTGTIRGTGAVLGVDLASLDGMALNATNGVGGITTIVNNGTIGSSSLLNLALLPSNTPVVAVQGGGQVNMTNNGTLTGRVAFESSTAGNTFRNTGTISGGVSMGVASSNTFTAVTGSQVTSGGGVEVSLGNLLGVNLTFAPTGQVDGGAGGSNSLILENTTGVGGGSTGTGTASSANYVNFNNLAINSGTWTLQGPLVSGSTTLNGGVAQFNNNATFGSGVLTSNGGAIEATGNGLTLANLMTLGTGGLTVQGAATGLTLSGLISGTAGLNKAGTGELILSGANTFQGGTTLNAGTLTLGNAAALGSGALTVAGAGTLQSNAALTTSNAITLNANLTVDGVNPLTLGGVVSGGSGLIKEGVSSLALTGNNTYTGATALNAGSLVVGSNTALGASVLNASAGTTLDASAAVSLGNNLNLGGNLTLGGSNALTLGGVVAGLGGLIKNGPADLILNQANTYLGNTALNSGKLVIGATGALGAGTLNAAAGTTLDASTSATLTNAINLAGNLGIGGSANLTLGGTVNGAGSLTKNGTAGLTLSGSNNFLGGTTLNAGTLTVGSNTALGLGNLTVGGAATLNSNSAVALGNGIALNAGLTVGGANGLTLGGVVSGAGALIKDGLANLTLNGTNTFTGGTSLNAGTLTLGTAGALGAGSLTVGGAATLDNSAALTLGNGIALNGDLTLAGNNDLNLSGVISGASALIKNGLADLTLSGNNTFTGPLNIVSGSVTTGSTGALGSTSGVDVSAGAALNLGVDSSLAGLSGAGGVAVGGGLNLTVGGVSTSSTFDGDLSGAGGLIKVGTGTLTLNGINGITGNTAINAGTLDVDGSLGSALVNVNSGGTLTGSGSLLGSANINSGGHLALGSGTTLSAAGLNMSAGASLDVALGAPSLTSLMNVGGNVNLAGDLNVSDAGGFGAGVYRLINYTGGLTGALNVNTVPLGYGLGDLLVQTSVGSQVNLVVAAPNIRFWDGSNTLANGTVDGGNGTWTAGGTNWTSADGLSNQTWGGGFAVFQGAAGTVSVDGVQTITGLQFVTDGYSLVNGTGGQLSTGSGNFAVRVDPLATATLGVDITGAGVLNKLDTGTLVLNGANSYTGGTLLNGGTVVVGSNTALGTGTLTAAAGTTLDSNASVTLGNDAVLNGSLTVGGSNALALNGAISGTGGLVKNGTAGLTLGGTNTFLGPVALNAGGLILARNTALGAGVLNAAGGTTLDASTAVTTTNAINLAGNLGIGGTADLTLGGAINGAGSLTKEGTANLILSGANAYLGGTTLNAGTLTLGSATALGLGNLTVGGAATLDNSAALSVGNGVVLDANLAVTGSNDLTLGGLVTGTAGLSKDGAANLTLNGVNTFQGGTTLNAGTLTLGTAAALGTGALNVNGAATLANSTPLVLANAVNLNAGLTVGALNNNLTLAGVLAGSGSLVKTGTADVSLTGTNTFNGLFDVQSGSLTTLGNGALGVGAGVNLASGTSLNLGGSASLGALTGTGIATVGAGSTLSVGNNNLDSTFDGIVAGLGDLAKDGTGALTLGGLSVVTGDAQVNAGSLLVNGSLASANVAVGSGATLGGTGTLLGNVTIADGGHLAVNSGATLTTGSLLLNANSNLDAGLGAPATGGTALVQVNGNLTLDGTLNVTDIGGFGAGIYRLIDYTGGLTNNGLLLGSLPVNIPASDLDLQTAVGNQVNLLVNGSTNVQFWDGSQTTGNGTIDGGNGTWSAGGSQWTGVNGAFNTAWTPNSFAVFQGSAGTVTVDGAQAVTGLQFVTDGYTLAGGAAGALTLFNGVGGNTAVRVDPGVTATLGVALNGGGTLAKLDTGTLVLNGANSYTGGTALDGGTLVVGNNSALGSGLLTTANGTTLDSNTAVSLANALNVNGSLTLGGSNALTLAGTVAGTGSLIKNGIANLTLSGNNTYAGPTALNAGGLILASNTALGSGALNAAAGTTLDSSTAVALANTVNLAGNLGILGTADLSLNGLVSGSGGLTKTGAGNLTLNGANAYLGGTQLNAGSLTLGNASALGSGALAVNGATTLDTNTALALANNTSLNAALTVGGSNDLSLNGVVDGSGSLIKAGGANLTLNGANTYSGGTALSAGTLTLGSTTALGSGALTVGGTATLANSTPLVLANAVNLNGDLTVAGSNNLTLAGVLAGNAALIKNGTADLLLTGNNSFSGPLTVAAGSVSTAGNGALGTTSGVTVGSGASFNLGGNANLNSLAGDGVVQVAGGNTLAVGGSNLDNSFGGALNGAGNLDKNGSGVLNLSGTNAISGAANVNGGTLNVTGSLASGTVAVSSGATLAGSGSLAGAVTVADGGHIGLASGSTLSVGSLVLGGNSNLDVGLGTPVLGGGTGLLNVGGNLTLDGNLNVTDIGGFGSGIYNLINYTGALTDNGLVLGTLPGSVVPGDLQVQTAITNKVNLLVTAPNTTVQFWDGNSLIGNGAIDGGNGTWNAGNTNWTNVDGTLNQGWVNSFAVFQGVAGNVTVDGTQNITGMQFVTDGYTLGSGTAGVLNLVNGGTGNTAVRVDPNATATLGVTLNGAGTLAKLDSGTLVLNGSNGYTGGTALNGGTLVVGNNSALGTGVLTAAGGTTLDSNAAVSLANAAVLNGALTVGGSNALALNGGVSGSGSLVKNGAAALTLNGVNSYSGGTGLNAGQLILGNKAALGSGALTVGGAAQLDGSTDLQLTNALNLGGPLTLAGSHDLALNGVVSGSGSLVKNGNGALLLTAANTYSGGTTLNGGSTTGNTTSLQGAIANNAALTFEQASDGTYTGNLTGTGVLNKTGTGALLLSGNNTFTGNTNVNTGSLLVNGTLNSAAVQVASGATLGGSGTLGGAVNMADGSVLQAGAATPLSVGSLALSSGTTLDFALGAPGASSTAVNVAGNLTLDGTLNVSDTGGFGVGVYQLFRYGGSLTDNGLTFGTLPVALGNLSLQTALANQLNLVVQTTPGQIQFWNGGTTNPDGSISGGSGTWGPGTNWTDPTGTQGQASTNQFAVFGGQGGTVTVVGNQGFTGLQVLDAGYTLVAGAGGSLSPTNAADGSLAPVRVNSGVTAQIDAPLVGTGGINKLDAGTLLLTGANTYTGGTTVSGGTLAGTTTSLRGRILNNARLLFAQRTNGQFSGTLSGTGALIKQGAGALLLTGNQPFSGTVAVEEGVLQVGNAANPGAVLGGQVTVANGAGLTGNGSVGSLVNNGSVTPDGGKLTVAGNFTNASTGALNLVITPSTTGSLAVGGTANLGGTLNVVNLAPYAGATTYTLLTAGAVNGTFATTNLENLAFLTTALNYSPTQVALAVSRNNVSYASVAATGNQRGVAAALGTGTAVGGAAVQNALLNGDAAAARAAFDSLSGEIHASTASAMLEDSRYVRDAVNERLRQPGCYREDDPRNALAPSENHLSSAGCHGEMVGWMRVLGTWGHMGGDSNSAKLDRNLSGFLLGTDKQVDDAWRVGVAAGYTRSDLDAKRRNSSADVDSYHLMAYTAYQQEAFAARMGVAYSWHDVESKRNVAVGGEGQRLKADYKARSAQVFGEVGYTIQTPTVALEPFAGLAYVNYDSDTIKEKGGSAALRGDADQDITYSTLGVRIGQTITLGNGSKITPRGSIGWRHAFGDTKPDADLSFINGGGSFSTQGVPIAKDSAVVEAGLDYQISQNGRLGLGYSGQLSRNDKDHAVTVSFSLGF

SEQ ID NO: 2459 - protein, 812 aa, Pseudomonas aeruginosa C3719
MHFSLRSRHLRPSLLASSLLLAVSAQGQEKLDVDLPAAPLGQAINALAQQSSVQILFAGDLGAGRQAPALKGRFTPEEALRQLLRDSGLKAQARDEHTFIVVPASEAAVPATQARSEPLDMEQMEITASRTSSDLVSATRQSTVIEHAQLEELRQGSDSLATVLAKAVPGMSDSSRTITEYGQTLRGRSMLVMVDGVPLNTNRDSSRNLANIDPALIERIEVIRGSSAIYGSGATGGIISITTRPAGGENRAETRLSATSPLTRLGSDGLGGQFQQYFAGSLGALDYSFDFGTRHVGASYDAHGDRIAPEPSQGDLFDSNVYNIGGKLGLRIDENQRVQLALSHYDARQDTDYATDPRVARLPPGSVPANAIKGLELDEQNRIRNTLANLEYENLDILGSRLSAQLYYRDYFTRFTPFDARAVSTRGGNVDQIMQNSEVFGSRLTLRTPLGESGNTELVWGGDYNQERSDMPLDVFDPAAYDASGGLVFDKIGKLTYMPPLRTRSAGAFAQLQHRFDEHWSIDGGLRYEYSTAEFDDFIPLSESKAASPVTVKGGDLDYDAVLSNLGIVYSPVAGQEIYASFSQGFQLPDVGIQLRNARRGFDIGSSNLEPVTNNYELGWRGAIGDNTLGSLALFYTTSKLGDVQSFNNGLILTRTKERIYGVEASADWLSDDEVWGAGSSATWMRGREKPDGKDWQDMTGYRVPPLKLTAYLQYKPDADWNNRLQATFFDSKDYRLDGVESFGRRQVSTYTTVDLVSQYRITPDDQLSLGIQNLFNRDYYPLYSQLLRNNNNTSHLPAPGTVLTASYTHNW

SEQ ID NO: 2460 - protein, 201 aa, Pseudomonas aeruginosa C3719
MPHVNQGAVKPTMRLKLILYFLILSCYLGIGSARAATLMHGVANTWNSFSDNVSQTWNDPQTFDLYVPAVTWHNRWTYDSDKIDKYNERPWGAGGGISHYDEKGNWNGIYLMAFKDSFNKWEPIGGYGWEKTWRPLADPDFHLGLGYTAGVTMRDNWNYIPIPVLLPLASIGYGSATFQMTYIPGTYNNGNVYFAWLRWQF

SEQ ID NO: 2461 - protein, 532 aa, Pseudomonas aeruginosa C3719
MKMRIAPLWLALAGVCLAWIPPAGAQMANDLTIGNPKAMALGNAVTADETGIDSVHYNPAALTRMKGRQATVKLLTGVMDIRAGFKAPPNYGEGTFGLRDDPVANSHSRTLTPTMYLPGLGGMTDVPLLVAPLAGISINPPGSKFTFATNVYTPQALGYSRDSDSDPARYQGREVSLQRLTYFSPTLAYQVNDELSVGLSVGFSHQAVALNEDFRAPNQLLGLLQQTKEIGCLPGMQEILEVFFNVCGGNIGPFQNLANIDLDMQQSLSPSFNLGVLWEPTDWFAWGATYQSESRMRLKGKYRVDYGQGWQGFWTGVHKSLGGAILGQMFPYGNVDEEHGNATMNMVYPDAFSTGVKLRPFKKWQFNFDLKWNGYSDWNEFKIEFDRELDLLRIAKYLDSKDATSHSITLDRGYRDTWSWAMGVQYDVNDRLQLRAGYEYRPSAIPKGQADILVPIGDANLYGLGLGYQWDKDTVIDVGFNYFVTKQSVKADNSCNLNCTGLDNLVYNPYAGLDVDTTVKAYIFAMTYRTTF

SEQ ID NO: 2462 - protein, 340 aa, Pseudomonas aeruginosa C3719
MKLKNTLGVAVGSLVAALSMNALAQGQGAVEVEAFGKRYFTDSSRSLEDGNLYGGSVGYYLTDDVSLALSYGEYHDMTSDDAFGVDGHKDIKGSLASLDAVYHFGTPGVGLRPYVSGGFAHQSISNIPDRSGRDHSTFANVGTGLKYYFTENFFAKASLDGMYNLDAQESEWMAGVGVGVNFGGSTKQEPAPAPVAEVCADSDNDGVCDNVDKCPDTPANVTVDADGCPAVAEVVRVELDVKFDFDKAKVKEESYGDIKNLADFMNQYPATTTTVEGHTDSVGTDAYNQKLSERRADAVRDVLVDQYGVGSERVNAVGYGETRPVADNATADGRAVNRRV

SEQ ID NO: 2463 - protein, 366 aa, Pseudomonas aeruginosa C3719
MPVRRKPLRPGKQRRLFGDRMKKKLIASSVMLLACAGAHAQSRIWLSGYMDLNIEHLISSGPGGNITRMSSGGLNNSRFNLSGVEELGGGNKAVFTIEPMFSANTGVQSTQFRQSFVGLKGNWGELTMGRQFTPSYWLAGYADPTWAADFSMVNDMQFFYATYRVDNALQYKTPTFHGFTGRVMITTGLGDGTRAGRFFSTGIEYRNGPLFLGAVSELQYTRDIFRSSQIHSSRDNYFSAVYRFGGFEPTVIYHTYNGYYAYPPYVAFNSQGWDAQIGARWNIDGINRVYLSVVHRHDDNNTSISSATGGVIGYIYGLSKRTDLYVTAAHVKSQHRVPVAYPVTFQVYPDGGQNPSGFQIGIRHAF

SEQ ID NO: 2464 - protein, 653 aa, Pseudomonas aeruginosa C3719
MTPHSSPHRLPPLRLARAVPFLYLLPCLALAAPVDLEPTVVSATTTERKLRDAPASVSLIAAEDLRRRPVRDLQEALRGSESLQFNGVGMSRRGISVRGMSSEHTLVLVDGQRISTSSGAIAHSDFDLGWVPVESIERIEVVRGPMSSLYGSEALGGVVNVITRRATDTWTGSGLLDGGVREDGLGGQSHQLGAYLAGPLVPGKLGLALNGESRRQQETPDADERRLSELEGGNADSGGLNLSWTPDDAQRIDLGHQRGRERRWRNSETGGPRSRYYESRDVIERERWSLAHNGQWDWGSSQLRTYRNRLERHNARSDGQPPSNPQRLTDSVVDGHLSVPAFERHLFTLGGEWRKEELEDRSVNTAGDASARHKALFLQDEIAFGPDWSLTLGSRFDKHEAFGWESSPRLYLLHHLSDVLTLRAGVGRGYKAPSLKQLSPEYAAVGGGGRFTIYGNPDLKPETNTSYELGADYQGDGWSLKGTVFENDVRDLIQTVCVARCGVRGGEIRNYENVDRARIRGLELGGGVDLPADLRWELNYTYLDARNRTAGQRLGDRSRHLANSQLRWSPNVRFSAQLRTEYVGSQVAYSSNVGYALPAYSLWHLELSQKLSENLTLRGGIENLGDQRLADDDTHFTYAEPGRTFHLGLVASF

SEQ ID NO: 2465 - protein, 800 aa, Pseudomonas aeruginosa C3719
MHRSKLSRSILLALSMASAGGAIAAEADAVDAAGSSRAAPTQLDAMLVTGTRASNRTQFETLAPVDVFTKEDIKSVESTDLKDVLAQLVPSFVVQRLPMADGQVFVRPATLRGLSPDQTLVLVNGRRFHRSALLGNRGAQAADLAQIPTSAIKRIEVLRDGASAQYGSDAIAGVINIILEDSPGTEITAGYSQYAQGDGGSRDFSARTGWALGDYGSLALFAESSNSDATSRTRQRPDAIAFQAAHPELDVPNPVQRWGQPELESRRVGFNLKANASDTLELYVFGLYSHSDGVSDFNWRNPDTTTGAYRTTSIFPGWNLRSLYPVGFSPQYGNTQNDLQLVAGLRGEITPKLRWDLSASYGRNAIDYSLDNSINASLGPDSPTSFDLGRLTQTEKNANADFNYEWDVAALPKPVNIAFGAEFRQETYQVRAGDPASYAVGRGAAAGLEANSNGAPGFSASQAGQWSQRSKAAYVDMEVPLGERWSIGAAGRYEDFSSFGSTVDGKLSARFAITPDVALRGTLSTGFRAPTPAQLNTTSTTQGLDTRTLQIFTSGRLSPSDPLAQLLGAKPLTPEESRTASLGLTWRTDLGLSGSVDVYRITLSDRFSQSASFAIPAGTPNPLGYTSVNYFTNDFDTTTTGVDVVGNYLRDLGAGRMTLTLAYNYNQTRVDNGSTSVATNETQRVLFEDRLPEHKGSFTGSWDIGAWSLMARVRYYGKWTDSTGNATGDIYQQFGAMTFLDLAVGYRINEHHSLSVGADNVFDRYPDEATFQASRGLIYSRNAPYDTDGANVYAQYRLSF

SEQ ID NO: 2466 - protein, 1034 aa, Pseudomonas aeruginosa C3719
MSNPRNRSALARGMTLALLAGASSTALATGAWAQTAPDAGSQVEEVVVTGIRGSQMRSVDVKRREASIVDAISSEDIGKLPDVTIADSLQRIPGIQIKRDAGEGATVNIRGLAQVITLLNGEQYLSAGNMGSAQPNLLDVPSQLMNQVLVYKSTDPKNALSGITGTIDLRTRRPFQMEQGLQIAGGVEGQRGERTKDNDYVINGLASWRNERVGLLVSAAASKANLGNNSSGVVGLSGNNDWGGSAANNFISPHGFESFHREVERKRLGVNVAFEADLGEGFTLVAEGFYAKLDEYNRAAGINISNRWDGGAFGVWTTPTVFENTGQTSAGNGRPWVAVDEYDINAWWVNSFAVNRTTKSTTKNYNLELKYDNGGAFTSEVRAIRANGNRLSMNGQAQGDLSNWQYAPGRFNLFRDPGDRTRGPFYPASICAQYPTSQRSNAVVGSAGGCYLNPNPQGYGANPQLHYNIGGNKAIWSGFDNPLAGGLGAGKTLKDYMANKDSYAIAAFSSEGNNEIDSDMNVFRAEGHYKFDNKFLGFITKIDAGVRQSDRTVNVEAFHLFSPFYGGTPGAVQANGTPVPAAGCFAQWKAIDVVMNQDQCQAGEFVPNPLGGAPVFQGYTVNRPTKIDAYNNVIFETNLGSITQGIPGFWVVDPHDFDNVAAFQTKVFGAAVRYQIPGATYDVTLKEQSAYGAANFEIGKLSGNVGLHVIQSHFLVKQNLTGATQNYGDTNLDVGDTVTNRKYTDWLPSLNAVYDFDDHLKFRFAYSKTMQPLDLGNYGGGLSISTADCGTKPGRCVTGASSSGNPYLDPWRSTNFDGAIEYYFGGASMVNLSAFKLKIDSFVTGGTTTGTFKDEDGTPRTVNVSQPIQGDGGSVKGVEVGTKLAFSDLLTDGGFFSNFGVDANATYSPSSESRLGLDGKKLPFTDNSKYQYNLIGWYQDDKWQARVAYNYRTDRLSSVSGSSGNNLPIYQDATGFVDVNLSYNVRDNIVVYANGSNVTGEIENYYVKFADGKTQYANQNQFEPRYTIGIRAKW

SEQ ID NO: 2467 - protein, 409 aa, Pseudomonas aeruginosa C3719
MHPTPRLAAALLAGSGLGWPLLAQADLVEDSHASLELRNFYFNRDFRQSGARDNADEWAQGFLLRLESGFSEGTVGFGVDAIGLLGFKLDSGGGSGGTGLLPADGSAGGSQDDYAKLGLTAKARVSNSLLKVGALHFKSPLVSANDTRLLPELFRGALLDVQEIDGLTLRGAHLDRNKLNSSSDYQVFSANRIGGRSDAFDFAGGDYRLTPALTASLHQGRLRDIYRQTFAGLVHTLDLGGQRSLKSDLRFARASEDGGFRELDNRAFGALFSLRLGAHAVAAGYQRISGDDPYPYIAGSDPYLVNFIQIGDFGNVDERSWQLRYDYDFGALGLPGLSFMSRYVSGDNVARGAANDGKEWERNTDLGYVVQSGPLKNLGVKWRNATVRSNFANELDENRLILSYSLTLW

SEQ ID NO: 2468 - protein, 416 aa, Pseudomonas aeruginosa C3719
MTRSAPNLLKSASLAPVLLACLPSLAGAEGFIEDASVSLGLRNLYFNRDFRQPGAAQSKQEEWAQGFLLQAKSGYTQGTLGLGVELIGQLGLKLDSSPDRAGSGLLPRHADGRAADDYARLGVAPKLKLSNTELKLGELLPELPILLRNDGRLLPQTFQGGMLTSREIAGLTLHGGQMRSLSQRNSSDHQDLSVDGRGGAFSDRFDYLGAEYRFNAERSQVGLWQARLQDIYRQDYYSLSHKQSFGGWRLGASVGLFDTRDEGAAKLGELENRALTGFFSATRGGHSLGAGYQRMYGDDGMLYIAGTSTPLVNDIQVRNFTSAGERSWQLRYDYDFVALGIPGLTAMARYASGAHARTKAMDDGRAWERDVDVAYVIQSGPLKNLGLRWRNAMLRSNHAADVDENRLILSYSLPLL

SEQ ID NO: 2469 - protein, 710 aa, Pseudomonas aeruginosa C3719
MPSRPRPSFVSHLLPGSLALCGLAIACAVQGEERRSLEPMVVTGSYNPSDTFDLPFSVDSIERRQIADGQLGINLSEVLPRVPGLVVQNRQNYAQDLQISSRGYGARSAFGIRGLKLLADGIPASTPDGQGQAATLNLDVAERIEVLRGPASTIYGSNAGGVIQMFSRDGQGAPRVGAEATVGSDGLSRNHLYTEGEGDGVGFLVDASRMDTDGYRDHSAARRDQTFAKLNFRPDADSRLALIYSSLEQNDIEDPLGQTWDAYKYDPRSVTANAELYDTRKSIDHQQAGMNYERYFGEATLQVNAYVGKRSVVQYQAIPKQIGCESNPRCQRNGAVIDFDRDFHGGTVRWLQPVSQAPGELNLTVGLDYDQSRDDRRGYQNFNGDQLGVKGKLRRDEVDTATSLDPYLQASWAIDAWTLQAGVRHSTMKMEVDDRYLSNGDASGSRRYRKNTPSFSVMYAFTPDLHGYLSAGKGFETPTQAEMAYAPVAANAPDVFNFGLKPATSSQYEAGLKARLWGNTRVNAAIFQVRTEDEIVVASSLGGRTSYQNAGKTLRRGFELGLESELSEHWNANLAYTRLSATYDSDFEAGGKTIGKGKHLPGVPESSLFGELVWKPAEGISMGWEGMYRSQVYVEDSNSEKAAPSYAVFNWRTRFEQRLGAWTFHQLVRLDNLFDRQYVGSVIVGDGNRRYYEAAPGLSWYAGAGVEYQF

SEQ ID NO: 2470 - protein, 362 aa, Pseudomonas aeruginosa C3719
MKSHFLAIPALMASTAAVHAGGIDRSGQSINALFESGRYAEFSFGHISPDTSGTSVAALGSRNSGNATEDYMQFGAAYKADINDKLSYAIIYDQPFGADIDYPTGTGYYAAGAQADLEAHALTGLLRYRMNDNFSVHGGLRVQTIEATAAVPFVGGYTVDGERDTGVGYVAGVAYERPDIAMRVALTYNSKIEHDVDTTEFGAAMSTTEIETPQSVNLDFQTGIAADTLLFGGIRWVDWSSFDISPAAYAGATGGASLVSYDNDVFTYSLGVGRRLNDNWSVSASVGYEKSEGGFASNLGPTDGNKSLALAAVYTRDNMKVTTGIRYVNIGDAQTAIPTNAPAANFEDNDAVAFGVKVGFTF

SEQ ID NO: 2471 - protein, 456 aa, Pseudomonas aeruginosa C3719
MNRRMMLASAALLLAPLAAQAQTRDVSVTIYNSNLALVEDARPLDLKAGRQKLEFKDVSAAIRPETVSLSAPGVTILEQNFDYDLLTPDKLMEKAVGQKVKIVRTNPGDGKETTEVATVLAANQGVVLKIGDRIEVLRDDGVPTRVIFDKVPETLRARPTLSVSVEAAGAGTRQAKLSYLTSGLSWKADYVALFDEAKSTMDLQGWITLSNNSGTPFENARTQLVAGDVNQLNDGGYRSSRSPGMISAGTESGVGERVADYYVYPLPERTTIASNQNKQVGFLSAQGVTAKKVYEVREGWFTSQAEPTKAVVAIQFSNARLAGLGAQLPMGTMRVYMRDAAGDPKFVGENAIGHTPAGSELSIKTGEAFDVSGQATLVAESRVSKRLTRYEMKYLLRNAKDQPVTVELRQGGLGRDSTVKAESLKGRRIDAGTLGWSVPVPANGETVLTFTVETGW

SEQ ID NO: 2472 - protein, 758 aa, Pseudomonas aeruginosa C3719
MTSIRAFLHASALSASLLVAAGAVQAQQAAPAAAADDAGTTGLQDIIVTAERRSSSAQRTPVAVTALSADTLVAAQVRTLTDMQQLVPAFKMGENDGYAQLTIRGIGSSGFVPTAEGAVAVNLNDVYVSRPIAQLAGMYDIASVEVLKGPQGTLYGRNATAGSVNMSTARPTNEWSGFGRVLVGNYRALNVEGAVGGALVEDRLLVRVAGFMDKHDGYGKNLVTGNDVSDKDAWGVRATVVVKPTDTLTGTLIYEHYKQSDNGAALHYFGAAGLTGLPGALGTPPVFQQLGGYAASDVQDIASPRDSRFRLRIDAVTGILEWSLGDFQLKSITGYRDQNSLTITPLGGGSSVDAFFIAGEPAHQFSQEVQLNYTSDRLKATAGLFYFREKDSSVPGSSPFPRSVLNAFFGVPDDGTPDYLVDFVEIGGTIKTRAKAAFAQATYEVVDNLSLTAGIRVSNERKQAFLVNGFSLTQPYIANSPTTNDTPLPPVTVQPRVSFNSTTPRLGIQYQVDPRTMVYASYSKGFKSGGYDVTTVAPAFEPEKLTAYEVGIKTTMANNRLRFNAAGFYYDYTNLQVLQVVGPAVVTTNAATARVYGVEAQIDAIVSDQFKLEASGSYLNTKYKNYAGPDGARPLLATVDFSGNHLNNAPEFQAYLAGTYTWALGDGEIAARVDGEYSTRYYFTPANLKLLSQKPFAKVNASLTYKAANNWQVTAFVKNITDIDTKTSGVVNTPILGTPAQGAVAPPRTFGLEARYSF

SEQ ID NO: 2473 - protein, 900 aa, Pseudomonas aeruginosa C3719
MAASALIGCAMSRFSTFLCPCRSLLALGVAASLSAQAAEPVVAAAGGETAPVQLDAVQVSGQHLSIRQAIGAKREAAVVSDGVAADDIGSIPDFGLGEALQRVPGVSMVVNNGRGEAQFMSLRGFNPDYNTVLIDGVALPSTETSRRVQSLDVIPASLAQQVDIYKTFNADMDSNAIGGIAALRTRSAFDHDGSFATVRANVADWENRRQLQGSTPSGQVQGSFSQTFGPDNHFGVVLSADYFRRDSSSLNTAIDSYSYYANGRRQDLTPALDTDGLAIAPDRFRPLSYDNVRQRRSAFGKLEYDDGDSLKLALSAGVFEHSNDEQRRSQWINRVGNAAVTDADSGRFAQGSAQVDANRFDQTRTLRYAQLGGSFRLNPEGHVDLVLNRATGRYVQDTREDVFAAAASARLGFGYALGSNTRPTITLADPAYYANPANYTQSYFLTRTEKSSTDTTTVKLDYSQNADADAQGWGLRTGLQYRDLQQRYNLDEVRRNPSGRVTLATVGTDDARICPFADFNCLLLIDPGKVAAFAAAAPGAYVLANTNARNSAISDFRIDERNGAAYAMGVWHGARTQATLGLRNEYLQRTVLSAVPQPLTSTSNYVQQSADSDRRFLLPSANFAWDITQALKLRMAGSRTIGLPTYGDIGQNSSPVVDVTGFTINRSIANPQLRPRRSDNLDLSLEWYPDRDSQLSVALFHKRIDDEIVRTTSTDTQRDPGGLSGTYQVTTTQAINAGTAQVQGIEFTAIDSRFDFLPGGWSNLGAMLNLTVLDPRTAEIQMADGSQRGLPGLMESPKRSANASLLYDVGPFSARISANYTGAQLISAATDNRVNDRYYDAITSYDAQLAWRLSAQLRLTLQGRNLSNARLTRVIGAEQQLMREQLDNGRAYYLGVDYAF

SEQ ID NO: 2474 - protein, 820 aa, Pseudomonas aeruginosa C3719
MTATAVVLRNAPSSLDFPRASRLSRSVRAALLSLAMAAGAAPLCASAAEAAAEQARPYAIPAGQLGDVLNRFAREAGITLSATPAQTGGYSSQGLRGSFTVQQGLARLLADTPLEAEDQGDGSFVLREAPAKDGDVLNMQAVEVFALGNNLGSTDGYLATHSQIATKTSKPLLETSQTVSVITREQIDDTASKTVQQAMRYTPGIFTGQVGASNRYDYVVMRGFADNSVDNIYLDGLKAMGDSGTFSSMQVDPYFLERIDVLKGPSSVLYGRSLPGGLVALTSKKPLYEDYRQITGSIGNMGQKEMGFDFSGPLDEEKRIAYRLIGLGKGSDTQFDHVKEERYAIAPTLAIDFSDDTTLTLQGYLQHDPNGGYHGGVPADGTLSHHNGRHISREFFDGEPSKDDFDRTQRMFGYQLEHRIDDVWSARQNFRYLDSDVDLSQVYAYGWSASEPNKLNRYFSGAREHLQAYIVDNMLQAEFATGAARHTLLTGLDYQRRRTVVDWRSGSASALDAFNPVYGDDAISYFPDDNHTRRLEQTGVYLQDLIDIDQWRFSLGLRQDWVSVTDKNRSTGSKADDDWEKFTGRIGALYLFDNGLAPYVSYSESFNPNAYSDASGTPLAPTEGKQWELGLKFQAPGSNSFYTASLFHITQENVASKEPQDNFYTSVGEVRSQGLELEAHTQLSDNLKLLGSYTYTDITYTKSLDGNQGHTPNQAPKHMASLWADYAFDAGPLSGLSIGGGARYVGETWADKENTLRVPDYTLVDARIGYDLGKLGLKGLDVSLNANNLLDKDYVASCYSLDFCYFGEKRNVTATVNYQF

SEQ ID NO: 2475 - protein, 878 aa, Pseudomonas aeruginosa C3719
MQGDCRKLVLVLLFLWLNAYSIAWAQAPPRHFIKGVVKAAKESEPIVGATVILLEKEKIIGVTSTNAQGLFLLQTSQKQPLQLKVKFIGYNDFSVQITPTLSPQTTLEISLKENNLTLSAVEIIGDAPGSYRKLPGTATRLKTEDIQMIAPVGTQEALEYVPGVNGVGDDGFGNSRLSIGIRGLNPRRSARVLVLEDGVPIQPAAYVYPNMYYNPPVERLEEIEVIKGSGSIKYGPQTMGGVINYITRRPRKDFGGMVMLTGGTNGYASAFAEIGGWGNNKVHPELQLLYKRGDGYRENNTFEQINATLKTNIIAKENKKLYLKYNLNMEDNQATYTGLTEYSFRTNPRFNPKKNDEFKVFRTSLDAIYEVQINKHLVAVTKGYASYFDRDWWREDDMFIRATSLGAYLNGQEVEAQNYTSATDLVRVGNGQTNFGILRTFATAGIEQNYNYEYQLFGKGATLNIGGRYHYERFMDSFKVGSSPTDREGALYQTVSVTDSTTGATTQFREALPRAQSRTFTTTAFSFYAQQNIQFTERFSMRLGARVEAFEQEVVDKLQGSKYNDKTTVVVLPGAGFNFAALTDFTLFGGVHRGFTPPQSGSFSLPFVDNGSQNTGSTLDLAAEKSWNYELGFRVNKSWGNFEVAGFLLDIEDMVAAARSAVFLNLGKVRSTGLEAGGSIKLSRLSALLPDINFAYTYLQSKVVNALTPSHLNSRYDAYRADASGTLVAVQDTIDISGNDMPYAPNHTLNIGLAKSFAFGLSLRADFKFVSQSFSDFENLTEGFVQNATYLDANGNERKYLGFRGDAGPIPAYYLINLSASYSFNKKWRVFATVKNLLDNIYISSRLHSHPSRPEPTASSGILVGARRQINAGVSWSF

SEQ ID NO: 2476 - protein, 884 aa, Pseudomonas aeruginosa C3719
MPDVRLSSRSLTPVLCAVGLACALQGEVQAADGGPRDAATAPRVFDIAPGELAEVLLNIVRQGHVPIAFDQRLVAGLRGPDIRGRLSVEDALRRALAGSGLAYAQDESGAFVLRGGQAPVQETRGAAAAPTLSTVVVTGTRKSDVKAQDSLSPIDVVSATQLRSSGAVDLRDALVKLLPSLTRQAQPFNASALTHTQSLRGLSPNHVLVLVNGKRRHETANLNISGGLEKGSTGVDLDTIPINAIERVEVLRDGASAQYGSDAIAGVINVILKSADHGGSAAADVGQTGDGDGFTHGGGGNIGLAFGDSGFVNLTAEYREQERTMRSGIDERTGRRDNISMGDPAFHRQSLALNSGFGLGDDIEVYGFGTYTRRKASSAANYRLASVAPTLYPDGFTPRPNSDEDDYAFLAGVRGERLLDAWHWDLSSGYGADRPDIGMTQSVNAAIYRETGNSPRSFDLAHYRNSQWTSNLDLGREFQLDFLAAPLALSLGAEYRRETYRIDAGDPASYYSGGAESLAGLSPLSEGQWSRHAWASYLDLGTSLTPAWEVDVAVRHEKFSDFGSTTNGKFATRYQFDPRVALRASVSSGFRAPSLVQEHYTGLSVGPTIALGLLAANSPAAKMLGADELQPEKSTSFNLGLVLNPWENVGLNIDAYQISIRDRIVDSATYSGQEAIDALAAAGISLPASASTVSTHYLANGADTRTRGVDITGHYLVALGEYGQVDWELSANFNRTTLRKNHRGANGEPLLNAQQVAWITSSTPRSQVSLGGTWSRQDWEVSLRLTRYGRTSSELDYTVGPDAWSTEKFNHFVNDPKYITDIAARYRLSADLTLTAGADNLFDVRPDKLPAQNTTYGDVLRYDTYASQIGFNGAFYYLRAAYRF

SEQ ID NO: 2477 - protein, 746 aa, Pseudomonas aeruginosa C3719
MSSRALPAVPFLLLSSCLLANAVHAAGQGDGSVIELGEQTVVATAQEETKQAPGVSIITAEDIAKRPPSNDLSQIIRTMPGVNLTGNSSSGQRGNNRQIDIRGMGPENTLILVDGKPVSSRNSVRYGWRGERDSRGDTNWVPADQVERIEVIRGPAAARYGNGAAGGVVNIITKQAGAETHGNLSVYSNFPQHKAEGASERMSFGLNGPLTENLSYRVYGNIAKTDSDDWDINAGHESNRTGKQAGTLPAGREGVRNKDIDGLLSWRLTPEQTLEFEAGFSRQGNIYTGDTQNTNSNNYVKQMLGHETNRMYRETYSVTHRGEWDFGSSLAYLQYEKTRNSRINEGLAGGTEGIFDPNNAGFYTATLRDLTAHGEVNLPLHLGYEQTLTLGSEWTEQKLDDPSSNTQNTEEGGSIPGLAGKNRSSSSSARIFSLFAEDNIELMPGTMLTPGLRWDHHDIVGDNWSPSLNLSHALTERVTLKAGIARAYKAPNLYQLNPDYLLYSRGQGCYGQSTSCYLRGNDGLKAETSVNKELGIEYSHDGLVAGLTYFRNDYKNKIESGLSPVDHASGGKGDYANAAIYQWENVPKAVVEGLEGTLTLPLADGLKWSNNLTYMLQSKNKETGDVLSVTPRYTLNSMLDWQATDDLSLQATVTWYGKQKPKKYDYHGDRVTGSANDQLSPYAIAGLGGTYRLSKNLSLGAGVDNLFDKRLFRAGNAQGVVGIDGAGAATYNEPGRTFYTSLTASF

SEQ ID NO: 2478 - protein, 435 aa, Pseudomonas aeruginosa C3719
MIRVRPVGRLALFLALGGTSPCHAATEEAKAPDYLEWRLLNRNYFLYNDYRRADAGRGYRKEWAHGLIADLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDLDRVRIQAGRFTAFKEQASSSGHGDFDGYGASTAGSAIGFAGASLAASDNLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSFMARYVSGRAIDGSHAPAGGAYNPLGADGRYRPLQGSGGKHWERDLDLRYLFASGPFKDLSLNVSHLSHRANAAQAGDDIDRLYLIVEYPLKGSL

SEQ ID NO: 2479 - protein, 766 aa, Pseudomonas aeruginosa C3719
MLKKNYLTVSILLAISGVGYANEISLETITVDGNTPSTKGKLLGGELNSNESVVDEKNLKQGSITLGNALSGELGIHSSQFGGGASTPIIRGQESKRAKILQNNGENLDMSGMSPDHAVTVDALLAKRIEILRGPTTLLYSAGNTAGVINVVDNKIPTAIPEKGYEGQFGVRFGSASKERLTYAGSTFALGNHLALRVQGMYNKASEYYAPHFTIEGKPYHRVPDSDVQSQTGTVSLSWIGERGHLGIAYTDRRDKYGLIGHTHKYDHYTISIIRQAVMFAKGYLRFYPHLAEEGDIDYNNPGIRLLHTHIPGGSHYGQDTHEHGKPWIDMHSKRYDIDGSLQNPLPGFEEAKISANYVDYYHDEKDGKRVENYFKNKGKNLRFELVHKEWKGLKGAIGVQYTNQSTSALALEASRAAKVFNKQPLLNNPKTKLWSLFAIERLNLGDFTFELSGRAERQKIAMDYDVKLIDRWLGFNTPMPNLDPHKDKGYSYSFATHWYFAPNHKLTLNAAHQERLPNAQELYAHGKHIALNAFEAGNKNLKKERSNQIELSLAYVGDKWDYKLNLYHTRYGNYIYPLTLNDNRGPKSFTDEYNLKVNRYYQGEARFSGAEGEIGYLFTPNYRLAVFGDYVRGKLVNLPNIAMSYNIWTGEVDKWASQPDISAPRIPPLRLGARFNADFNLNWSGMLEYYRVFAQKKVSKYEQVTPGHHQVNLGVTYSNHFNQTEYQVFLKVDNLLNQKMYQHASYLPHIPQMGRNAMLGMNISF

SEQ ID NO: 2480 - protein, 421 aa, Pseudomonas aeruginosa C3719
MSMTPIARAVAFAALGSSITVPSLAHAEFIKDSKASIELRNFYFNRDFRQEGASQSKAEEWAQGFLLRYESGYTEGTIGFGVDAIGLLGVKLDSSPDRSGTGLLKRDRESGRAQDDYGEAGITAKLRASKSTLKIGTLTPKLPVIMPNDSRLLPQTFQGGALNSMEIDGLTLDAGRLKKVNQRDSSDNEDMTITGGGKRNIVVRSGLTSDKFDFAGGSYKWTDNLSTSYHFGKLDNFYKQHYLGLVHTLPIADKQSLKSDIRWARSTDDGSSNVDNKALNAMFTYSLGYHAFGVGYQKMSGDTGFAYINGADPYLVNFIQIGDFANKDEKSWQARYDYNFAGIGIPGLTFMTRYVKGDNIDLLTTSGEGKEWERDMDIAYVFQSGPLKNLGVKWRNATMRTNYTNDYDENRLIVSYTLPLW

SEQ ID NO: 2481 - protein, 454 aa, Pseudomonas aeruginosa C3719
MYKNKKTRPAARTVGCLFALGALGLGNAAHAAEAFDPNSKWMLGDWGGKRTELLEKGYDFKLEYVGEAAANLDGGYDDDKTGRYTDQFALGVHMDLEKIFGWKATEFQFMVTERNGKNLSNDRIGDPRAGHISSVQEVWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDTSRGLNLFANLTVHDKATNVVDNYQQLGVVYKGPFDARPKDDIGLGIARIHVNDDVKKRQRLVNQVNGIDDYDNPLYQPLQDTEYNAELYYGVHVTDWLTVRPNLQYIKRPGGVDEVDNALVAGIKIQTVF

SEQ ID NO: 2482 - protein, 483 aa, Pseudomonas aeruginosa C3719
MSSVSLPGTSPAAVPVRVPRRLCIAALACAAQLLAGTAAAQQAPAAAPTSAEPPAEADGLWTRDTLLGDIGGLRPWLGKYGVTLAATETSELLANLHGGLERGVGYHGVTTVTLGLDTEKAFGWKGGSFNASALQIHGRQFSQSHLGTLNTASGTEADAATRLWELWYQQSLLDDRVDVKIGQQAVDQEFLTSTYSATFMNTMFGWPALPSYDLPSGGPAYPLSALGVRVRAKLTPSLTALAGVFDGDPLGNNPDNHSGTNFNLHNGALFIGELQYAINQDGAAGGAAKSGALPGTYKLGLWYHSGSFADQRDDTAGRSLASADSTGIGRPRHGDYSVYAVADQMVWRAGPDSPRSLGVFARVMAAPGDRNVVSAAANLGVVLKAPFAGRDNDSAGLALTYVKVGRHARALDEDARAFGGAPYGVRGSETALEATYNYQVAPWWQIQADAQYTFNAGAGQNPDDPRAPLHNTFVLGVRTTITF

SEQ ID NO: 2483 - protein, 440 aa, Pseudomonas aeruginosa C3719
MIRRHSCKGVGSSVAWSLLGLAISAQSLAGTVTTDGADIVIKTKGGLEVATTDKEFSFKLGGRLQADYGRFDGYYTNNGNTADAAYFRRAYLEFGGTAYRDWKYQINYDLSRNVGNDSAGYFDEASVTYTGFNPVNLKFGRFYTDFGLEKATSSKWVTALERNLTYDIADWVNDNVGTGIQASSVVGGMAFLSGSVFSENNNDTDGDSVKRYNLRGVFAPLHEPGNVVHLGLQYAYRDLEDSAVDTRIRPRMGMRGVSTNGGNDAGSNGNRGLFGGSSAVEGLWKDDSVWGLEGAWALGAFSAQAEYLRRTVKAERDREDLKASGYYAQLAYTLTGEPRLYKLDGAKFDTIKPENKEIGAWELFYRYDSIKVEDDNIVVDSATREVGDAKGKTHTLGVNWYANEAVKVSANYVKAKTDKISNANGDDSGDGLVMRLQYVF

SEQ ID NO: 2484 - protein, 438 aa, Pseudomonas aeruginosa C3719
MIRKHSLGFVASALALAVSAQAFAGTVTTDGADIVIKTKGGLEVATTDKEFSFKLGGRLQADYSRFDGFYTKNGNTADAAYFRRAFIEIGGTAYKDWKYQVNFDLSHNTGSSDNGYFDEASVTYTGFNPVNLKFGRFDPDFGLEKATSSKWVTAPERNAAYELADWINTHQDGMGAQVNSTLADMAYLSAGVSAKDADDRDGDSVKQFNFRGVFAPMHETGNVLHVGVNYAYRDLDDTAFDSRIRPRLGMRGIATSGGNDAGDNGNRATFGGVSNSPAGSYKDDSVWGLEGAWAMGPFSAQAEYLARKLKADDNGYKDIKAKGYYAQLAYTLTGESRQYKLEGAKFDSIKPENKEIGAWELFYRYDNIKVEDDNVVADTATREVGDTKAKAHNLGVNWYVNDAVKISAAYVKAKTDKITNANGDDDGDGFVTRLQYVF

SEQ ID NO: 2485 - protein, 792 aa, Pseudomonas aeruginosa C3719
MKHRFPELCSIRRSSGRLIPLVLMITMINNANAQDKPDEPRKVLNKVTVEAAAIQSTTENTQVTSSEDIEDNQVRNLDDLVRYIPGVAVDDIGRFGSNGFNIRGMDGDRVAITVDGLSLGETLNPASYAPYEFFSSGRGGVDIDAMKAVEIVKGADSISAGSGALGGAVMFVTKDPADYLNPSGNDTHFGLKFGYSSANDEALATATLANRTGNWESLLVYTAREGHETESFFSGSRPDISGTAREIPDPVDYDNDNVLFKLYYRPADGHRLGFVAEKYNSNIELDNQTRLNDSYLMRTTDDKTERERYGVNYLWQADNALFDELDWRYDYQTAYTLGHTLMVVPTGCPAGANSPAVAPCNRTEHRDYDQEIHKTVLHLDKTIANHTLGYGVSIEEKSVTYADVKTRYVGTTSEVGVGWPQLGGDFVPDTDVGSYGIYVRDQISLVDNRLLVNTGVRFDHYKYSPSLNNSQFNDNSGTVNDVTFSSPTWQLGASWNLTAQHILWVQTGSGFRAPTVENMYFSPSTAIATEVSSGQQVDLWNTVSNPDLEAEESRNIEIGYRWHGNSHVFGISTYRNDYSNFIDYNTFIRNADVEYQTCNTAGTVCNNFFGDEYDSLDNIGEVTVKGIEVEGLWAITEQVRLRFAYAWSEGEEKDGTPLQSIVPASGIIGLGYDAPNGRWAVETNVVFADGKDKKDATAVDPVNFTQIPEDYFTDYGDYTLVDLQARYNITQNLKLNVGVYNLFDEEYIRWQRIRFVNQGSAAGGARGGVSEDGIHRYTEPGRNYRLTLAYTF

SEQ ID NO: 2486 - protein, 995 aa, Pseudomonas aeruginosa C3719
MTDDHSFRPRPTSLSAALLLGAWIAQPATAAYVEAGRPGDPASWRSAEYQQDWGLERMRADQAYAAGIDGQGVKIGEMDSGFDPSHPDTPASRYQPVTASGTYVDGTPFSVSGAMNGNNDSHGTHVGGTLGASRDGVGMHGVAYAAQVYVANTNQNDSFLFGPTPDPNYFKAAYQALADAGVRAINNSWGSQPKDVSYETLDGLHAAYAQHYGRSTWLDAAAGVSRQGVINVFSAGNSGYANASVRSALPYFQPDLEGHWLAVSGLDQQNGQRYNRCGIAKYWCITTPGRLINSTMPGGGYANKSGTSMAAPHATGALALVMQRYPYLNNEQALQVLLTTATQLDGTPTGAPTDTVGWGVPDLGRAMHGPGQLLGRFEANLPAGLRDEWSNPISDSALLQRQAEDAAEHAAWQRTLKDKGWENGLPAGASQQERTDYAIGMARDQAAAQRQYQGSLVKAGAGSLVLSGDSTYRGPTLVDGGLLSVDGSLLSAVEVNAGGTLGGSGRIGGLLARSGGTVAAGNSIGTLEVAGDLRFESGSTYAVELSESASDRIVASGKASIAGGNVTLAMENSPDLLSQSQVESLVGRRYDILDAAGGIDGRFDAVLPNYLFLGGTLDYAANAIRLDIGRNGTTLASVAQTPNQAAVAGAVETLGAGNPVYESLLLSENAATAQRAFQQLSGEIYPALAGLLLNDSRYLRDSVGERLRQTSDGEAGGEAPEGWFKALGSWGKSADGSHGSEGYRHSVGGFLLGVDSQVASDTRLGLVAGYSNSSLNMDSSLQSSASIDSYHLGAYLGRQLQQWRLSLGAAHAWHRAEVKRDLQYGAVAGKQKAKLDAQSSQLFAEAAYALGWRSLELEPFAGLAYVHVASDDFRERGSAAALEGGDDNLDAAFTTLGLRAKRHFELDAGRRLALSGTLGWRHNLSDTTPQRHLAFASGSQPFSVESVALSRDAALLGVDASLAVNREVSVRLGYNGLLGSREKDHGVGLAVDWRF

SEQ ID NO: 2487 - protein, 416 aa, Pseudomonas aeruginosa C3719
MNNNKKCAFFLLPILAGDSVPALAEGFLEDSRASLALRNFYMNRDFRDGAGRAKSEEWAQGFLFDYRSGYTESTLGVGLDLLGKLGVRLDSGAGRSGTGLLPLRDDGSAAGDYARLDATAKLRLSRSELKVGGLVPKLPTIQPNYGRLFPQVFQGALLTSGELSGLSLNLGRLTEVSQRNEAGTSDLALFNRNRRFAGAAQADRFDLAGLDYRIAPDWTGSYHYGELEQVYAQHFLGLKGRIGVAADSLESDLRLALSRDTGGARGGRIDNRSFSGLLTYRLRNGQAFGLGYQRMSGDHGFPYLEGTDPYLVNFGQYNDFAEAGESSWQLRYDCDFAPLGVPGLSLMTRYFSGHGAKPKGADGSREWERDSDLRYVLQGGPLKGLGLVWRNATYRSAFSRDIDENRLYLTYELPLF

SEQ ID NO: 2488 - protein, 1043 aa, Pseudomonas aeruginosa C3719
MEKRKTFHGRQVGKKRLLPIVFPLFLFLLIPLNGYGDDTPMPEVVQQNSTRITGVVKDAYGEPVIGANVKVVGTTQGTITDFEGKFSINVSGASAKIKISFIGYKDKEVTAKKGVSLNIVLEEDAQTLGEVQVVAYGVQKKVSITGAISSMKGDDLLKTPAGSLSNVLSGQITGISSVQYSGEPGADAADIYVRGVATWNNAKPLIQVDGVERDFSQIDPNEIESVTVLKDASATAVFGVRGANGVILITTKRGAEGKAKVSFSTSAGVNVRTKDLEFANSYQYASYYNMMKVNDGGVATFSDEQLETFRNHSNPLMYPDINWIDYCMNKAAFQSQHNVNISGGTSNMKYFVSAGLFTQGGMFKQFNATDDFNFDYKRYNYRANLDFDVTKTTLLSVNIGGRIETKRTPESGEDQNQLFRKLYWAVPFAGAGIVNGERVVSNSEVLPFTGVDGLSSYYGKGFQTKTTNVLNVDLALNQKLDFITKGLSVKLKGAYNSEYANTKKASSSKAYYTPVANADGSISLRKYGTDSQLSYGEPDNGFSKARNWYMELALNYARKFGDHNVTALLLYNQSKKYYPSEYSDIPTGYVGLVGRVTYDWKTRYMAEFNAGYNGSENFRPGNRYGFFPAGSLGWVVSEESFFQPIKSVVNYLKLRASVGMVGNDVSQRFLYLPDSYQYGDGGYYFGQNVGNKMPGASEVSRSNPDAKWETAVKQNYGVDATFLAERLTVSLDYFREDRSDILSKPDYLPAILGMSLPSVNVGETLNRGFEVQLKWNETLKNDFRYWANFNISFSRNKIVYKNEVDQNEPWMYETGRRIGSRSMYKFWGFYDETADMRYQEEFGRPIANHGITLVPGDCVYVDLNADGEINSNDATRDIGYTDMPEYTAGLNTGFSWKNFDFSMQWTGAWNVDRMLDEFRRPLGDTNEKGLLLYQYDTTWRSSADTFTAKFPRTSSLHASNNYAGSDLYLINASYLRLKSVEIGYNFNFPFMKKLKMDNCRLYVNGYNLITITGFKWGDPESRQSSRPNYPLTRVFNIGLKLGF

SEQ ID NO: 2489 - protein, 739 aa, Pseudomonas aeruginosa C3719
MRKSVVTKWMLLAGVALSAGSAQAEQAASEAGRAVDDAASSGATGDIVVTALRRETTLQKTPAAVAAISGEELQARGISDIQDLAAAVPSVSFGQTIGQAHIAVRGIGSDVVTAGQDPRVAFYQDGVYIARPGAQLGGMFDVDRVEVLKGPQGTLYGRNATGGAVSVVSRKPTDTLEGYVRTGYGNYNAVTLDGAISGPIAETLTARIAGHFEHRDGYGKNLVTGKDIDDKREVALRGAIAWRPSDRLELLTTVDYFRESDNAFGLHYFNQGNPNVPVLGLKLGGLAARNSRDIYSDVDPKARTRSWGITEEISFDADWAKLRSITSYRKFKGFYLTDIDGTSVQLAYDKLFENAKQFSQEVQLDGEVDRFAWLVGALYFHEKNDGAGSEIPINSVVAGGPFSLRQAFLSIGDLKTESFSAYARVTFDATDWLKLTAGGRYNWEKKSISDVFQFDFSRPYVPGAPIIPIPPFPRSTSDSFSGFTPSATAELRLSPSVFAYFTYSQGFKSGGYNIGVAQAAFRPEKIKSYEAGVKTTTFDGRLKANLIGFHYDYSNLQVSQVRGQSTLVENAAAAKVDGIEAELIAEPVRGFSFGGNLSYLDAKYKDFLSIDPINVAAGPQDLSGNRLTQAPKISYALFAQGKWDVGDYTLTLRGDYNRIGLQYFTPFNNPIVAQDGYGVGSALARIESEAGWSVEAYVRNIGNTKAIAQTYVSSGMFGFPVLGALIPPRTYGLTLGYKL

SEQ ID NO: 2490 - protein, 418 aa, Pseudomonas aeruginosa C3719
MITACPRPCAWRCYALGLGLLPLAAQAEFLADSSAHLDLRNFYQLRDYRQHDAPQSQAGNWSQGFVLRLQSGFTGGPLGFGLDATGLLGVKLDSGRGRSNDGTLPFGANSKEPVDDYSHLGLTAKLRYSQTQLQVGILMPQLPVAFRDDVRLLPQTFDGALLTSSEIEGLTLTAGQLWKSRTRESAGSDDMYIMGRDKAHASDEFNLAGATYAFTPRLSASYYYGQLKDIYRQHYLGLLHTLPLGEGLSLRSDLRYFDSGEDGAAISGPVDNRNLNAMLTLRAGAHAFGIGVQKMIGNDAFPVLNGYTTPYVANLMAYQTFTRPQEKSWQLRYDYDFAGLGLPGLNLMTRYVQGRDIDRGAGRADDSEWERNTDLSYVIQSGPLKSVALKWRNITYRSRYGADLDENRFIVNYTLKLW

SEQ ID NO: 2491 - protein, 694 aa, Pseudomonas aeruginosa C3719
MNARTHRTLNRGIGVVTLSTLLASPSALARENPPAEDEPAALEALVVTGEKRERSLKDTASSVSLTSARDIDRKQTGNASVAEVINGSPNVVYTDSVGAPIIRGQDTQGPNNGQNVFWGGTVPRATINLDGHYLNYNEMFFGATSVWDVDSIEVFRGPQTTSQGANAIAGAIIVNTKDPTFSPEAAYQAEIGSYHSRRSSIAVSGPLAQDFAGRLAVDYAGRDTFIDYDNPKFQDSGTDQDFRALNARAKLLWLPSGIPGLESKFTFSHNDSNRPTQEAATRPFDKLDHRSTTMPSWEQDTNTSILDVAYDLDNGIRLFNQAQYSLSSVHRTTGAGGEGDADIRQKNASNESRISFGEQEDRISGMGGVYYARTRTDETLHLRGLSAFDDTKKNLGVFGELNYRLSDRWTLTTGLRYQEDRIERSGNSVLAPRPLDYQKTFSAFLPKVSLAFAATPDWTVGGLVSRGYNPGGVSLNLTTRNWAYFKEETIWNYELFTRASLLDGRLLLNGNLFFMDFKDAQYNIPVVVSPGVAQSYTINAEKAHAYGMELDLDYRLRDDLRLKASAGVLRTRIDEMSGNTGYEHNEFARSPGYTLSFGPSWDVTERLNLNAQVRYLDGYYSDTANTKAYSIKAYTLTDARASYRFNDQVQLYGYVKNVFDDRSPTYMQENRGIGGIEASMTQPRTLGIGIKGTF

SEQ ID NO: 2492 - protein, 908 aa, Pseudomonas aeruginosa C3719
MKHVPIHQTFTRSTLFVALSLASSLAMAQAPADENIEEIVVTGKFLKSLQSAMEVKRNAASVVEAISPEDIGQLPDVSISDSLKRLPGLAQDRDRGNGSQISIRGMGGMLGFTTLNGREVAILEETRNIRYDQFPSELINAAQVYKTPQAWIAEGGVSGTVNLDTIKPLDYDSTKVVVDLRASMSELGKDIDDAYNDGIGQRLSISYIDQFLDNTLGVALGYSTRSEPIATQRAELWNYGDTWHNTQWNNELGANVVAPWGGSALVRGGEDKRQGVMAAIQWRPNDNLEIAYDGFWSAFDIAETQRGFDFQISNDWNNQWIPLKTTPTAYDNVPEAGAVDLLAGTVPLSSLRNLNEEYVQDDELISNGINVKWQEGAWTIKADAAVSETSRDKRWATVRTINDAPGWATFSSTGDGRMTFELLDADLADVTQNRVTELHVQPQAEGGDKVQSFKLDFQYDVDAGILQSVKFGAAASQRDKYEHNQIWTQSPTASDTSLTSAYVVNAKSSSYWGDLPAYLSLDRNAVIADYFGGLQNPTPGDADDLTASWDVSEDISAQYIQFDLATQVFGRDLSGNIGVRNVRTETLARGYEQGETQEVWEEIPAGSGTWVMTGSVETVTAVATPHDYNDVLPSTNWTLSLTDEHLIRIGAAKTMARAPVNMMSPSLNLNQDLWGANPGESTSGNPKLNPFRATQYDLAYEWYYSEKSQIAINLFYKELDSFIMRAADAETIERNGQEYSVSRPVNGSGGYIRGYELLWQQSFDFLPAPFDGLGIYTNFSHNESNVEQALPLHSSYKAGLTGLSENVGNFTLWYYHNGFEARTSYSYRSEFQRDINLVMGEEGVNDAEGYWDLSLSYEFDDHYKVYFQVQNLTNEPYKTYGLESNNPAHINRYEEFGTRYSVGINWKL

SEQ ID NO: 2493 - protein, 1096 aa, Pseudomonas aeruginosa C3719
MKTETFKFSRKATTALLLCTGLVASQPLSLWAENDSGAVQIVQQQKITVKGTVNDAMGPVIGASVVEKGNSSNGTITDMDGNFSLSVQPGTVLVVSYIGYKTQEVTATVGKAINVTLQEDNEMLDEVVVVGFGTQKKVNLTGSVGIATAKEIESRPVTSAVQALQGLVPGLKISTSTGELDKNMSISVRGTGTVGSYSSGSPLILIDGTEGDLNTINPQDIENISVLKDAAASSIYGSRAPFGVILVTTKSGKAGKTSVNYNNSFRIGSPINMPESMDSYSFAVMFNETYKNQKGSGQVFTDEVMQKMLDFQAGKLTGGMDSDPANPNAWNYPWYNAYANVDIYSEMFKSSVFSQEHNVSVNGGSEKVTYYASFNYLDQGGLLEYGEDGLSRYNVAAKINANITKWLKFNYSTRFTRNDVWRPTSFNSQFYDYFGRMTWPNMPMYDPNGYPYGEVRNIAEGGQRDVQTDRHYHQATLIIEPIKNWVTNIELNYRITDGGVKETTLPAYNHLPDGSVDDTKANSSLYQEDTKENYLNFNAYTSYLHTFNDTHNLKVMLGFQSEETKYDFSSTKKYGLMVNGLPQFDLTTGLDGTGNKKDTEVSGYHNEWATVGFFGRLNYDYKGRYLAEVNMRYDGTSRFRRGSRWQLSPSFSLGWNIAQEEFWKPIENIANLLKVRFSYGELGNQNINNWYPTYRTISIGSLNGDWLQNGLSPNTSSVGGLINTALTWEKVRTWDVGVDYGLFNNRLTGSFDYFVRFTEGMVGPSAELPATLGISTPSSNNSDLRTKGWEVSIGWKDRLKNGLGYGINLSLSDQITMIDSYPDNKTLSIDSYLPGYKDGLIWGYETIGIAKSDEEMQAHLASLPKGGQDAVGSQWAAGDIMYKDLNGDGKISEGARTLGDHGDLKILGDTYSHYFFGIDLNADWKGFDFRAFFQGVLKHDYWGSGNFTGMLFGVRGGYSRWHTRGFKQHEDYFRAEPAGLEGHELPANLDSYYPRPIFSDSSDGTSFGAKNQKVQSRYVQDASYIRLKNLQFGYTLPAKFTNKFGINRLRIFVSGENVWTGTGLTKLFDPETISGGNGGNAYPLSRTWSFGLSLTL

SEQ ID NO: 2494 - protein, 730 aa, Pseudomonas aeruginosa C3719
MKKHSTARRVLALGLNLTLAGVPALLWADEEPTELPALTVSAGAAGETPPALDLDDSAGGGSRLGLSLRETPGSVSVANRASFERRGLRSTQDIANSLPGVNASAPPGFGGFVTYRGFSSNQVNQLFNGIPVQYSSAMRPLDDWIVDRVELVGGPSSFLNGAGAVGGSLDYISKLADRYGDFMEGRVRYGSYDDSEVAFGFNQALGIGPEPKHFVRLDVSRSGGNGYVDRNSRESWNVAFSLLSDLTPDLSHTLALEYQDEQEDSPYWGTPVLNPYAGELKIDKSRRRENYNVADGRYEQRVRWLRSILEYRVSDSTRWRNTFYHYDAERDYRNLETYRYNADNSGVVRSNAFLQRHDQQLDGNRFELQHSQPLFGLASDWALGFDYSINKQTRFPSTASGPFGTVDPASFEPGHFYDLPGMRPGHRKDRSNEVRTSALFAENRLGLTDELSLVTGLRYDHLDLDVRNHRVPDKDNPAHFERRWDVLTGRAGLVYQFTPHANVYLQYSTAADPPGGVLTSASFAQVRDYDLSTGDQWELGSKFDFLDGRGSATLAAYRIVRRDFSVADPNDPNLSVPVGQQTSRGIEAAASLRITPKLLVEGNFAWVDAQYDEFTENVGGVAVSRKGKTPPNVPERVGNLWLTYDFDPAWQGGVDARYVSSVYANNANTWHVPSYTVYGTFLSYRLDERTRITGRVRNLTDEVYARFVQSTPLYYVGDPRTFELSVQTRF

SEQ ID NO: 2495 - protein, 647 aa, Pseudomonas aeruginosa C3719
MFKPLAVAVGLGCAALSLGANAYQYGEYAGETLERLITDYPGRYRGTASFAGASELMQSRLGFGYQTSRQDFTWAGNRSSQNVIASAPGSSGKFLVLGAHYDTYYGRPTLQGLDDNASGAAVLTEIARNLGGIALENGLEVVGFGAEEEGLRGSRAYVESLDASQRANLLGMINLDSLVTGDKMYAHAGSNSVSSPALGAYREQILRIARELDIPLFTNPGLNAEYPAGTGCCSDGESFNGMDIPVLFIEATNWELGDLDGYEQTDNPAIPGGSTWHDPAEDNKEVLTNALGQERIEQRMRDFSRLLTRLVLELTNADLLASTASGGALARQMEDQLQRQHQALTRLHDRRWLTLLGSNRPVGSFDGEVGAEGEVSPDSGFDMPGNPESRRAGVHLLGDYRYSEALTLGGSLAFQRSRDKLDHGGRIEGDTWQLGLFGLYNDGGPEWLAGELNLGHTRYDSKRSVYLQAAGGPVLLDQRLSGDTSAWSWGARLEGGYDFSFGELRSGPLAGLDYMHYRIDDFREDEALRTALGYEKQDYDSLEASLGWRLRGELALGARMRLQPYASLRWVRELADGRLDDMDLTSRGDGRVRVADMGGVDRDFGRAQLGAQLAITEQLGVFAEANSRFAHSEGNQAGYSLGVNWQF

SEQ ID NO: 2496 - protein, 463 aa, Pseudomonas aeruginosa C3719
MKSRKINKSRLALAITAGTLGALAQQAVAAGFIEDSKASLTLRNFYINTDNRNGSASPSKQEEWGQGFILNYQSGFTQGTVGFGVDALGLLGVRLDGGGRAGKSGLGLDRQPGTVFPLESNGEPVHDFASLGLTAKAKVSNTEFRYGTLQPKLPVVTYNDGRLLPVTFEGGQVTSTDLKDFTLVAGQLEHSKGRNSTDNRSLSIAGANGSSAGSRDSNKFYYAGGDYKVNKDLTLQYYYGNLDDFYKQHFLGLIHNWQIGPGVLKTDLRAFDSSSDGKNGSRSGRADGYVSSGYYGSGVTKGEVDNRAFSGLFTYTVSGHSIGAGYQILNGDSDFPFLNRGDGEGSTAYLITDVQIGKFQRAGERTWQVRYGYDFAGLGLPGLTFNTMYLKGDNIKSGRGDQSEWERDIALAYVIPDGTFKGLGFTWKNASFRTGLPVSGSGTATQRDQDENRLIVSYTLPLL

SEQ ID NO: 2497 - protein, 1109 aa, Pseudomonas aeruginosa C3719
MSHPNWRKNNVRSSIQQACIPQAAERNGRTIITAVTLGALISFSALAQAETDTLEKVVRFDIPQQRADISLTEFAKQANITLIFPFDDVKQLQTNSLQGEYSITDAVALLLRDTQLFVNIGADGQLTILMEHDLGEIDSMHKKKLLSSAVIAALSSLTGANAIAQQTSAPAGQVEEVLVTGIRASLQRAMDVKRESGGVVDAISSEDIGKFPDTNLAESLQRITGVSIDRSGGEGQQITVRGFGPQFNTVLVNGRQIASEDTSRAFNFDTVASELVKRLDVYKTSSATLQSGGIGSTVNITTARPLDIGEFKVAGSAKALMDGNSEETSPQISGMISNTFADDTFGVLFALSHQERSTRLNQAQMDGWLENVGVPNPMTESGADWDGNVFSPRNYDHKVTFEDRKRTNANLVLQYAPSDDLTITGDLLYTDFDINTDTTSYGHWFTAPNIQGVGDDGSLFDTDGERRRPIVDENGTLIDLYQEVGLATDMHAKTFDRLTETTAIGLNAEWQANDNLQLVFDLSHSTSEREANNGGGDQLSLIGYANRVRFQVDNNILPLASMFAEANPNIYSGQQEIDGAIIDDSDGFAGYDPAITPAGVNDHLNKDNSRAHVMLRRGWAVEDAVTQFRMDGLWDEGNDTGLTKAKFGFQHSTETKALERWDNEGVGIHCTYCGYPDAPTIPADAQYIFDAGSDFLGDVSGSGRMPTQWLAHDGEANFAFLESYYASTNTDTISFDAVKRNNSYEITEATTAAYLELEFAGEIADMRIEMTSGVRLEETTTDVDGTTAPVSGLTILDETEMLAQYGAADSISLSTDYSSILPNMSIKLDISDNLVARAAASKTITRPTLNSMSPVTVITTTRQGGDLTSASGNPALEPFESDNLDLSLEWYYDDTSYVSAGYFKKDVANFIVNAQESRTFTLPDGSLLTDPSTGSDSGAADAGDDVAVFTNTLPNNGENATVDGVELALQHAFGETGFGIIANATIVTSDAELDPDDLSQVFALPGLSDSFNLVGYYEQGPFQARLAWNWRDEFLQSLTQGQGDGPTIVEAYQQWDLSGSFDINDNVSIFVEGINLTEEYVHKRGRYANQLLLIEDSGRRLALGVRASF

SEQ ID NO: 2498 - protein, 790 aa, Pseudomonas aeruginosa C3719
MKHHYRLPLRRTPPGGSDYALALLLALGGALPASAADAPAPAEEAPPLASSVPDKADTALGKVTVTARRREEDSQKVPTPITVLGGETLEAQRISRVQDLQQVLPSVNVAYIHARQSSVAVRGIGNNPASDGLEGSAGIYLDNVYLGRPGMAVFDLLDIEQLELLRGPQGTLFGKNTTAGVLNISTRAPTFTAERTVEVSGGQDGYFQGRGTVSGPLGETLAGRLSAYRTRDDGYIKNIHDDNYLNGGERQGARGQLLFEPNEDFSLRWIADYNEEDSSNGSMVVYGAAERFWQRAALVGASPLRDPQRRKVNINGRQHVSVHQGGSSLEANWNLAGGYRLTSISAYRYWHFTPANDEQLNVSAINDTGVEVHDRQFSQEIRLASPTGGAFDYVVGAYAFRQNLGNKTFTSYGPLADLYLLGANLGALNDTYSKANGKIETDSFALFAQGTWHLSERLDFTAGLRGTYEEKNAKVERFAPLGGAAVGGVGAAVRNGQLGAYDSGDLSQYNFAPSALLSLSYQFSDDLLGYASLSHGEKSGGVNLAVGSAPSAGADSLLVGPERANDAELGLKSTLFDRRLLLNANLFWTGIHGYQATTLYQAPGSTQLVQVLANAGSVRSRGLEFEATALPLRGLTLNFNGSYNDVTYLSFKDAPCPAEVSTRPGAPSSCDLTGQRVVGASKWIANLNGEYQWRLDDRFQPYVSASYAYRSAAEGTLDNSDLSKIDGYALVNLAAGLRSDLGDGQLDTSVWLKNAFDKDYYLSAFASINGSYTASVGQPRTLGVSLRYDF

SEQ ID NO: 2499 - protein, 399 aa, Pseudomonas aeruginosa C3719
MQNKLSSHRRTRPATTALLPSALGAALLALAATPAQAIGFSQGDATLDINGTVNGFYSHRTEERAGVKTTDSALTNGLLPGWINFVFTTKVEGLDIKAHVGFAPGINDKSDVVGLPSDPSCGGSTGCDSPFTQIDTRNLYFQFGNTEWGTVKFGRDIGLFGQKIILSDMTLLGLGGNSYASTPFNTTFGMIGHGYMYTGFQPQITYTTPAFGGFSASAGIFDPSKFAGDETKDPGFQAMANYDWKAGTAKGSVWAGAVHQRTSGAGSFNANGFELGAKVGIGAFEAVAYGFDASGLGLSTVGALYLSPFGKTDGKGYFVQGTYTVGKTKFGINFGENRDSGGALADTNKFRSATVGVYHSLNKYITLVGEYNQERGDGDDLFAGDLKTRTISLGGIIMF

SEQ ID NO: 2500 - protein, 381 aa, Pseudomonas aeruginosa C3719
MSRTKRPRAAMPASLALALLAVDDARASSVVLYGIVDASIVYTRNGGHSGSRVELQSGSLSGSRVGIKGVEPLGGGAAALFQLENGFNAVNGRLNQGGRLFGRQSHAGLRTPGGHTVVAGRLYDPLTDLVQPLQGDGYLGQTFSTPGDVDNADASARLNHALKWSSARLGAWQASALVSLGGVPGAMGSGLSHGAALAYRHGAFAAAAGYLHVDLGNALHGRRGRSSADSLFNSAVNAAYASAASVQIARVAAQYAIGSLAIGAYYGDARYRPDGASRFGHTQAFRNASLYGVWQATPTVTAVIAYNQLHASGDSAARYRQVSAGASMLVSKRTDFYATAAYADARGTNGLGAAQAVVGATGADAGGPTQVRLNAGVRHRF

SEQ ID NO: 2501 - protein, 646 aa, Pseudomonas aeruginosa C3719
MIRMALKPLVAACLLASLSTAPQAAPSPYSTLVVFGDSLSDAGQFPDPAGPAGSTSRFTNRVGPTYQNGSGEIFGPTAPMLLGKQLGIAPGDLAASTSPVNAQQGIADGNNWAVGGYRTDQIYDSITAANGSLIERDNTLLRSRDGYLVDRARQGLGADPNALYYITGGGNDFLQGRILNDVQAQQAAGRLVDSVQALQQAGARYIVVWLLPDLGLTPATFGGPLQPFASQLSGTFNAELTAQLSQAGANVIPLNIPLLLKEGMANPASFGLAADQNLIGTCFSGNGCTMNPTYGINGSTPDPSKLLFNDSVHPTITGQRLIADYTYSLLSAPWELTLLPEMAHGTLRAYQDELRSQWQADWENWQNVGQWRGFVGGGGQRLDFDSQDSAASGDGNGYNLTLGGSYRIDEAWRAGGAAGFYRQKLEAGAKDSDYRMNSYMASAFVQYQENRWWADAALTGGYLDYDDLKRKFALGGGERSEKGDTNGHLWAFSARLGYDIAQQADSPWHLSPFVSADYARVEVDGYSEKGASATALDYDDQKRSSKRLGAGLQGKYAFGSDTQLFAEYAHEREYEDDTQDLTMSLNSLPGNRFTLEGYTPQDHLNRVSLGFSQKLAPELSLRGGYNWRKGEDDTQQSVSLALNLDF

SEQ ID NO: 2502 - protein, 417 aa, Pseudomonas aeruginosa C3719
MKIRRKTAIPRNAGAVLPMLACLAAQAAEGGFLQDAKTDLVLRNYYFNRDFRDHDAGKSLVDEWAQGFILKFSSGYTPGTVGVGLDAIGLFGVKLNSGRGTSNSELLPLHDDGRAADDYGRVGVAAKLRVSASELKIGEMLPDIPLLRYDDGRLLPQTFRGFAVVSRELPGLALQAGRFDAVSLRNSADMQDLSAWSAPTQESDGFNYAGAEYRFNRERTQLGLWHGQLEDIYRQNYANLLHKQRVGDWTLGANLGLFVDRDDGAARAGEIDSHTVYGLFSAGIGLHTFYLGLQKVGGDSGWQSVYGSSGRSMGNDMFNGNFTNADERSWQVRYDYDFVGLGWPGLIGMVRYGHGSNATTKAGSGGKEWERDVELGYTVQSGPLARLNVRLNHASNRRSFNSDFDQTRLVVSYPLSW

SEQ ID NO: 2503 - protein, 989 aa, Pseudomonas aeruginosa C3719
MPGANPASEEVMSLQRPIPSLARPLSRLSPLTLALRWALLGLSAAGAGLLGGDLAHAQSVGQHSAATRLDDATPRSYDIPAGSLGASLGAFASQSGLLLSFDPELTRGRTAPALKGRYSVLEGLQRVLSNTGLQVAAGTSGAYLLVEPRMSGEAPADLSPVVVSAAELADPQKETYTAPRSSVYLSSEDIDRFGRVSVGDLLQGIPGVQVGDSRNGGALDVNIRGIQGQSRVAVRVDGAEQALDVYRGYAGTQQRSYIDPDLVSSVTVDKGPSTRSGAIGGSVEMRTIGVMDILVDGKDLGVRFTGDVWNNGVAPQHRSASSKTENLSSVPHDDRGSLFGSQAKSGSAAFAYRNEHLDLVAAYAQRNQGNYFSGKKGQDRYRVYNRYGREESSVAKVYNAGEEVLNSSSETESYLLKATWRIADEHTLDLGYRRYDGRTGEIMPSDIFRFGTAGIYQYPLSEVKIDTYTARYRYLPENNPLVDLSTGLWMTDAKSDMLTSVLAPRSQAYRSDRNWTRQDNRRIGGDLNNVARFETDFGDFKLDLGGSFQVEDIQPQKSVVTTLHDINANRTLRDATRQEYGLNGKLEFKPVERLTLWGGGRYSHFNSKDNGISASPRREDRDMRFITVSRPGYYGSMMWFPDQNGQYTDATDPRLNNGIVTNNTNNPFEGIPFDEFGPANVTVHPSRVTNVVTGYNYSKKGSSRGGGFSPAFGINFELAPDTFVYASYTEGLRLPSLFETSQGTLQVEPGKDLKPERSRSWEIGASALRDSLLADGDSAAIKLAYFNNTIKNYITRYYDPGQMGLMTFSNTDSYRTSGLELQSHYDAGRVFADLSATYYLKTETCDAAFAARLRAGANRYQRTENTPNCTPGSFMGSYTNTQNPPRLATNLTAGLRFFDQALTLGGRMTYTSGPTATADKPWQVGATTPQIEYRSVQLFDLFLKYKLFEHTELNASLQNLTDRYYLDPLAQSFMPAPGRTLRVGMQAKF

SEQ ID NO: 2504 - protein, 708 aa, Pseudomonas aeruginosa C3719
MRVSVSLVLGVGLGCSSPALWAETESPAELEVLTVTAEAERAEGPVQGYRANRTASATRTDTRIEDIPQAISVVPRQVLDDLDSARIERALDFAGGVSRQNNFGGLTMFEYNVRGFTTSEFYRDGFSANRGYMNAPDSATIERVEILKGPASSLYGRGDPGGTVNLVTKKPQAERFARLHASAGSWDRYRSTLDLNTPLDEEGDLLYRMNLAVEDSKGFRDYADGQRLLVAPSFSWQLDPDTSLLVEAEVVRNRQVFDRGTVAPHNHLGSLPRSRFFGEPDDGKIDNNNETLQATLRHHFNEQWSLRLASHYKHGHLDGYASENSSLAADGYSLRREYRYRDFEWHDSITQLDLLGDLHTGSIRHQLLMGLEYERYHNDELILRSIPSRNPYAIDIRRPVYGQPKPPFGRDDRNHEEVDAMALNLQDQIEFSEKWRGLLGVRFDRYRQDMNATRLNNGRFRDTSSQQTQRAATPRIGVLYQATPEVGLFANASKSFKPNGGTDMAGKAFDPEEGRGYEAGVKLDLLDGRLGMTLAAFHLKKKNVLTADPSNPGYQQTAGEARSQGFDLQFSGQLTEQLRLIGAYAYIDAEVTKDENIARGSRLLNVPKHSGSLMGVYEFREGWLHGADAGAAVNYVGERAGDSSDSGFELPAYTTVDLLAHYPLASNATLGVNVNNLFDRRYYERSYNNVWVAPGEPRNLTMSLTLNY

SEQ ID NO: 2505 - protein, 984 aa, Pseudomonas aeruginosa C3719
MPLSLRSSSFCFLACLCSSGWVSAQTINQAKLTPPLYDIGEAFHLTSNCFIEDTYGAKFPSSFLGSSTNFTIFGKKRSLTFSQCHAPVQNNASLISATETLTLTNLAKLVLNENVSTGQSGLISGKNISLTSSRSIVVTNNRTPYSPVVTTVTTPNNSTTVNCFFGSAIHTATSLDINKIRKQITFDSNSGNFGAALLNDTAATCSIQNNSATISFSQNFAACGGGAIYDGTISIKNNSGPITLSGNTAANGLLTTTPDPAKVIGAGCGGAICAPTKSVTFANNTGICNINYNLAEKDGGAIYATICDFSTRSPVYLSKNSAKENGGAICAKVLTVNANGPMMFFNNRAQKGGAIYVGSTVGDSTNPATSTLSLTSANGDMIFLGNTIDNRPGIRNSICVEGDGKITSLNAIGTSSLIFHDPIANKGPATTNPATLDTININTPGCSGSVKFSAETLTISEKLNPENATSVLFGKVVIGDGQLIVTNNATLNVLGLTAETGRLTLGSGAKIGLATVTGNQPTQENFVIKNLGFDAQSYLTPSYAAANVTTTNSKTITLEGSLNLASEDDAELYDNPLLHSSLSFPVATFVSNNNDPTKNNFSVGDLSIPEHYGYQGLWSSSWTPPPLAPTPDGGIPTGTNNRTLYVLWKPDPAYQAPYVLDPERRGELVSNTLWTSFLATQTFSEALQESLLCEEEGVLVSAKAIGSYIRHPSRNMHEGFKGRYGGYQASIGVHYPDDASLGLAFGQLYGQVKSSPYDAQSTERINVVSFFGKFPVATEKTLTNVSWEASYGYTVNLMKTNYQNPKTQHTRNSKGRWHNNTYYALVSVEHPFLTWCQLTRQFARDLDLSGFISAEFMGGWQNAFAETGALVRSFSRGRGHNISLPIGLTSDWQTPFKKAPSTLTLKIAYKPDVYRVTPHNVVTILANGERIPIKGAQLARNGFFLQLHDSVKLSEYATGFLDYVLDTKKSYASHRVITGLQGKF

SEQ ID NO: 2506 - protein, 1093 aa, Pseudomonas aeruginosa C3719
MPRSIFLFLLSLSLLRPIAAQTSFGRISGTVTDPSGSAVPAAKVNIRNMETQALRPVTTDGNGTYTAENLPIGPYRVDVEAAGFKRSSRSGFQLVADGRITADFQLEIGEATQSVDVVAVQSETINTVSGEVSHVIDKEQVDNLALNGRAYTELLTLVPGAVVTNPDQFGVLTSLSATNQVINGHRSNQNNLTVDGVGNLDAGANGSVINNVSPDFLQEVKIQTSNFSAEYGRSTGAAFNIVTKNGTNSFHGGLFEYFRNDALDARNFFSPNKTKLRYNDFGWNLGGPIKKNKLFFFAGEEWRRLRQQTAGTRVTLPTTAELQGDFSALSTPIYMPGTKTPFPGNIIPSAMITPDGQAIANVYRTVMPLTAVFSNLPVANNATFQNPNPLDYREDLIRLDYHINDQHTLYGRFIDDSNSIYLANGPGGSLPITPETRQRPGRSALISETWVATPSIVNEARLGSSWNSQHYVNVGDTWQRDTQGFAFQRVYNNVGPYVNGIPDVSISGGITGWTGPSHTLSSPTTEIEASDTVSIVRGQHSIRAGFMLIRNRKDQNGRSPYTGSVAFNNSGNPNTTGNALADALLGNYATYTEAAYDPMGKYRYTEPSLFIDDAWKVSRKLSIDLGLRYEYMMAMYSTADNLSEFVPSLYDPAQAVRLDSKGLIIPGSGNIYNGLVRVANGVSSSQSYLVPNANDPSVLSVPAGAPRGMYPSQGTWSPRVGFAYAVTPKTVIRGGFGLFYDRIQGNPTFYTLNNPPYVGSTQYQYGNLSNITGGATVLAPWGTIQTIDPHLKVPYSEQFSFGIQQELPWKLFGEATYVGTLSRHLLDEPDINEPSLTALQSLPSTTPINSIRPYVGYSVIQQFESRATSNYNSLQLHLTRRAGRVMFTAGYTFSKALGTASSDTTNNHDYFNPRLYYGPLSFDATHVFVGTAIINLPTLANRSAWMKTPLGGWQLSAVIHDQTGFPLSVTGNSAIIGGRLADYVGGPAVFADPGPNGWINRAAFAAAPQGRWGTAGAGDVRGPGMQMYNLSLTKFFVISEQHNINLRFRADFINAFNNVNFQAPATNVSNSDFGTITNAYPPRNIQLGVKLQF

SEQ ID NO: 2507 - protein, 463 aa, Pseudomonas aeruginosa C3719
MPLLCALIVGGLFGTSQAQAGGFMVPTTNTAGWGRAMAGGSLFPNDPSAAFNNPAAMAFIDKRIAQLTINYADIDIKYNGDAYDYQGNPMTGGYQDGPGTPELGTNDGGQAGFGAWLPTGFLVVPINDRFAFGLSQVVPMGMRSTWDPNWKGRDFAVDTKIETIGLTGSLSFKVNDNFSLGAGVIIQRTSGFVSQNLDLYASAANSPGMGGIPFPASNSSALMRVKVDNTSPGFFAGAVWKPTDRDTLGFAYHAKIRNKLKGHYNLYDHDGGLTEGAIEGGTPGLAYPGLDLRMGASASARLDIPAYASLDWVHQFNDRLSLGASATWTEWSSFQDLTLKSHGNTIVSIPYTYRNTWTLAVGGDYKVTDQWTMRAGVAYDQTPTHNATRDPRIPDGDRYFASLGAGYRFQSMPELSIDAAYSRQFVKEVPLKTVNQDRLGGGRLDGRATSKGQVFSLSATYDF

SEQ ID NO: 2508 - protein, 753 aa, Pseudomonas aeruginosa C3719
MSRQSTDTAVSSQRLLASAIGVAITAIAAPQAAHADEAGQKKTDKDRVLSLDAATIVGEQQDETTYNVDRSASKKYTAPLLDTPKTVTVIPQQVIKDTGALTLADALRTTPGITFGAGEGGNPAGDRPFIRGFNAESDTFLDGMRDVASQTREVFNVEQIEVSKGPGSAYTGAGSTGGSLNLISKTAKQDNFTDAGFTWGSDQTRRTTLDVNRMIGDNAAFRLNLMKHDAHVAGRDEVSVSRWGVAPTVTFGFDTPTRATLSYYHLSTDDMPDYGLPLTNVNRSKANPSKPASVDRDNFYGLKDRDYRKSTTDSGTFRIEHDLNDNLTLSNSTRLVRTTLDYIVSNPDDSRGNVANGYVYRSAKSRNSTSKGWVNQTDLKANFETGFIKHTLVTGLEFSYEDVHNRPYAITSGGGAGNTCNARLLASGDCTSLNRPTPGDNWTGSITDGLAYTDTDTKTSAAYVFDTLKLSEQWELNLGLRYDDFDTKSSGYQTAGRNGPAGYFKRENNSHFWNYQTGLVYKPAPNGSIYLAWSTSSNPTGETGGEGQADISVGNNGLDPERNRNLELGTKWAFFDDALSLNAALFRTDKTNARVASPDVSTLQVLDGEQRVQGVELGFNGKLTEKWKVFGGYTYLDSEIRKSTVKSDEGNKMPQTAQNNFTLWTTYDLLQNFTIGGGTTYVDKQYGNTANSTYIPSYWRYDAMASYKVSKNVDLQLNVQNLTDKRYFDQVYSTHMAHVAPGRTALLGVNFHF

SEQ ID NO: 2509 - protein, 484 aa, Pseudomonas aeruginosa C3719
MMRYQRVTGATLGLALMASAAPGWAADEQATPPTPDNPSYAAQVQSIPSVEKPIKGQAGASGLFEGQSLTLTTRNFYSRENMKDSFTFRIPKAGGGSQRIHQRNAWVQGTVLKYSSGYTQGSIGFGFDVAAFNEIALERGKGRIGGGGNRTLANSDGEAIGEWSKLGVANIRLRASNTEFKAGRFLVNTPVFSYIDNRALPSSFTGFAVTSEELDNLSLQAGSFRKVSPRTGSGDEDMTTEYGTRQVKGDRLNYLGGNYKPLDGLEISLYGSHFQDVWNQYYLGVTHDIGDLENGIALRTAFNGYHTGDTGAREAGYIDNDTWSLAFTLGHRAHALTLAYQQVDGNEYFDYVHETSAIFLANSMLADYNSPNEKSAQIRYETDWSYYGVPGLSTGVWYVKGWDIDGTHYDGDRNGAYGNYAEVRAQDGEKHHELGLMAAYKVQNGPIKDSTFKLTYMMHKASQNQVDGSVNELRLVSTFPFNLL

SEQ ID NO: 2510 - protein, 427 aa, Pseudomonas aeruginosa C3719
MSTSLPQAARSVRLSRSTTLTTTAVVLAGIAPLGNAAGFLEDSKASLETRNFYMNRDFRDGPGQSKREEWAQGFILNLQSGYTQGTVGFGLDAMGMLGVKLDSGRGRSGTGLLPKDSDGRAPDTYSKLGLTAKVKVSQSELKVGTLIPKLPSVQPNNGRIFPQIFEGALLTSKEIKDLGFTAGRLEKTKIRDSSDSEDLALNDKNGRFAGVSADHFDLGGLDYKLTDQLTASYHYSNLQDVYRQHFVGLLHSWPIGPGELTSDLRFARSTDSGSAKAGGIDNKSLNGMFTYSLGNHAFGAAWQRMNGDDAFPYLEGSNPYLVNFVQVNDFAGPKERSWQLRYDYDFVGLGIPGLTFMTRYVKGDNVELAGQSGEGREWERNTELQYVFQSGALKNLGIRWRNATFRSNFTRDIDENRLIVSYTLPIW

SEQ ID NO: 2511 - protein, 687 aa, Pseudomonas aeruginosa C3719
MSSSGLFPSLPLWPLTPLALACLIVSGETLGADGRPSELPSQVITANPLGNESPATPSSVLEGDELTLRQKGSLGETLNGLPGVSSTYFGPGASRPVIRGMDGDRIRLLRNGVGALDASSLSYDHAVPEDPNSVERLEVVRGPAALLYGGNAIGGVVNSFDNRIPSEPVDGIHGSGELRYGGADTTRSRSGALEAGDGNFALHVDAASREFNDVRIPGYAHSSRQRQIDGDTGKHRVQNSDGRQDGGAVGGSYHWEHGYAGLSYSGYDSNYGSPAEDDVRLKMQQDRYAFASEIRDLEGPFTSLKLDAAYTKYEHKEIEDGETGTTFKNEGYEGRIEARHRPLGPLNGVVGAQFANSRFSALGEEAFVPHTETDSAALFALEEWKLSDRLDLSFGARLEHTRVDPDAKGNERFAENDGSQSFTTGSLSTGAVYKLTPIWSLAATLSYTERAPTFYELYANGPHAATGTYEVGDADADKEKAVSTDLALRFDNGVHKGSVGVFYSRFSNYIGLLASGRHRNEEGEVVAAGVDEALPEYLYSGVRADFYGVEAQDRIHLLESPYGNFDLELSGDYTRAKNKDTGEPLPRIAPLRLNTALIWELQQWQARVDVEHAASQHRVPEEELSTDGYTTLGASLGYNFDLGESRWLAFVKGTNLTNQTVRYASSILRDRVPAAGRGIEAGVKVAF

SEQ ID NO: 2512 - protein, 742 aa, Pseudomonas aeruginosa C3719
MYPQFRRGHLAAAVLFASSSLLGGQALAEDERLEELDERAESVVQLGDEVVLGTAEQELKQAPGVSIITAEDIRKRPPVNDLSEIIRTMPGVNLTGNSSSGQRGNNRQIDIRGMGPENTLILVDGKPVSSRNSVRYGWRGERDTRGDSNWVPPEEVERIEVLRGPAAARYGSGAAGGVVNIITKRPTDRLRGSMTVFTNIPESSKDGATRRANFSLSGPLTEALSFRAYGSANKTDSDDTDINLGHTVNPSRTVAGREGVRNRDLSGMLSWQVTPDQVVDFEAGFSRQGNIYAGDTQNNNGTANTQGLADDGAETNRMYRENYAITHNGTWSFGTSRFVAQYDSTRNNRLEEGLAGSVEGQIGADRSFSASKLENYRLSGELNLPLHALFEQVLTVGAEWNKETLNDPSSLKQGFVGSDSLPGTPAAGSRSPKSKAEIRALYVEDNIELRPGTMLTPGLRLDDHSDFGLNWSPSLNASQTLGEYFTVKAGIARAFKAPNLYQSNPNYLLYTRGNGCPIQTSSGGCYLVGNENLDAETSVNKELGIEFRRDGWVAGLTYFRNDYKNKIVAPLDVMGQTGTGNNILQWSNAKKAVVEGLEGNLLVPLHEDLSWSTNLTYMLQSKDKDTGNPLSVIPEYTLNSTLDWQASERLSTQLTSTIYGRQEPPKHGTSRNTPVVSRKEVGTYGIWGVSAGYTFSENLSVRGGVSNLFDKRLYRQGNSFDAGAATYNEPGRAYYVSMTTSF

SEQ ID NO: 2513 - protein, 228 aa, Pseudomonas aeruginosa C3719
APYVALTFDSGKFSVDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYQGFTLNGGLTWTDAEISRDQITPENTGNVPRRQADVVWQLTPSYRGDSYQ

SEQ ID NO: 2514 - protein, 693 aa, Pseudomonas aeruginosa 2192
MPAPFTLRHAKRLSVSRSIWPLMSAGLFTMSPLCSALADTVKVEDSTLTLGTVTVQGATSGPLSTSSVLSSVDILGGDILEKMPVNYSWELFRRAPGVMLTEFNQGTTSGKISFRGFNGEGEVNAIKLLIDGIPSNSNDGNMPYMDMIFPMELDSIEVVRGTSDARYGLNNIAGNVNMLTRTGGDYNKARFRYGSFNTQETQLAKGLESSNWTQNYFFAYQKSDGYRDHADADKFSMSGKWFFTPDDDSYRIGLIARHYETEAQEPGYLTEDDARHHPEMTNSFNATDKGTRRMNQVSLHFDTDLADTLAWSAKTYVNTLDDRRWTQYWRTSSQQERDTYETQYGALTSLTWRPEVIWLYDFALEGGTDVQQQQNQSERYRTRDRARLATTRDQQFDFDTYGAYVQAEIKPFESLKIVPAYRVDKIQGDFTNEMTGTDYDINDYGLIKQPKISIVYSPWDVASFYANWGRTFQVGTGAAAYKIPPRDTDLAPSINEGWETGIKFTPADWVDGRVAYWQQEASGEVSRRLNDPSGESDNVGETRRWGYDVQMNLHPDERTEIWLAYSWQYSKILQPSATLPGSKGREIDHIPHHLYNAGISYDATPALQLTAWMNGQTNYYLERENTKGTYGGYVLMNLGATYKVTQSVSVDLQLKNLTNRYYEYVWYDPDGAQGSLHSPGDGRALYTGVTVDF

SEQ ID NO: 2515 - protein, 438 aa, Pseudomonas aeruginosa 2192
MIRKHSLGFVASALALAVSAQAFAGTVTTDGADIVIKTKGGLEVATTDKEFSFKLGGRLQADYSRFDGFYTKNGNTADAAYFRRAFIELGGTAYKDWKYQINFDLSHNTGSSDNGYFDEASVTYTGFNPVNLKFGRFDPDFGLEKATSSKWVTAPERNAAYELADWINTHQDGMGAQVNSTLADMAYLSAGVSAKDADDSDGDSVKQFNFRGVFAPMHEAGNVLHVGVNYAYRDLDDTAFDSRIRPRLGMRGIATSGGNDAGDNGNRATFGGVSNSPAGSYKDDSVWGLEGAWAMDPFSAQAEYLARKLKADDNAYKDIKAKGYYAQLAYTLTGESRQYKLEGAKFDSVKPENKEIGAWEVFYRYDNIKVEDDNVVADTATREVGDTKAKAHNLGVNWYVNDAVKISAAYVKAKTDKITNNNGDDDGDGFVTRLQYVF

SEQ ID NO: 2516 - protein, 448 aa, Pseudomonas aeruginosa 2192
MQGDGKKRLWTLPLLLGAGLMASAVAEENAERSKEGFIEGSEVNLLLRNFYFNRDFRKGQSSPAGGGYTEEWMQGFMANFSSGFTQGTLGVGIDAFAQLGVRLDSGGGRSGAGGSVDLLPYDDQGRPQDDYSRAGGAVKLRWYGTVLRVGDVFPETPVIQYGNSRLFPSSFRGFTLVNDSLAKGLTLQAGKLNSMTQPNSTSGSDDFYSFYTGRRIDSPWVAYAGGDYQATEHWSVSLYGSRQKDVWDQYYAGTSFNYPLDDKLSLLGGANYYKVKDQGRQVMGELDNDIWSVRGGFAYGPHQVLLSYQRNNGDDDFDYLRQTDSIYLDNSIQYSDFNSPKERSLMLRYDLDMAAFGVPGLSFMTRYGKGWDADYSNANSVYMRTDANGNPLTNQGRWERDVEVKYVVQGGAAKDLAFRVRQATVRSDSFESDLDEVRLIVEYPLQVL

SEQ ID NO: 2517 - protein, 253 aa, Pseudomonas aeruginosa 2192
MHPTLLLCAFLFMVFTYPQAWAQDREGPQAGLGEQLASYGIQPHVQFTSLSMKNLDTGPRPYSFGNSGDLYIGADVDLATLSGLDGAALHFEQTIFILDNGTGQPTGGEWQGAVGSYFGGAPLHNDIASNQLSLLTYKQKWLDGQLDLHVGRTNGRRYFYIYNCETGVTCNDPILDASSGMLPPPFGAWGGYLKYQVNPRFYVHAGAFESNPVDYLKKRKGLDFSTDDASGTSFLVGIGSKPGDNTTQYELNA

SEQ ID NO: 2518 - protein, 653 aa, Pseudomonas aeruginosa 2192
MTPHSSPHRLPPLRLARAVPFLYLLPCLALAAPVDLEPTVVSATTTERKLRDAPASVSLIAAEDLRRRPVRDLQEALRGSESLQFNGVGMSRRGISVRGMSSEHTLVLVDGQRISTSSGAIAHSDFDLGWVPVESIERIEVVRGPMSSLYGSEALGGVVNVITRRATDTWTGSGLLDGGVREDGLGGQSHQLGAYLAGPLVPGKLGLALNGESRRQQETPDADERRLSELEGGNADSGGLNLSWTPGDAQRIDLGHQRGRERRWRNSETGGSRSRYYESRDVIERERWSLAHNGQWDWGSSQLRTYRNRLERHNARSDGQPPSNPQRLTDSVVDGHLSVPAFERHLFTLGGEWRKEELEDRSVNTAGDASARHKALFLQDEIAFGPDWSLTLGSRFDKHEAFGWESSPRLYLLHHLSDALTLRAGVGRGYKAPSLKQLSPEYAAVGGGGRFTIYGNPDLKPETNTSYELGADYQGDGWSLKGTVFENDVRDLIQTVCVARCGVRGGEIRNYENVDRARIRGLELGGGVDLPADLRWELNYTYLDARNRTAGQRLGDRSRHLANSQLRWSPNARFSAQLRTEYVGSQVAYSSNVGYALPAYSLWHLELSQKLSENLTLRGGIENLGDQRLADDDTHFTYAEPGRTFHLGLVASF

SEQ ID NO: 2519 - protein, 883 aa, Pseudomonas aeruginosa 2192
MSNPRSPRLRLVPVLCAVGLACLGQPGESAAEEVRATSSAEIQRFDIPAGELAQVLLSIVRQSRTPIAFDQHLVEGLPAPAIQGSYSVEQALQRALQGSGLEYIRSAAGVLSLQRATAPDAALPAAKPAGTLATVVVTGTRKADVKAGESLAPIDVVSAEQLRDSGSGDLRDALVRLLPSLSRQAQAYNASALTNAQSLRGLSPNHVLVLVNGKRRHETANINVSGGLQSGSTGVDLDTIPLAAIERIEVLRDGASAQYGSDAIAGVINVILKSADHGGRLAYDNGRYGDGDGLTQNGGVNGGLRFGESGFLNLSAQFREQARTIRAGIDQRTGHYGNPSIGDPSLHRQALAYNAGVALDDNVELYSFATYTHRSVSSAQIYQLPSLAPRLYPNGFTPRITSDEDDYSLTLGARGGELFGAWDWDLSSTYGADRPEIGMDHSINLALYGETGDSPRSFDLARYKATQWTNNLDLRRDFDLAWLPAPLNFSWGLEQRRELYEVEAGDPWSYYNGGSKALPGQAPATAGQWSRDVLGAYLDLSIALDERWQLETAARYEHYSDFGSTTNGKLASRYRFSPEVSARASLSSGFRAPSLAQENYTSLGVSPTIASGLLAVNSPAARLLGAEDLEPEKSISYNLGLVLDPLPDLNLAIDAYRIEIRDRIVDGATYSGQPAIDALRAGGISIPAGLTQVSTHYMTNGADTRTHGLDLTASYLTRLGEWGRIDWRLGANVNRTKLVRNHRGRNGQPLLNDQQQAWITSSTPRSQVSLQADWSYRRWGLTLRETRYSKTVSELDYYTGEHAYSTTVFNRFENSPKYITDVALRYAASRNLTLSAGANNLFDVKPDKLPAESAYLGFNQYDTYASQISFNGAFYYLGAAYTF

SEQ ID NO: 2520 - protein, 442 aa, Pseudomonas aeruginosa 2192
MTRSADPPIPPGGSARSPQGRAPGFDNQGESTMTGNRWIVAAALALWASQAGAVNGMRMIGFGPVQSAMGGASVGLPLDAATVITNPAGLSLLDGRVDFGITVLDADVRYRAVGAASGQEQTSSRRPTLIPGFGLVVPLGDRLTFGLGGYGVAGLGVDYPQDLLGGRLYTSYSQLRLAPGVSYEVMPGLSLGVTANIMYATLEYSAGGGLGLQPRDGAISYGGGFTVGAAWRPVEWLTAGLAYESRGWFQDFEYEVPAHTIVVDPATGTTANVGPGVEKLELDQPDLLTFGVGVRPVAGLAVAADVQWIRWSQTNGRNQPRLQTDPALTGGMQLDLDWSDQWVLKVGAEYAAASWLKLRAGYDYGKSPLNADRALENLAFPAVLEHHVTAGVGLELGRTSVSVGGTYAPEGKQTGSNLAQGIAAYETTFTAWTLDVGFAHRF

SEQ ID NO: 2521 - protein, 706 aa, Pseudomonas aeruginosa 2192
MPSRPRPSFVSHLLPGSLALCGLAIACAVQGEERRSLEPMVVTGSYNPSDTFDLPFSVDSIERRQIADGQLGINLSEVLPRVPGLVVQNRQNYAQDLQISSRGYGARSAFGIRGLKLLADGIPASTPDGQGQAATLNLDVAERIEVLRGPASTIYGSNAGGVIQMFSRDGQGAPRVGAETTVGSDGLSRNHLYTEGEGDGVGFLVDASRMDTDGYRDHSAARRDQTFAKLNFRPDADSRLALIYSSLEQNDTEDPLGQTWDAYKHDPRSVTANAELYDTRKSIDHQQAGMNYERYFGEATLQVNAYVGKRSVVQYLSIPKGVVSNSQRGGGVVDFDRDFHGGTVRWLQPVRQAPGELNLTVGLDYDQSRDDRRGYQNFNGDQLGVKGELRRDEVDTATSLDPYLQASWAIDAWTLQAGVRHSTMKMEVDDRYLSNGDASGSRRYRKNTPSFSVMYAFTPDLHGYLSAGKGFETPTQAEMAYAPVAANAPDVFNFGLKPATSSQYEAGLKARLWGNTRVNAAIFQIRTEDEIVVASSLGGRTSYQNAGKTLRRGFELGVESELSEHWNANLAYTRLSATYDSDFEAGGKTIGKGKHLPGVPASSLFGELVWKPVEGISMGWEGMYRSQVYVEDSNSEKAAPSYAVFNWRTRFEQRLGAWTFHQLVRLDNLFDRQYVGSVIVGDGNRRYYEAAPGLSWYAGAGVEYQF

SEQ ID NO: 2522 - protein, 789 aa, Pseudomonas aeruginosa 2192
MNRRPAYRSIPSSRSAPFRRRLLPLSICLACAGGAQLAGADDTPAGTEEARQAQPATTLQTVTVTSRRRVENSQDVPTAMSVLGGETLESQRIYRVQDLQQLVPSTNVAYVHARQSSVSIRGLGNNPASDGLEGSVGLYLDNVYLGRPGMASFDLLDIEQLEVLRGPQGTLFGKNTTAGVINIGTRAPSFTPERSVEISGGEDGYFQARGTISGPLGETLAGRLSAYRTRDDGYVKNLHDGNTLNGGARQGFRGQLLFKPNDDFSLRWIGDYNEEDSDNGVLTLFSSGPMVNGVNRYEQRAAAAGATLVDGHRRKVNFDSDQQVTVFQGGTSVEANWKLANDFTLTSISAYRWWDFTPRNDDGLDVPAAYNAGVSVRDKQWSQEIRLASPSGGFFDYVLGAYYFGQDLDNKSFTDYGPRADIWNGTPAGALSDVSTRGRGHIDTDSYALFAQGTWHLTERLDLTAGVRGTYEEKSAWVERYAPLGGAAVSGAAAAARNGRIGAYDSGDIGLHSVSPSALLSLSYRFSDQVLGYASLSHGEKSGGVNLTVASAPSAGADSLLIGTERANDAELGLKTTLLDNRLILNGNLFWTVVHGYQANAYDEANRTQYLTNAGDVRSRGLEFEATALPIRGLTLNFNASYNDVRYLSYKNAPCAPEVAFQAGAPASCDLSGHQVVGASKYIANFNGEYRWKLDDGLEPYLTASYAFRSRAVGTIDDSAYGQIPSYALVNASAGLRGDYGDGQWDLSLWLKNAFDKTYFTSLWNSANGGYAGVLGTPRTLGVTARYDF

SEQ ID NO: 2523 - protein, 435 aa, Pseudomonas aeruginosa 2192
MIRVRPVGRLALFLALGGTSPCHAAAQEPKAPELLEWRLLNRNYFLYNDYRRADAGRGYRKEWAHGLIADLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDFDRVRIQAGRFTAFKEQAASSGHGDFDGYGASTAGSAIGFAGASLAASDDLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSLMARYVSGRAIDGSHAPAGGAYNPLAADGRYRPLLGSGGKHWERDLDLRYVFASGPLKDLSLNVSHLSHRANAAQAGDDIDRLYLIVEYPLKGSL

SEQ ID NO: 2524 - protein, 746 aa, Pseudomonas aeruginosa 2192
MSSRALPAVPFLLLSSCLLANAVHAAGQDDGSIIELGEQTVIATAQEETKQAPGVSIITAEDIARRPPSNDLSQIIRTMPGVNLTGNSSSGQRGNNRQIDIRGMGPENTLILVDGKPVSSRNSVRYGWRGERDSRGDSNWVPADQVERIEVIRGPAAARYGNGAAGGVVNIITRQAGAETHGNLSVYSNFPQHKAEGASERMSFGLNGPLTENLSYRVYGNIAKTASDDWDINAGHESNRTGKHAGSLPAGREGVRNKDIDGLLSWRLTPRQTLEFEAGFSRQGNIYTGDTQNTNSNNYVKQMLGHETNRMYRETYSVTHRGEWDFGSSLAYLQYEKTRNSRINEGLAGGTEGIFDPNNAGFYTATLRDLTAHGEVNLPLHLGYEQTLTLGSEWSEQKLDDPSSNTQNTEEGGSVPGLAGKNRSSSSSARIFSLFAEDNIELMPGTMLTPGLRWDHHDIVGDNWSPSLNLSHALTERLTLKAGIARAYKAPNLYQLNPDYLLYSRGQGCYGQSTSCYLRGNDGLKAETSVNKELGIEYSHDGLVAGLTYFRNDYRNKIESGLSPVDHASGGKGDYANAAIYQWENVPKAVVEGLEGTLTLPLADGLKWSNNFTYMLQSKNKETGDVLSVTPRYTLNSMLDWQATDDLSLQATVTWYGKQKPKKYDYHGDRVTGSANDQLSPYAIAGLGSTYRLSKNLSLGAGVDNLFDKRLFRAGNAQGVVGIDGAGAATYNEPGRTFYTSLTASF

SEQ ID NO: 2525 - protein, 910 aa, Pseudomonas aeruginosa 2192
MPRFSDAHRVRDCLDARGAPVVVDMHSRCCVRCLHRFDRASAGRAMMAVAAHACIIWGRCASAFQNVSVRTRPSASRLGARRRWMATDAVGGGHSRARRVTHTRRGESVASIPNRGSHTHRTKGIGCCIRTPPRMMETLSYGLCHICVNRVNSAALRHAGRAAPPPESGVLPMSASRSLKISALAVAVVSLLPLAAAAQQAPSDDGVVRLDAVKVTVERRSEDSKDVPVSASVLRPEFLDAISTSGSDIRVLAGKAPSLNIESSNGRVFPRVYIRGYGNTDFNTYASQPVSLIYDDVVQENVFLKGFPIFDLEGLEVLRGPQGTLFGRNTPAGVVKFNSVKPIIGANDGYASLSYGTYGTMTLESGLSIAMGDHWAARLSTLGQRRDDWVENRDGRDLEGYTDSAVRLQLLYQASDDFSALFNAHARHLDGTARLFRANIIQPGTNQLVEGFDPENSFIDGANRQELQTYGGSANLTWDLGDIALHSITAYEGIGKYYSRGDIDGGFGAVFAPPSGPGVIPFPVETAGGIKSLDQYSQEVRAQSQYEGPLNWQAGLYYFHDDVEGENYTYNTLSGGDLASYQLIRQRNTSWAAFGSLNYAATDRLNLRAGIRYTYDKKTFDALALDRVTLVEPSSGETDNSKVTGDLAVTFSINDDVNVYARAARGFRGASFGVPSGTAPLTVAEPETVDSLEVGIKSDLFDNRARLSVDVYDFRVKNQQLTAVGGASNDVRLLNADKTKARGAEFDFEALLTQNLRVTAGGAYNWTRIDDPNLSVGICRTCTVTDPINAAGRAVIDGNDLPQAAKWMANATLRYGIPMGNDGELFFYTDWSYRSEVNFFLYDSKEFTGQPLVEGGAKIGYNWGAGAYELSVFCRNCTNQIRVTGAIDFNNLTGFINDPRIVGAQLRANF

SEQ ID NO: 2526 - protein, 472 aa, Pseudomonas aeruginosa 2192
MPDSSMKRGATLCLALAIGPGSLLADDSLGHRDNISTGLNQRQKAEMKVPPGFVEGSTLNGFLRNYYFARDNHDTPSRRDQREWAQGLMLSFRSGYTDTPIGIGLDAHAFYGLRLDGGGGSGGAGVLPLDSAGRPADSFSAAGAALKLRGLDSLLKIGDQLLENPVIASGVSRMVPQSYRGVTLKNYHFRALELDAGFVEATRLRNQSGHSHLTSGYGNGTKGGIAADRESPHIAWLGASYSAPGGSQATLYSGRLADIWNQHYLGLSQPWRLSSQLTLTPWLHYYKTRDQGRSQLGRIDNDLYNAGLTLAGGGQSLSLSLQKVDGDTPFDFIAQNDRTFLYESNAMQYADFNGPGERSWKIQYQASLAFLAAPDWQFGAAYGRGQADLTRVDPDSAGYGYLYNPNGKNAQHWERDLSLRYAFPAGPAKGLSVTLRWATHRPGEGYTAPGNTRGNSSSDEYRVVVDYPIRLL

SEQ ID NO: 2527 - protein, 851 aa, Pseudomonas aeruginosa 2192
MHRSLHTDAPLGAALLLALQLAPGSAAAAEEQAPVDPPTVQLQRIEVTGSAIRRVDAETAVPISVLRAEELRQQGVTSTEELIGRLSGNQGVYNSSRSVGSATGGASFADLRGIGANKTLVLLNGRRLANNAIDGSAVDLNTIPFAAIDRVEVLRDGASALYGTDAIGGVINFITRKSLNEGRFDSGYASPTHDGGGNQRNVSASWGFGELEEDRFNVFAVANYDKQERLGAKDRGYTYNYQPGRGLDYSSGTAFPGNWSQGANASNPLAAGGCKGADLIPRNGICRQSLWRYLDLVPETEKTSVFSRATGKLADEHNVSLEYFWSRNDNATQVGPGTLTGLQIDPGTAFYPGNGITPGPGGFVLDPSRPVEVNWRQSVLGPRLQSSQNTGQRLLLGFDGQFAGWDYDIGASYNQNKVVDHIHSGYVDDRAAALGIANGTLNPFGPQTDAGLAYLGSHALSGDFRTSVGRVKGLDARASREIGDWFGAGPAALALGGEFRKEAFHQDIQDFAGNVQSLGVDPAATVSGERNLKAQYAELNVPVLDSLELSAAIRHDKYSDFGSTSNPKYSFRFQPFRQLVLRGAYSEGFRAPSLYELYNPTFTTYTSANYDDPRLCAGGQPSQGGIANRDCAQQFYNATGGNTDLRPETARNVTLGLVYQPLRDLSVGLDFWWIRIANQIAEFPEAAIFADPQAYAGRIVRKADGSIDHVVTGLANLGKVKTSGVDLSLDYRFPASRYGQFGLDLQGTYVSRYDFQQQIGGQYLDNVGDFQGVGVIARWKHVANATWSRDAWQATLSNRYTSGYNDYDRASHGKVGSWNLWDLAGSYRLSHALGLTLGVKNLFDREPPFSN

SEQ ID NO: 2528 - protein, 846 aa, Pseudomonas aeruginosa 2192
MVTGSRIPRAQQEGPSPVTVISSEEIQNRGYRNVFEALQTQTQNTGMTQGEDYGNTWQPAANALNLRDLGPNHTLVLINGRRVADYPTAYGGSVNFTNLANIPAVMIDRIEILSGGASAIYGSDAIAGVVNIVLKKKFDGVDVNLRAGTTERGGGDNQRLQLVGGGATGDFEGLFGLQVEQRQPVWANQRGFMDSYPDGNNVGYRLNPQSGRYLGDASCAGLGGLFGGNVAPVPGARGGYRCMTDQYYNNYWTLQTKKENYDGYAGGTWHLSDSGKLFADLLFGFDHLQNNTRGPSFTSPDFINASSGDLERWYRLFSPEEIGGKSSNNSKWREVSWTGTLGYSDRVANTSWEYELAATRSEYRSDRTTRYTPAAGILDLYLGRKLGERDGYPVYDPDPARLGRPLSEEEWRSLRRNVTQHSESYSQTYSFTGNGELFDLPAGPVAFAGVLEVGKQGYRIRPDSQYNDGSLYNVSKASSSGGSRDRYAAGGEFSIPLHDTLLASAAGRWDQYRFSGRTEEQTTYNLGLEWRPLTSLLLRGSYGTSFRAPDLNYIYQADANGYYPAQKDYYGCEKGVDGACKNGRVDYVQSGTPDLKSERGRYWSYGFVWSPSSRFDFSADYYHIQIDDLLTTLDPDKLLRDEAACRSGGLDPDSAQCRDTLARVERNAGDASVDPNRLNKVYVNAINAAKERTSGIDLRSNIRWGAGDYGAFSSTLGYTLVLSHDYQQSDDYPSENQRDSLDSHDWRSKLNASLTWDYAQFTSTLFAVRYGSVTNAAGSGRLSPWTVFNASARYRLNERASVGLTVNNLLDQIKEDDSDGWPYYPTGNYDAMGRQWWLDFSYHFGG

SEQ ID NO: 2529 - protein, 851 aa, Pseudomonas aeruginosa 2192
MTLPFTRAAWRPLCSAAVLGAALWAAGASAAERRFDLPAQPLAASLSRLAQQAQVQVLFDESLLRGLRAPALSGSYGVREALERLLVGSELELVEAGGGYVVRRRQVDAYSDNALQLDAQTIVGNGREVDASNVGRSTLTRRDIERQQADNIPSLLQTLPGVTMGGSPKPGGQTTNIWGLGDAEDVPYTLDGAQKSGFERYQQGTVFIEPEMIKRIEVEKGPHSVFTGNGGFGGTVHMETKDAPDLLREGRDLGAMLKYGYHSNDQQKIYSGAVFGRSEDRRVDALLYLNGRDGRDMKLADNLPLSPTDYPINPKRLPNSAQDEKTGLFKLNLHPTEEHDLGFTYLRSKSSRWTPFSASSYPTPPSQWTIDRYGYELGLTRLLAHRDTTDTTWTGKYNYHPLDNPWIDLQLSYSDARTEQLDRREDTAFYQLATGGKRMRTEYQDKVLELRNTSRFDTGALQHELTLGAALHKHKRDILMHMPGKTYETPRYNYGWLQPAFMPAGKQDTQSFYIQDAITYGSLTVTPSMRFDSVRNDGQANLAPIYDNPKLGHDYRAQTYSGWSPRLSVFWTATPNLAFFADYTETWRAPVIDEQYEVQNSSTIGGSSRDLDAERIHAIRGGSVINLPDLLVAGDSLQIRTTLFQNRIKDEIFRTRSVGCSQQSIDNGSIGGSCGDMLPLSNYRNLPGLTIKGFEIESFYDSQRLFGSLSYSWMTGKHDGAYSNPWGPNVWARDIPPPKWVAMLGLKVPEWDAKLGWQGEFVRKTDRLPSDRYSGGMGTGSGDIYWDHAANDSYDTHRLFAEWVPAKLGLKDTRIDFTVDNLFNRSYRQPLGGDLVYSQGRNAKISVTQFF

SEQ ID NO: 2530 - protein, 421 aa, Pseudomonas aeruginosa 2192
MSMTPIARAVAFAALGSSITVPTLAHAEFIKDSKASIELRNFYFNRDFRQEGASQSKAEEWAQGFLLRYESGYTEGTIGFGVDAIGLLGVKLDSSPDRSGTGLLKRDRETGRAQDDYGEAGITAKLRASKSTLKIGTLTPKLPVIMPNDSRLLPQTFQGGALNSMEIDGLTLDAGRLKKVNQRDSSDNEDMTITGGGKRNIVVRSGLTSDKFDFAGGSYKWTDNLSTSYHYGKLDNFYKQHYLGLVHTLPIADKQSLKSDIRWARSTDDGSSNVDNKALNAMFTYSLGYHAFGVGYQKMSGDTGFAYINGADPYLVNFIQIGDFANKDEKSWQARYDYNFAGVGIPGLTFMTRYVKGDNIDLLTTSGEGKEWERDMDIAYVFQSGPLKNLGVKWRNATMRTNYTNDYDENRLIVSYTLPLW

SEQ ID NO: 2531 - protein, 616 aa, Pseudomonas aeruginosa 2192
MNRVFLTPAAVALCGASSLSLAEPVSLADQVVTATRTAQTASQSLAAVSVIDREDIERSQARSVPELLRQVPGVSLANNGGFGKNTTLFLRGTESDHVLVLIDGIKVGSASAGLTAFQDLPVELIERIEVVRGPRSSLYGSEAIGGVIQIFTRRGDGQGAKPFFSAGYGTHQTLEGSAGVSGGAGNGWYSLGVSSFDTAGINTKRAGTAGYEPDRDGYRNLSGNLRGGYRFDNGLELDGTLLRAKSHNDYDQVFGNSGFNANADGEQNLVGGRARFTPFDPWLVTLQAGRSEDKADAYQDGRFYSRFDTRRDSLSWQNDLTLAEGHVLTLGYDWQKDEISSSEAFSVDSRLNKGWFAQYLGQYGRQDWQLSLRRDDNQQFGVHDTGSAAWGYALSDALRFTVSYGTAFKAPTFNELYYPDYGNPDLDAETSRSLEVGLSGTHGWGHWAVNAFRTNVDDLIGNDPRPAPGRPWGQPNNIDEARIRGVELVLGSQWLGWDWNANATFLDPQNRSGGVNDGNELPRRARRMFNLELDRRFERLSLGASVHAEGRRYDDPANKVRLGGYATLDLRSEYRLNDEWRLQGRIANLFGADHETAYGYNQPGQAVYLSVRYQAL

SEQ ID NO: 2532 - protein, 884 aa, Pseudomonas aeruginosa 2192
MPDVRLSSRSLTPVLCAVGLACALQGEVQAADGGPRDVATAPRVFDIAPGELAEVLLNIVRQGHVPIAFDQRLVAGLRGPDIRGRLSVEDALRRALAGSGLAYAQDESGAFVLRRGQAPVQETRGAAVAPTLSTVVVTGTRKSDVRAQDSLSPIDVVSATQLRSSGAVDLRDALVKLLPSLTRQAQPFNASALTHTQSLRGLSPNHVLVLVNGKRRHETANLNISGGLEKGSTGVDLDTIPINAIERVEVLRDGASAQYGSDAIAGVINVILKSADSGGSAAADVGQTGDGDGFTHGGGGNIGLAFGDSGFVNLTAEYREQERTMRSGIDERTGRRDNISMGDPAFHRQSLALNSGFGLGDDIEVYGFGTYTRRKASSAANYRLASVAPTLYPDGFTPRPNSDEDDYAFLAGVRGERLLDAWHWDLSSGYGADRPDIGMTQSVNAAIYRETGNSPRSFDLARYRNSQWTSNLDLGREFELDFLAAPLALSLGAEYRRESYRIDAGDPASYYSGGAESLAGLSPLSEGQWSRHAWASYLDLGTSLTPAWEVDVAVRHEKFSDFGSTTNGKFATRYQFDPRVALRASVSSGFRAPSLVQEHYTGLSVGPTIALGLLAANSPAAKMLGADELQPEKSTSFNLGLVLSPWENVGLNIDAYQISIRDRIVDSATYSGQEAIDALAAAGISLPASASTVSTHYLANGADTRTRGVDITGHYLVALGEYGQVDWELSANFNRTTLRKNHRGANGEPLLNAQQVAWITSSTPRSQVSLGGTWSRQDWEVSLRLTRYGRTSSELDYTVGPDAWSTEKFNHFVNDPKYITDIAARYRLSADLTLTAGADNLFDVRPDKLPAQNTTYGDVLRYDTYASQIGFNGAFYYLRAAYRF

SEQ ID NO: 2533 - protein, 813 aa, Pseudomonas aeruginosa 2192
MHFSLRSRHLRPSLLASSLLLAVSAQGQEKLDVDLPAAPLGQAINALAQQSSVQILFAGDLGAGRQAPALKGRFTPEEALRQLLRDSGLKAQARDEHTFIVVPASEAAVPATQARSEPLDMEQMEITASRTSSDLVSATRQSTVIEHAQLEELRQGSDSLATVLAKAVPGMSDSSRTITEYGQTLRGRSMLVMVDGVPLNTNRDSSRNLANIDPALIERIEVIRGSSAIYGSGATGGIISITTRPAGGENRAETRLSATSPLTRLGSDGLGGQFQQYFAGSLGALDYSFDFGTRHVGASYDAHGDRIAPEPSQGDLFDSNVYNIGGKLGLRIDENQRVQLALSHYDARQDTDYATDPRVARLPPGSVPANAIKGLELDEQNRIRNTLANLEYENLDILGSRLSAQLYYRDYFTRFTPFDARAVSTRGGNVDQIMQNSEVFGSRLTLRTPLGESGNTELVWGGDYNQERSDMPLDVFDPAAYDASGGLVFDKIGKLTYMPPLRTRSAGAFAQLQHRFDEHWSIDGGLRYEYSTAEFDDFIPLSESKAASPVTVKGGDLDYDAVLSNLGIVYSPVAGQEIYASFSQGFQLPDVGIQLRNARRGFDIGSSNLEPVKTNNYELGWRGAIGGNTLGSLALFYTTSKLGDVQSFNNGLILTRTKERIYGVEASADWLSDDEVWGAGGSATWMRGREKPDGKDWQDMTGYRVPPLKLTAYLQYKPDADWNNRLQATFFDSKDYRLDGVESFGRRQVSTYTTVDLVSQYRITPDDQLSLGIQNLFNRDYYPLYSQLLRNNNNTSHLPAPGTVLTASYTHNW

SEQ ID NO: 2534 - protein, 891 aa, Pseudomonas aeruginosa 2192
MKHRGWSAVRGGRKGAQLALGLGLVLLGTAALPLHAQDGADSASQQQTALRRVRLDIPAQPLNRALLRFAEQAGVQVFFDSQRFAGLGSAAVHGEYVLADGLSQMLQGSPVEYRFSGKDQLSLIRVSQDDLVQMSPSVISAARPDDWVYQTPHSVSVIGREQIERNPPRHAADMLEETPGVYSSVSQQDPGLSVNIRGIQDYGRVNMSVDGMRQNYQQSGHQQRNGTLYVDPELLSEVVIDKGASSAMGGAGVIGGIANFRTLEARDLVRPGKQVGGRVRLTSGLGGDANGTHFIGSAAFAIGTEVWDMLVAASERHLGDYDPGTKGSIGELRTGAWFNPEAGQRVKHSPVAYSGYVMRSRLAKLGVALPQDQRLQFSYLTTQVSYDDANMLNTENQALWEKLGSSDVRAQNFAIDYGYAPDNPLVDFKAKLYYVDNRNRQQTLQRGITPGYSITYQTDTYGAQAQNTSTFALDDLSTLRANYGLEFFYDKVRPDSSQPRASTSAVGFPAAEGMTPKGDRALGSLFARLDYDYDDWLNLNAGLRYDRYRLRGDTGFNARTFILGTTRQTDMPLQYAVDREEGRFSPTFGLSVKPGVDWLQLFATYGKGWRPPAVTESLITGRPHGGGAENMYPNPFLSPERSKAWEVGFNVLKENLWFSDDRLGLKVAYFDTRVDDFIFMGMGMQPPGYGMAGIGNSAYVNNLDSTRFRGVEYQLDYDAGLAYGQLSYTHMIGSNDFCSKTAWLGGVTQTVKGSGRRPPVIDMRPDEQANAATHCSAVLGSAEHMPMDRGSLTLGMRFFDRRLDVGARARYSEGYSVAGGATVSQAGVYPADWKEYTVYDLYGSYRVSDELTLRLAMENVTDRAYLVPLGDVLAFTLGRGRTLQGTLEYQF

SEQ ID NO: 2535 - protein, 995 aa, Pseudomonas aeruginosa 2192
MTDDHSFRPRPTSLSAALLLGAWIAQPATAAYVEAGRPGDPASWRSAEYQQDWGLERMRADQAYAAGIDGQGVKIGEMDSGFDPSHPDTPASRYQPVTASGTYVDGTPFSVSGAMNGNNDSHGTHVGGTLGASRDGVGMHGVAYAAQVYVANTNQNDSFLFGPTPDPNYFKAAYQALADAGVRAINNSWGSQPKDVSYETLDGLHAAYAQHYGRSTWLDAAAGVSRQGVINVFSAGNSGYANASVRSALPYFQPDLEGHWLAVSGLDQQNGQRYNRCGIAKYWCITTPGRLINSTMPGGGYANKSGTSMAAPHATGALALVMQRYPYLNNEQALQVLLTTATQLDGTPTGAPTDTVGWGVPDLGRAMHGPGQLLGRFEANLPAGLRDEWSNPISDSALLQRQAEDAAEHAAWQRTLKDKGWENGLPAGASQQERTDYAIGMARDQAAAQRQYQGSLVKAGAGSLVLSGDSTYRGPTLVDGGLLSVDGSLLSAVEVNAGGTLGGSGRIGGLLARSGGTVAAGNSIGTLEVAGDLRFESGSTYAVELSESASDRIVASGKASIAGGNVTLAMENSPDLLSQSQVESLVGRRYDILDAAGGIDGRFDAVLPNYLFLGGTLDYAANAIRLDIGRNGTALASVAQTPNQAAVAGAVEALGAGNPVYESLLLSENAATAQRAFQQLSGEIYPALAGLLLNDSRYLRDSVGERLRQASDGEAGREAPEGWFKALGSWGKSADGSHGSEGYRHSVGGFLLGVDSQVASDTRLGLVAGYSNSSLNMDSSLQSSASIDSYHLGAYLGRQLQQWRLSLGAAHAWHRAEVKRDLQYGAVAGKQKAKLDAQSSQLFAEAAYALGWRSLELEPFAGLAYVHVASDDFRERGSAAALEGGDDNLDAAFTTLGLRAKRHFELDAERRLALSGTLGWRHNLSDTTPQRHLAFASGSQPFNVESVALSRDAALLGVDASLAVNREVSVRLGYNGLLGSREKDHGVGLAVDWRF

SEQ ID NO: 2536 - protein, 416 aa, Pseudomonas aeruginosa 2192
MNNNKKCAFFLLPILAGDSVPALAEGFLEDSRASLALRNFYMNRDFRDGAGRAKSEEWAQGFLFDYRSGYTEGTLGVGLDLLGKLGVRLDSGAGRSGTGLLPLRDDGSAAGDYARLDATAKLRLSRSELKVGGLVPKLPTIQPNYGRLFPQVFQGALLTSGELSGLSLNLGRLTEVSQRNEAGTSDLALFNRNRRFAGAAQADRFDLAGLDYRIAPDWTGSYHYGELEQVYAQHFLGLKGRIGIAADSLESDLRLALSRDTGGARGGRIDNRSFSGSLTYRLRNGQAFGLGYQRMSGDHGFPYLEGTDPYLVNFGQYNDFAEAGESSWQLRYDCDFAPLGVPGLSLMTRYFSGHGAKPKGADGSREWERDSDLRYVLQGGALKGLGLVWRNATYRSAFSRDIDENRLYLTYELPLF

SEQ ID NO: 2537 - protein, 723 aa, Pseudomonas aeruginosa 2192
MEKRMSTQQRAAGNACPTAAFSFDPARLAQRRRWAGAFAALCGLALSPSALLAEEHSQHQDHAVELAPSVVTGVAQSSPLTIVTNPKEPRQPVPASDGADYLKTIPGFAVIRNGGSNGDPVLRGMFGSRLNILTNGGMMLGACPNRMDAPTSYISPETYDKLTVIKGPQTVLWGPGASAGTILFEREPERFGELGSRVNASLLAGSNGRFDKVLDAAAGNRLGYLRFTGNHAQSDDYEDGAGNTVPSRWKKWNGDVAVGWTPDEDTLIELTAGKGDGEARYAGRGMDGSQFKRESLGLRFLKSNVSDVLEKVEAQVYYNYADHIMDNFRLRTPDPSSMMPMPMASQVDRRTLGGRLAATWRWDDFKLVTGVDAMRNEHRARGSKYDMMTDYYTDADQFPWSKDAVFHNYGAFGELTWFAAERDRLIGGLRLDRASVKDYRQTLKSGHMGHAMANPTANDTRADTLPSGFVRYEHDLADSPTTLYAGLGHAERFPDYWELFSPKRGPNGSVNAFDKIKPEKTTQLDFGLQYNGDKLQAWASGYVGVVQDFILFSYREGMMGSSTQATNVDARIMGGELGASYQLTGNWKTDASLAYAWGKNSSDDRALPQIPPLEARFGLTYEEGDWSAGSLWRVVAPQNRIARDQGNVVGKDFDKSAGFGVFSLNGAYRVTRNVKLSAGVDNLFDKDYTEHLNKAGDAGFGFSANETVPEPGRTFWTKVDFSF

SEQ ID NO: 2538 - protein, 434 aa, Pseudomonas aeruginosa 2192
MKTLRTLPALLCAGFLGLSAQAAEDSRSGPLAGFGERLQRHGVKTHAQFWSLSLKNLDTGPRQHSFGNSGDLFLGADLDLATLAGLDGASLHIEETLFILDRGTGQPTGPSWQGAVGSYFGGAPLHNDIGANQLSLLTWQQQWLGGRLDSHLGRTNARRYFLIYNCETVVTCNDPIIDASTGILPPPYGAWGGYLKYRATPTLYLHAGAFESNPVDYLKKRHGLDFGTDDASGTSLLLGIGDKREESLDPYRSHYELNAYLNTANQVDPLTGASDHGSAGGFFKFQQLFWRADGGRLDSPRALGLFGSLSVSADDKQPFRHFAELGMTYHAPFDRTRDKLNLKASYLRLNDHQLEFQRQARIAAGGDAKLGQRDVYALETNAHIALTPHIALEPSVQYIFNPDNYYNPGARELSGDGFVVGLQLMVDMGSLLGL

SEQ ID NO: 2539 - protein, 352 aa, Pseudomonas aeruginosa 2192
MITACPRPCAWRSYALGLGLLPLAAQAEFLADSSAHLDLRNFYQLRDYRQHDAPQSQAGNWSQGFVLRLQSGFTDGPLGFGLDATGLLGVKLDSGRGRSNDGTLPFGANSKEPVDDYSHLGLTAKLRYSQTQLQVGILMPQLPVAFRDDVRLLPQTFDGALLTSSEIEGLTLTAGQLWKSRTRESAGSDDMYIMGRDKAHASDEFNLAGATYAFTPRLSASYYYGQLKDIYRQHYLGLLHTLPLGEGLSLRSDLRYFDSGEDGAAISGPVDNRNLNAMLTLRAGAHAFGIGVQKMIGNDAFPVLNGYTTPYVANLMAYQTFTRPQEKSWQLRYDYDFAGLGLPGLNLMTRYV

SEQ ID NO: 2540 - protein, 694 aa, Pseudomonas aeruginosa 2192
MNARTHRKLNRGIGVVTLSTLLASPSALARENPPAEDEPAALEALVVTGEKRERSLKDTASSVSLTSARDIDRKQTGNASVAEVINGSPNVVYTDSVGAPIIRGQDTQGPNNGQNVFWGGTVPRATINLDGHYLNYNEMFFGATSVWDVDSIEVFRGPQTTSQGANAIAGAIIVNTKDPTFSPEAAYQAEIGSYHSRRSSIAVSGPLAQDFAGRLAVDYAGRDTFIDYDNPKFQDSGTDQDFRALNARAKLLWLPSGIPGLESKFTFSHNDNNRPTQEAATRPFDKLDHRSTTMPSWEQDTNTSILDVAYDLDNGIRLFNQAQYSLSSVHRTTGAGGEGDADIRQKNASNESRISFGEQEDRISGMGGVYYARTRTDETLHLRGLSAFDDTKKNLGVFGELNYRLSDRWTLTTGLRYQEDRIERSGNSVLAPRPLDYQKTFSAFLPKVSLAFAATPDWTVGGLVSRGYNPGGVSLNLTTRNWAYFKEETIWNYELFTRASLLDGRLLLNGNLFFMDFKDAQYNIPVVVSPGVAQSYTINAEKAHAYGMELDLDYRLRDDLRLKASAGVLRTRIDEMSGNTGYEHNEFARSPGYTLSFGPSWDVTERLNLNAQVRYLDGYYSDTANTKAYSIKAYTLTDARASYRFNDQVQLYGYVKNVFDDRSPTYMQENRGIGGIEASMTQPRTLGIGIKGTF

SEQ ID NO: 2541 - protein, 802 aa, Pseudomonas aeruginosa 2192
MKHVVSSALLLGLSSLSLAAQAAPIALDLPAQPLAASLEQLQGASGLRIRFDRAAVADRRAPALRGTLEPSEALQRLLAGSGLSGEVRGGDAWVEAAPTGAGIAPGDSVDLGALSVVATQDPATAAITEDSGSYTTRAMRTSTKLAMSIRETPQSVSVVTRQRMDDQGMRDLNDAVKGVTGLTVQQYGPARVKYAARGFDVDNIMYDGLPTSISTYTQDVISAADLAMFDRVEVVRGATGLMQGAGNPAAAINMVRKRPTQDFRASLQGSVGTWDRYRSEADVSGPLNSEGTLRGRAVVAYQKGNSFQDHVSSERGVFYGIAEADLSPDTTFAIGASNQNDNRNDNWVGLPSPLGGRHLDLKRSSYYGADWSYWDTDTTHLFSDLTHRFANGWQMKLAADKLWARINMLGLYNDCYYSTTGCASMTQNPGDYSYTDDHDSYDAYANGPFQLLGREHELVVGASYRQERFDGHGGWGSLFNKDGTPTGPMDPTQWDPSSTLKPRLNTSLWGMKLDQEQKGAYLTTRLNLADPLKVILGGRLDWYKADADTDSYKVTRNVTRYAGVIYDLNQTYSVYASYTDIFKPQSNFDAGGGLLDPITGKNYEIGLKGEHFGGALNSQIALFQIDQENRATEDVGGPSPCPFSPTSRYCSRASGKVRSQGVDLELSGALSDDWQMMAGYTYVDAKYKHDSNKANEGKPFDAAKPRHLFKLATSYTLPGELHKWRVGGDLATQSKTEDSSTGFQQGGYTVVNAMLGYKVNERIDTRLNFNNLFDKYYYSGIDFGNLNYGEPRNLMFTVKYSL

SEQ ID NO: 2542 - protein, 788 aa, Pseudomonas aeruginosa 2192
MSSPFAARPSRGRLALACAAAFAWPAAHAASTDDARGATARGGVERAADAAAPASAVATVPPAPVAGDTLTAVSVTAQRQPVDPDTPAVVTSITREQIESHTNVTTEDALKYAPNLMVRKRYIGDRNSVFAGRDFNELQSARGLVYADGVLLSNLLGSSYAYPPRWSLIPPDDIARVDVLYGPFSALYPGNSIGSTVLLTTRRPEKLEASLSTQFFTQRYHDGYGFADSFGGNHQTARIANRVGRFWFALSLDRLENNGQPMQYASPNSAYNPKLGTAVPVTGAATDIGPNGRPRTIVGAQTIERTEQLNETVRMGYAFTDHVDATLTLGHWENHYRQHGETFLRDAAGNPVYGGNVSIGGQNMTVAPNAFAPQRGDQENWLYALGLNGRLDSGWRLSGVVSAYDVSRDVQRSASTVQGGAGTLFQGDGTGWRTLDLKAEAPEVKGHTFTFGYHYDNYFLRNVTFNTADWLAGPTTSLSSVYRGDTRTQALFGQDAWRFAPGWLATLGLRYERWDAYGGALGNASGTLGYADRSANALSPKVALQWDATDVWRFRLSFATGTRFPTVGELFQGTISNNAIVNNNPNLRPEKAIDWDFTAERDVGVGVVRASVFQSDLRDSIYSQTTVSGATTVTNISNVDRVRVRGVELAFSGENVGLKGLAIDANVSASNAQILADAANPAYVGSRFPRIPRMRANLLASYRFDEHWLASVGVRYSGRQFNTLDNSDVNPDVYGGTSSFTVVDLKARYRFDHHWTASLGIDNLTDRRYYVFHPYPGRTFYGELKWSL

SEQ ID NO: 2543 - protein, 720 aa, Pseudomonas aeruginosa 2192
MKTETKVIKGRQGIARNRHTPLCLGLLLALSPLAAAVADARKDGETELPDMVISGESTSATQPPGVTTLGKVPLKPRELPQSASVIDHERLEQQNLFSLDEAMQQATGVTVQPFQLLTTAYYVRGFKVDSFELDGVPALLGNTASSPQDMAIYERVEILRGSNGLLHGTGNPAATVNLVRKRPQREFAASTTLSAGRWDRYRAEVDVGGPLSASGNVRGRAVAAYEDRDYFYDVADQGTRLLYGVTEFDLSPDTLLTVGAQYQHIDSITNMAGVPMAKDGSNLGLSRDTYLDVDWDRFKWDTYRAFGSLEQQLGGGWKGKVSAEYQEADSRLRYAGSFGAIDPQTGDGGQLMGAAYKFKSIQRSLDANLNGPVRLFGLTHELLGGVTYAQGETRQDTARFLNLPNTPVNVYRWDPHGVPRPQIGQYTSPGTTTTTQKGLYALGRIKLAEPLTLVVGGRESWWDQDTPATRFKPGRQFTPYGGLIWDFARDWSWYVSYAEVYQPQADRQTWNSEPLSPVEGKTYETGIKGELADGRLNLSLAAFRIDLENNPQEDPDHPGPPNNPFYISGGKVRSQGFELEGTGYLTPYWSLSAGYTYTSTEYLKDSQNDSGTRYSTFTPRHLLRLWSNYDLPWQDRRWSVGGGLQAQSDYSVDYRGVSMRQGGYALVNMRLGYKIDEHWTAAVNVNNLFDRTYYQSLSNPNWNNRYGEPRSFNVSLRGAF

SEQ ID NO: 2544 - protein, 795 aa, Pseudomonas aeruginosa 2192
MTPFPRFALHTLPALFLSLGCLAATAQAAEAVRYRFSQAAAPLARALDAFSRASGQTLLYTAELPPQATAPALHGSLGAEEALQRLLQGSGLRARRVDERTLTLEPIPASGALDLDATTVSAAAPAQGYRPAASASISRGDAPVLEIPQTISVVPAQALQDQRPRNLDDALGNISGITQANTLGGTQDAVMKRGFGDNRDGSIMRDGMPSVQGRNFTATADHVEVLKGPASLLYGIQDPGGVVNVVSRKPQLQQANALTLRGSAYAHGRNGGGGQLDSTGPLGDSGLAYRMILDHEDEDYWRDFGKSRETLVAPSLAWYGEDTTVNLSYEHREFTTPFDRGTAIDPRTNRPLDIPRSRRLDEPFNITEGRSDLTRLDLERQLDDSWKAHFGYGYSRETYDDNQARVMAVNADGTLTRRMDGTHGAVSSDSFATLGLSGALQLAGMRHDLQFGMDHEKRKIFRADLLRDSRTSRFDYLDPVYGQVVPSTRVVAGDSDQTDKLRSDSLYFQDSIHLDDRWILVGGARYQIYDQLAGRGRPFNANTDINGQKWVPRGGLVYRLSDEVSLYGSYTRSFKPNSTIAPLSTGETIDSAILPEEATSWELGAKLDVPGRLSGTLALFDIRKKNVLVNELDGAGNSSVRAAGRVRSRGLELDLTGQLSERWSLIGSYAWLDAEVTEDPTLEGKRLQNVARNTASLSAVYELGEVLGGDRLRLGGGARYVGERPGDPGNSFDLPSYTVADAFASYDTRFGGHGVKFQLNVKNLFDRTYYPSSANRLYVAMGEPRQFQVSTTVEF

SEQ ID NO: 2545 - protein, 444 aa, Pseudomonas aeruginosa 2192
MRNLFALTPMALALCTASAAWADEGEAKEGFIEGSSLQLLTRNYYFNHDRRHASGHDSKEWAQGFIATFQSGYTPGVVGFGVDAYGMLGLKLDGGGGTGGTSILPITAPSKEGYESGKAPDEFSSGGAALKIRAFDTELKLGDQFLSNPVVAGGESRMLPQTFRGVSLTNNSFEDLTLTAGQVSFTKYYNQSGHRRLGSYYGELPGDRDSHHLSWLGGTWGGIEGFTSSLYAAELQNVWKQYYADVDYTYEIDDNWSLNPGAHYYKTVDSGDSLLGRIDNNTYSLHFAVGYKQHTVTAVLQKVNGNTPFDYINQGDSIFLDNSQQYSDFNGPNEKSWKLQYDYDFVALGLPGLSASASYSRGKLDLTRVDPDSPGYGGWYSADGKNAKHWERDLDLQYVVQGGPAKDLSLRLRWATHRGTGGYSAVDNDIDEYRVIVDYPIDVF

SEQ ID NO: 2546 - protein, 278 aa, Pseudomonas aeruginosa 2192
MSRTLATVMLAGGLLAAGQAVAEDHDMTPTHETDSGPLLWHNESLTYLYGKNFKINPPIQQTFTLEHASGWTWGDLFIFFDQINYNGKEDASNGKNTYYGEITPRLSFGKLTGADLSFGPVKDVLLAGTYEFGEGDTEAYLLGPGFDLAIPGFDYFQLNFYYRKPDGNRVRAGAWQITPVWSYTIPVGNSDILIDGYMDWVINNKSASTSRRNQSDYHANLHFNPQVKYDLGKALGYEPKHLYVGLEYDYWSDKYGVKDSQYFTTDQNTASFLVKYHF

SEQ ID NO: 2547 - protein, 452 aa, Pseudomonas aeruginosa 2192
MQNLRRAVFAGLVAGTLSEGAAATAGDGGFVEDSELQFLARTYYFNRDYRDSPNNAGRNRFKPRSERNGYREEATQGLRLQFASGYTPGSLGFGLDAHAMLGLQLDSGGGRTGTGNLPVGADGHPDHRYGKVGGALRLRHGETRLKYGQTTTSAPVFAASSNRTLAGMAYGLLLEDRSFDGLLLEGGRFTAASGPGESKVRGDISTVYGRLGAYPVRLDAVGFLGGQWQATERLQLSLYASRFDDIWQQAYFGASHRQPLGGERALRVDLDAYRTRDSGQSRFGRIDTLTSSLALGYEHGPQRITLAYQRVHGEQPFDYMAFGDGRSSASMVLANSVGYSDFNGPGERSWQLRYDLDLGALGLPGLSLHALHARGRAGASASSAAESIYAGLYGRDGRHRENDLGFAYRVKAGPLAGLALRASQAWHRGNASYLDGDIDETRLVVDYSRSIW

SEQ ID NO: 2548 - protein, 790 aa, Pseudomonas aeruginosa 2192
MKHHYRLPLRRTPPGGSDYALALLLALGGALPASAADAPAPAEEAPPLAGSAPAKADTALGKVTVTARRREEDSQKVPTPITVLGGETLEAQRISRVQDLQQVLPSVNVAYIHARQSSVAVRGIGNNPASDGLEGSAGIYLDNVYLGRPGMAVFDLLDIEQLELLRGPQGTLFGKNTTAGVLNISTRAPTFTAERTVEVSGGQDGYFQGRGTVSGPLGETLAGRLSAYRTRDDGYIKNIHDDNYLNGGERQGARGQLLFEPNEDFSLRWIADYNEEDSSNGSMVVYGGAERFWQRAALVGASPLRDPQRRKVNINGRQHVSVHQGGSSLEANWNLAGGYRLTSISAYRYWHFTPANDEQLNVSAINDTGVEVHDRQFSQEIRLASPTGGAFDYVVGAYAFRQNLGNKTFTSYGPLADLYLLGANLGALNDTYSKANGKIETDSFALFAQGTWHLTERLDFTAGLRGTYEEKNAKVERFAPLGGAAVGGVGAAVRNGQLGAYDSGDLSQYNFAPSALLSLSYQFSDDLLGYASLSHGEKSGGVNLAVGSAPSAGADSLLVGPERANDAELGLKSTLFDRRLLLNANLFWTGIHGYQATTLYQAPGSTQLVQVLANAGSVRSRGLEFEATALPLRGLTLNFNGSYNDVTYLSFKDAPCPAEVSTRPGAPSSCDLTGQRVVGASKWIANLNGEYQWRLDDRFQPYVSASYAYRSAAEGTLDNSDLSKIDGYALVNLAAGLRSDLGDGQLDTSVWLKNAFDKDYYLSAFASINGSYTASVGQPRTLGVSLRYDF

SEQ ID NO: 2549 - protein, 421 aa, Pseudomonas aeruginosa 2192
MSHPSHVRALCASLCLGAGLPVHAGHVHAGQGFLEDAKASLTARNFHLHRNFVGDASQGKAEEWTQSFILDARSGFTQGSVGFGLDVLGLYSLKLDGGKGTAGTQLLPTHDDGRPADDFGRLAVAGKLRVSNSELKIGEWMPVLPILRSDDGRSLPQTFRGGQLSANEIAGLTLYAGQFRGNSPRNDASMQDMSLFGRPTATSDRFDFAGGEYRFNGERSLLGLWNAELKDIYRQQYLQLQHSQPLGDWLLGANLGGFRGRDAGSARAGKLDNRTVSALFSARYGLHTLYLGLQKVSGDDGWMRVNGTSGGTLANDSYNASYDNPGERSWQLRYDFDFVGLGLPGLTFMTRYLHGDHVRLAGVTDDGSEWGRESELGYTLQSGAFKRLNVRWRNSSQRRDWGSNTRFDENRLIVSYPLSLL

SEQ ID NO: 2550 - protein, 647 aa, Pseudomonas aeruginosa 2192
MFKPLAVAVGLGCAALSLGANAYQYGEYAGETLERLITDYPGRYRGTASFAGASELMQSRLGFGYQTSRQDFTWAGNRSSQNVIASAPGSSGKFLVLGAHYDTYYGRPTLQGLDDNASGAAVLTEIARNLGGIALENGLEVVGFGAEEEGLRGSRAYVESLDASQRANLLGMINLDSLVTGDKMYAHAGSNSVSNPALGAYREQILRIARELDIPLFTNPGLNAEYPAGTGCCSDGESFNGMDIPVLFIEATNWELGDLDGYEQTDNPAIPGGSTWHDPAEDNKEVLTNALGQERIEQRMRDFSRLLTRLVLELTNADLLASTASGGALARQMEDQLQRQHQALTRLHDRRWLTLLGSNRPVGSFDGEVGAEGEVSPDSGFDMPGDPESRRAGVHLLGDYRYSEALTLGGSLAFQRSRDKLDHGGRIEGDTWQLGLFGLYNDGGPEWLAGELNLGHTRYDSKRSVYLQAAGGPVLLDQRLSGDTSAWSWGARLEGGYDFSFGELRSGPLAGLDYMRYRIDDFREDEALRTALGYEKQDYDSLEASLGWRLRGELALGARMRLQPYASLRWVRELADGRLEDMDLTSRGDGRVRVADMGGVDKDFGRAQLGAQLAITEQLGVFAEANSRFAHSEGNQAGYSLGVNWQF

SEQ ID NO: 2551 - protein, 730 aa, Pseudomonas aeruginosa 2192
MKKHSTARRVLALGLNLTLAGVPALLWADEEPTELPALTVSAGAAGETPPALDLDDSAGGGSRLGLSLRETPGSVSVANRASFERRGLRSTQDIANSLPGVNASAPPGFGGFVTYRGFSSNQVNQLFNGIPVQYSSAMRPLDDWIVDRVELVGGPSSFLNGAGAVGGSLDYISKLADRYGDFMEGRVRYGSYDDSEVAFGFNQALGIGPEPKHFVRLDVSRSGGNGYVDRNSRESWNVAFSLLSDLTPDLSHTLALEYQDEQEDSPYWGTPVLNPYAGELKIDKSRRRENYNVADGRYEQRVRWLRSILEYRVSDSTRWRNTFYHYDAERDYRNLETYRYNADNSGVVRSNAFLQRHDQQLNGNRFELQHSQPLFGLASDWALGFDYSINKQTRFPSTASGPFGTVDPASFEPGHFYDLPGMRPGHRKDRSNEVRTSALFAENRLGLTDELSLVTGLRYDHLDLDVRNHRVPDKDNPAHFERRWDVVTGRAGLVYQFTPHANVYLQYSTAADPPGGVLTSASFGQVRDYDLSTGDQWELGSKFDFLDGRGSATLAAYRIVRRDFSVADPNNPNLSVPVGQQTSRGIEAAASLRITPKLLAEGNFAWVDAQYDEFTENVGGVAVSRKGKTPPNVPERVGNLWLTYDFDPAWQGGVDARYVSSVYANNANTWHVPSYTVYGTFLSYRLDERTRITGRVRNLTDEVYARFVQSTPLYYVGDPRTFELSVQTRF

SEQ ID NO: 2552 - protein, 802 aa, Pseudomonas aeruginosa 2192
MPRPTFRPGLLALAIALAVPAPFLHAAPAEQASVRDYRIAAGPLAGTLNRIAAQAGLVLTLDPALAEGRSAHAVQGRFDAPGALREALKGSGLELVENAGGTYSLRKVPEDTLSLQAMTVSGAEEDPLGPTSGYVAKRSMTGTKTDTPILETPRSISVATRQQMTDRAVHNLDDAVRYMPGVVASSFGSDSRSDWLKVRGFKPTQFLDGLPMAVGVYNNPKLETWNLERVALLRGPASSVYGQTPPGGMLDMVSLRPQNVASHEVKAEVGNYNHKQVSFDSTGPLDDEGRFLYRVSGVVRDSNTQVDHIDDKRYNIAPSLTWNIDDDTRLTFLGQFNRDDTGITSQFLPLRGTKYDGAVRQGFHHKNLGDPDWEYYDRTYYWLGYAFERRINDVWQFRQNLRYLRNDLSFQALTPASYYAAASDDGTLQRTSTSVDEDVSQFVVDNNFQADFDTGALRHTLLLGLDHNRTTNEYTSIFGFNVPPTNINNPIYGQPIPKPPRSDAYYDYKQKTYQTGLYVQDQIALDNWRLTLGGREDWVHTGATFYNKGDATNTSRDKKFSGNAALSYIFDNGVAPYISYAESFQPTTGADMNSTSSLKPTEGKQWEIGVKYQPVGSDSLFTAAVYDLRQENVSVSQNIGGTPVTSQTGEVKVSGIELEARSFVTDNLKMIGAYSYADTEVKKGQYAGNRLQQAPRNQASLWADYTWHEGTLNGFSVGAGARYVGSTYGDQANTYDGYAGSYTLYDAAVRYDLGQLNGSLKGVSVAVNANNLFNKDYLASCDGYYCYYGGQRSVVGSVSYKW

SEQ ID NO: 2553 - protein, 646 aa, Pseudomonas aeruginosa 2192
MIRMALKPLAAACLLASLSTALQAAPSPYSTLVVFGDSLSDAGQFPDPGGPAGSTSRFTNRVGPTYQNGSGEIFGPTAPMLLGNQLGIAPGDLAASTSPVNAQQGIADGNNWAVGGYRTDQIYDSITATDGSLIERDNTLLRSRDGYLVDRARQGLGADPNALYYITGGGNDFLQGRILNDVQAQQAAGRLVDSVQALQQAGARYIVVWLLPDLGLTPATFGGPLQPFASQLSGTFNAELTAQLSQAGANVIPLNIPLLLKEGMANPASFGLAAEQNLIGTCFSGNGCTMNPTYGINGSTPDPSKLLFNDSVHPTITGQRLIADYTYSLLSAPWELTLLPEMAHGTLRAYQDELRSQWQADWENWQNVGQWRGFVGGGGQRLDFDSQNSAASGDGNGYNLTLGGSYRIDEAWRAGVAAGFYRQKLEAGARDSEYRMNSYMASAFVQYQENRWWADAALTGGYLDYDDLKRTFALGGGERSEKGDTYGHLWAFSARLGYDIAQQADSPWHLSPFVSADYARVEVDGYSEKGASATALDYDEQKRSSKRLGAGLQGKYAFGSDTQLFAEYAHEREYEDDTQDLTMSLNSLPGNRFTLEGYTPQDHLNRVSLGFSQKLAPELSLRGGYNWRKGEDDTQQSVSLALSLDF

SEQ ID NO: 2554 - protein, 417 aa, Pseudomonas aeruginosa 2192
MKIRRKTAVPCNAGAVLPMLACLAAQAAEGGFLEDAKTDLVLRNYYFNRDFRDHDAGKSLVDEWAQGFILKFSSGYTPGTVGVGLDAIGLFGVKLNSGRGTSNSELLPLHDDGRAADNYGRVGVAAKLRVSASELKIGEMLPDIPLLRYDDGRLLPQTFRGFAVVSRELPGLALQAGRFDAVSLRNSADMQDLSAWSAPTQKSDGFNYAGAEYRFNRERTQLGLWHGQLEDVYRQSYANLLHKQRVGDWTLGANLGLFVDRDDGAARAGEIDSHTLYGLFSAGIGLHTFYLGLQKVGGDSGWQSVYGSSGRSMGNDMFNGNFTNADERSWQVRYDYDFVGLGWPGLIGMVRYGHGSNATTKAGSGGKEWERDVELGYTVQSGPLARLNVRLNHASNRRSFNSDFDQTRLVVSYPLSW

SEQ ID NO: 2555 - protein, 989 aa, Pseudomonas aeruginosa 2192
MPGANPASEEVMSLQRPIPSLARPLSRLSPLTLALRWALLGLSAAGAGLLGGDLAHAQSVGQHSAATRLDDATPRSYDIPAGSLGASLGAFASQSGLLLSFDPELTRGRTAPALKGRYSVLEGLQRVLSNTGLQVAAGTSGAYLLVEPRMSGEAPADLSPVVVSAAELADPQKETYTAPRSSVYLSSEDIDRFGRVSVGDLLQGIPGVQVGDSRNGGALDVNIRGIQGQSRVAVRVDGAEQALDVYRGYAGTQQRSYIDPDLVSSVTVDKGPSTRSGAIGGSVEMRTIGVKDILVDGKDLGVRFTGDVWNNGVAPQHRSASSKTENLSSVPHDDRGSLFGSQAKSGSAAFAYRNEHLDLVAAYAQRNQGNYFSGKKGQDRYRVYNRYGREESSVAKVYNAGEEVLNSSSETESYLLKATWRIADEHTLDLGYRRYDGRTGEIMPSDIFRFGTAGIYQYPLSEVKIDTYTARYRYLPENNPLVDLSTGLWMTEAKSDMLTSVLAPRSQAYRSDRNWTRQDNRRIGGDLNNVARFETDFGDFKLDLGGSFQVEDIQPQKSVVTTLHDINANRTLRDATRQEYGLNGKLEFKPVERLTLWGGGRYSHFNSKDNGISASPRREDRDMRFITVSRPGYYGSMMWFPDQNGQYTDATDPRLNNGIVTNNTNNPFEGIPFDEFGPANVTVHPSRVTNVVTGYNYSKKGSSRGGGFSPAFGINFELAPDTFVYASYTEGLRLPSLFETSQGTLQVEPGKDLKPERSRSWEIGASALRDSLLADGDSAAIKLAYFNNTIKNYITRYYDPGQMGLMTFSNTDSYRTSGLELQSHYDAGRVFADLSATYYLKTETCDAAFAARLRAGANRYQRTENTPNCTPGSFMGSYTNTQNPPRLATNLTAGLRFFDQALTLGGRMTYTSGPTATADKPWQVGATTPQIEYRSVQLFDLFLKYKLFEHTELNASLQNLTDRYYLDPLAQSFMPAPGRTLRVGMQAKF

SEQ ID NO: 2556 - protein, 708 aa, Pseudomonas aeruginosa 2192
MRVSVSLVLGVGLGCSSPALWAETESPAELEVLTVTAEAERAEGPVQGYRANRSASATRTDTRIEDIPQAISVVPRQVLDDLDSARIERALDFAGGVSRQNNFGGLTMFEYNVRGFTTSEFYRDGFSANRGYMNAPDSATIERVEILKGPASSLYGRGDPGGTVNLVTKKPQAERFARLHASAGSWDRYRSTLDLNTPLDEEGDLLYRMNLAVEDSKGFRDYADGQRLLVAPSFSWQLDPDTSLLVEAEVVRNRQVFDRGTVAPHNHLGSLPRSRFFGEPDDGKIDNNNETLQATLRHHLNEQWSLRLASHYKHGHLDGYASENSSLAADGYTLRREYRYRDFEWHDSITQLDLLGDLHTGSIRHQLLMGLEYERYHNDELILRSIPSRNPYAIDIRRPVYGQPKPPFGRDDRNHEEVDAMALNLQDQIEFNEKWRGLLGVRFDRYRQDMNATRLNNGRFRDTSSQQTQRAATPRIGVLYQATPEVGLFANASKSFKPNGGTDMAGKAFDPEEGRGYEAGVKLDLLDGRLGMTLAAFHLKKKNVLTADPSNPGYQQTAGEARSQGFDLQFSGQLTEQLRLIGAYAYIDAEVTKDENIARGSRLLNVPKHSGSLMGVYEFREGWLHGADAGAAVNYVGERAGDSSDSGFELPAYTTVDLLAHYPLASNATLGVNVNNLFDRRYYERSYNNVWVAPGEPRNLTMSLTLNY

SEQ ID NO: 2557 - protein, 742 aa, Pseudomonas aeruginosa 2192
MPRSIPLRPAPLALSLSLFASFSAPALAADPVEQQMVVIGSRAPTSISELPGTVWVIEREQLDQQTQAGVPLKEALGQLIPGLDIGSQGRTNNGQNLRGRSVLVMIDGVSLNSSRGISRQFDSIDPFNIERIEVMSGASAVYGGGATGGIINIVTKKGVGGDTRFNTELGARSGFQSHEDHDLRAAQSISGGNDLFNGRLAIAYQKNGAAYDGSGDQVLTDITQTDLQYNRSVDLMGSLGFTFANGHSLDLGLQYYDSGYDGDRGLDLGRNFDALRGRAPYSIKGGVDLDREPESKRHQFNATYHAPEVLGHDLYLQAYYRNEKMAFNPFPTIRYSNTGAINYGTSYYSASQQDTDYYGMKLALVKTWERASLTYGVDLDREKFTSDQMLFNLPLAAASGGLVASEQAKLGRYPDIDTDSRAFFLQGSWKATDDLTLSAGVRRQSMSTDVSDFVAANQQILIANGLGKTADAVPGGSKDYDVNLVNVGAIYKLNLQQQVWANYSEGFELPDPAKYYGFGRYGAADGNGHYPLLQGVSVNDSPLDGIKTKQVELGWRHTDGALDTQVAAFYSWSDKSIKYDSKTLAVLQQDTKKRNYGLEGQATYWLDDHWQVGVNGLAIRSQEKVDGRWLKQDVTSASPSKAGAFVGWKDDQRSLRLQGVRTFNLNDEPGNKIDGYALFDLLGTQALPVGTLTAGIQNLLDKDYTTVWGQRAQVYYGGLAPAGLFDYKGRGRTYSLTYSVEF

SEQ ID NO: 2558 - protein, 141 aa, Pseudomonas aeruginosa 2192
TGQSGMTYRLGLSWDWDKSWWQSSTGRLTGYWDAGYTYWEGGDEGAGKHSLSFAPVFVYEFAGDSIKPFIEAGIGVAAFSGTRVGDRDLGSSFNFEDRIGAGLKFANGQSVGVRAIHYSNAGLKQPNDGIESYSLFYKIPI

SEQ ID NO: 2559 - protein, 661 aa, Pseudomonas aeruginosa 2192
MPLKTEGYLARNSVSATRTDTPLREVPQAVVPVPRQVLEDAAATRIDTALDLAGVGRSNNFAGLGLTEFTIRGFATGEYYRNGFPINRGYPNSPDIVSIERIEVLKGPSAFLYGRGDPGGTFNIVTRQPTAERSFALGTQYGSDNAKRSTFDATGALDEGGTVLARLTGAVEDNGSFRDFVHSDRYYLAPVIAWKPSADTTMTLEGEFISAGQIFDRGIVPFRGDLRAVPRTRYIGEPGLPPFRNDNALGQLRVEHRFNSDWVLSAGTQVLAGNIAGEAVQTVGFLGDGRLLRRTLDRRELTWSDLDLQINLAGKFETGFLRHTLLVGLEHDRLRYREDITRSNFNTNPFVLDLFAPRYGQALPALTVPSSNLLQNTTSYAGYVQDQIDLTPKLHALLGVRVEDIALDTTNYINGVSTKLQGTAATPRFGLVYDLSDIASVYGSYAQSFRPNTGADRSGRPFPFQQAESYETGVKLSLLDGRLDATAAFFDIRRTNQLVTDPVDQNFSVATGAARSRGFDLTVAGFLAPGWRVIGTYAFVDAAITRDSTLPVGTRLANIPQNSFALQSVYEFQSGPLRGLGLGGGVTYVDSRVAGTALSTFTMPAYTLANLISYYWITPEVRVYLNVDNLFDERYFDRSFQNRYATPGQPRTIMGGVAARF

SEQ ID NO: 2560 - protein, 766 aa, Pseudomonas aeruginosa 2192
MSRQSTDIAVSSQRLLASAIGVAITAIATPQAAHAEQAGQKKTDKDGVLSLDAATIVGEQQDETTYNVDRSASKKYTAPLLDTPRSVTVVPKQVIKDTAAVSLQDALRTVPGITFGAGEGGNPTGDRPFIRGFDAQSDTYVDGVRDTGAQTREIFNLEQIEVSKGPNSAFGGRGSAGGSLNLVSKQAKAGNFIDGGFTYGSDQTRRYTLDLNQEFLDGNAAFRLNLLKHDANVAGRDEVDVSRWGVAPSLTFGLGSPTRVTVSHYHLESDDTPDSGIPYAKSGNRSKHNPDKPVNVDRGNFYGLTGRDFQKSRIDTSTVTIEHDLTDSLTIRNTSRYGNSHQDYLWTQPDDSQGNINNGTVWRRQNNRVSTTTTAVNQTDLFGEFYLGGFKNSFSTGLEFSREDSKRDGYTVDTNTGLGNNKCNPSLIGAPSGYNCTSLENPNPHDPWNGSITRKYAPLNTVGTTKAIYAFDTIDLNEQWQVNIGARFDSFETTAKNHGVSPTTKLSDKSSFWNWQAGLVWKPAPNGSIYASYATSATPPGSMLDNGDTSNAVDGFAISNNLEPEETTNYELGTKWAFFNERLELSAAIFRTDKDNTRILVANQTYDNAGQSRVDGVELSASGKLTEKWKVFAGYSYLDSELVDAGKAGRNGNVNASAVSSNGNEMPNTPKNSFSLWTTYDLFPKATIGGGAFYVDKVYGDVGNTVYVPDYWRYDAMASYKLSKNVDFQVNVQNVFDKKYFDKAYAAHYASQAAGRTVLFSTNFHF

SEQ ID NO: 2561 - protein, 680 aa, Pseudomonas aeruginosa 2192
MMRTLLCMLVLALIMSSAPAAFCQDVELEPVVATAEKWEENPQKTPISMTYLSEGQIEDGGVRDAREMSRFIPNAYMGATGTENVLTIRGISSFDTALFSPAGFFVDGVSMPLHYMYNMDLLDVERVETLRGPQGTLYGRNNESGLIHVITQKPSDQLRAKVYGEYGSFNSYRVGGNVSGPIVKEKFQAGLALQQRNSDGFMENLYNNDDETAKKDSFTGRIALRAQPAPAWDINLNADLMETDDGLGVYRYMTGPNATDFNKINQDADLYSEQSGNGQTLSIDFKNEYVHVTSLTGLRDYEHDFATDNDFSPMPFASADFSYQDDSFSQELRLASPDRHGPLKWLAGAYFFSEDTEVDYNRAANWHLVTNMETTGAAGFGQAVWSITDFLRLTGGIRFDSQDMDGAMHDLSKKTTFSESMDHEEWLPKISFSCDVAESAMIYASAVKGFLAGGYNYGMSRTASSFTYGPEYTWNYEAGLKATMFNGKCDFSLAGFYIDIDDKQVFDVDPAIFATEIRNAASAHSSGFEAEARVRPIHGLDIFGNIGWAESRFDDWTATEFNSTYTGLIKYDYEDKKLPNAPKYTGLLGAMYRHNSGLFLRGDVMFTGEFYADAKNTARQGAYELVNLRTGYEADHFDVVLWCENLFDQEYEKIKYAWGVNELAIDGAPRTVGVLIRLRV

SEQ ID NO: 2562 - protein, 879 aa, Pseudomonas aeruginosa 2192
MSSSDSCSHRRRDDVPALDPTDDAHAARPRRATALQRKLLACAVAFGAMTAARGALADARTEARLHFRAGMDLIAQKQFDEGIRQLQKANEILPHPNVTFNIARAHAEAGHIEQALAAYREYIASDPADREQVTRIVEQLEQRLAAQRAAAIPEPKQPAAPAPQQPAPQQPAQGEAPSPPPPAGAPAAQGAPATAATKAPAPGSKAAPGDAARIVGAARTEDVYQETVVTASRGAQSPLDSPNSTTIVTRQDIRLSGITRIPELLRRVAGMDVMQITGGDENVSMRGFNSRLANKILVLVNGRTVKNDVLGSTFWEALSIDVDQIERIEVVRGPGSALYGADAFAGIVNIITIEPGVGKSGFRAGYGDHRQGYASVWASAREGDFAYRLSAGYTRYPRWSREVADDRIDLETSGQSQDLGAQNVRIDLRTSQRLGPQRELTVGAGYSRSELDIYGIGPFNDYNLEVANADVAVAYRSENVNARTYYSNLDGYSLLNAAYLGHTLFAGRPQQHVVNAELEFVKTLRAPRAVVHDFHIGLGYRLKATSWSYLEDDMPLEHQGSVFLQDSMKLGERVTVVASGRLDYVPYLERLIPSPRGSVIVKPTERQAIRLSGSTAFRSPTSLEAYVDLPIQLALPGLELLSTSRTPGSSERPIDPEQIITAEASYLNQQSDYFEFEITAYYNRVSDLIVLAEPQRTTLSQRAHGSGGLNPETGRYTSGFGGFENQSDVYHVFGGELGGRVYPTEGLDIFANYALNRSVHQRPDGRDALEDARTSRHKVNAGVQVRTPIGVDGEVTFHYQSSQVWAEQVPTGTVIATKQYELPAYTLLNARVGYRFLDRAEISATVFNALDGLGDDALQMHPFGNRIGRRFMGFFSYSL

SEQ ID NO: 2563 - protein, 441 aa, Pseudomonas aeruginosa 2192
MKVMKWSAIALAVSAGSTQFAVADAFVSDQAEAKGFIEDSSLDLLLRNYYFNRDGKSGSRDRVDWTQGFLTTYESGFTQGTVGFGVDAFGYLGLKLDGTSDKTGTGNLPVMNDGKPRDDYSRAGGALKVRISKTMLKWGEMQPTAPVFAAGGSRLFPQTATGFQLQSSEFEGLDLEAGHFTEGKQGTTTKSRGELYATYAGQTAKSADFAGGRYAITDNLSASLYGAELKDIYRQYYLNTNYTIPLAEDQSLGFDFNIYRTTDEGKSKAGDISNTTWSLAGAYTLDAHTFTLAYQQVHGDEPFDYIGFGENNSGGGGDSIFLANSIQYSDFNGPGEKSWQARYDLNMASYGVPGLTFMVRYINGKDIDGTKVDSSSAYAGLYGEDGKHHETNFEAKYVVQSGPAKDLSFRIRQAWHRANADQGEGDQDEFRLIVDYPLSIL

SEQ ID NO: 2564 - protein, 362 aa, Pseudomonas aeruginosa 2192
MKILPRTLLIAGCGVSLVSLAHAQSSALTLWGQVDSGITYISNKRGGASWGTASGIGSPTRWGLRGNEELGGGYRAVFALESGFNVNTGALIKTNTLFDRQAYVGLDGPLGTLTLGRQSDLMDDVAIRYSNAFWNRSLYSFHAGNLDSLTNGYQIENAVKYRSPDWYGVRVGALYGFAGSDASGHSAGAYATYDRGPLSAGVTYMTTKRRVLDLYNYFGWTRFLGQTLSAQQTFQSNAVDNLGIGLTYRIVQPWTINLLYTRTDIKGARSATHMQNIDAGTLYQFTAAEAVTLDYTYSRMEGMHWNTLEAGNLYSLSKRTQVQATLTWQLASGNGATAATYPNGPSSGRSQLLAHVGITHSF

SEQ ID NO: 2565 - protein, 709 aa, Acinetobacter baumannii
MSQNRPPVAFYFYLTCLFFGLNSLGSWHAGAQESPGENRVAEDSILPTYLQEVVLTATRTERQVSSLPLPVTLVSADRIEKAGAVRLGEILSEQTGIITVADESGFEGVQIQGVASDYILILMDGVPLVGRSAGNFDLQRLAVGNIKQVEVVKGPSSSLYGSEALGGVINIITEKPNTESLEGSVDYRIGRFAQQDMNLNLKQRRGAFRYGLFANRFSSEGYDLTPETAGQTVNPFENYTLQGRFYYDFSDRFSLFTSSRFYDQVQDAGLSVGETDYEGDSHQREWNFHTRGEHAWSDALEMEYEFYYTNFQADERLADPLTDTVLSDSDFDQRLLRPEIRGTYTLNGGGKLTAGTGLQFEQLDRTYFDRAVSFGSQYVYAQYDFNPVDRLNVIAGARYDNHSEYNDQLSPKLAVRYRLSDVTALKASVGYGFKAPDFRQLYFDYTNSTVGYTVLGYNVAGRKLTELDEQGQISQIVVPISDLDAPLQAESSVGYNAGIAFRLKRWNAELNLFRNDFSNLIDTRIIARKTNGQNVFSYVNFDEIFTAGAEVNATYKLSENISLNAGYQLLYAYDKTQREAVADGSVFARDATNQTVALSRSDYFGLPNRSRHNANLKLYYDIPDWGLDFNFRLLYRSRYAQFDTNGNGLIDSYDTSFVDGYALAHAAVSKTFLKDFTLQVGANNLFGYTDPDIPTQPGRVLFTKINYQF

SEQ ID NO: 2566 - protein, 704 aa, Acinetobacter baumannii
MPHSKFLLQPLWVAMLAVSHSGLVFAESEKNDADTKALHSLAPIVVTAQQGNDANGLIVHADPKQPIQPVPATDGADYLQSIMGFNSIQSGGTNGDLTFRGMFGSRIKILTDGTENLGACPNRMDAPTSYISPESYDRISVIKGPQTVQYANTGSAATVLFERQPEKLTSEKPYRGQASVLLGSYGRIDHNIEAAVGDEKKYIRLNANRSESNSYQDGDGNTVPSAWKKWNADVALGFTPDENTWVEITGGKSDGESLYAGRSMDGSQFARESLGLRFEKKNITDVIKKIEGQVNYSYNDHIMDNFSLRTPPLVEMNHGGMTMLMPNAMAMQVTRRTLNSRLAMTSEWNKWSLITGVDSQFNKHGGSMSSPTMPSMNVPYRQDMRFQSYGAFGELGYQWNDQNKLVTGARLDRVTVEDERTDSQAKGFNTKLEKTLPSAFVRWENQHPEHDLKSYIGLGYVERMPDYWELFSPKHGNAGSTNTFNGVNPEKTLQLDLGFQQQHGALNTWASAYAGLVDDYILMSYHHHPSMGMDGHDMSHDITAGAKNVDATIAGAEAGIGYQFTDRIQADLSAMYAWGKNTTDDKPLPQISPLEGRLNIRYVADKYNLGLLWRAVAEQNRVSLHQGNIVGYDLKPSKGFSTLSLNGSYNLRKDIDVSVGIDNVLDKTYTEHLNKAGSAGFGFASEEQFNNIGRNYWVRMSMKF

SEQ ID NO: 2567 - protein, 70 aa, Acinetobacter baumannii
MLKAQKLTLAVLISAAIISSAQASEQSEAKGFVEDANGSILFRTGYIQRDKKNNVEDDSYAHLFNQQSLH

SEQ ID NO: 2568 - protein, 600 aa, Acinetobacter baumannii
MFKILWNCGLVVPALFNVLFILSSGAMAEAPPQAIAPETLNLSESKSGIEETSSNSVTQAESNQIANVEVIGAPDYLLSQTENLFSQEDITDEENPIEQVTSVSQLSDIQPTDWAFQALQSLVERYGAIAGYTDGTFKGDRALTRYEFAAGLNTALDRFNQIIANSTADLVRQEDLDTIKKLREEFSTELAALRGRLDTVDAKLETIEKQQFSTTVKLTGRAQIVIGSLFAGNNVITGRPAPRVVTQQGSVSLRLNASFTGKDSLGITLGGGNIQSLGQTRAGLLGTFDGRTADNSSITRPPNDISVSGVRYRFPFGSNTQVNIYALSDGANELGFTVPINPYFESSLATGSNGISRFSRRALVYQYGDAGGGIAVLHRLNQQFQLGVAYSAPNANNPGPNTGFFTGRYLALGQILYTSPQRNFRAALTYVNTYSPPNAQGLSGTNFGPAAGSNLVNSTVAGTGTVANLYGVQAFYQFSPKFAMNGWVSYGAHRYLGRGDGRAMDWAVGMSFPDLGKKGSLGGLFVGMAPTLISLGKNVNLGAGLGQADKDLSLHIEGFYQYKINDKIDITPGFIWVTAPDSNANNPDSVYAWIRTTYRF

SEQ ID NO: 2569 - protein, 833 aa, Acinetobacter baumannii
MAQDVTAGTDSSGMEDPAQAGDDEIVAEPDQILVVATRIKGQVDTAQPPIAVLDEEAIASYGAGSIQDLLSALSPQTSSGRGRGDGAPVVLLNGMRISGFREMRGLPPEAIRRVEILPEEVALKFGYRPDQRVVNFILKDNFSSYGSDSELRLPSGGGFSEWEQEFTLAKIAGSNRINVTAKLEDTSPLTEAERAIAQAGSTARLAGDPDPAQYRTLIGDSKSAQVNATLARALGGGAGLSVNLLAQRDDARTLNGLNTVTLTDVDGTQVLRTTDQPRPITTRRRTTTLQAGAALNKPLGDWFLAVTADGGHVETRSTIDNRADLSGLQALVDAGTITATGSLPSSAIVPGAADRALSKTDSLSSLATMSGAPLRLPGGEMALTVKAGFDYSGIESSDTRTSTGQVNLERGDAQAGFSLDLPITSRKEGFGAGAGDISLNANAEVHRLSDFGTLYNWGGGLTWAPTEKLSLQATYVVADKAPGLTDLGGPTTVTQNVSLYDFTRGETVLATVLSGGNPGLREERQRDWKFGVNWTLPFLKDSTFVAEYFRNRSTNTTNSFPLLTPAVEAAFPGRVVRDADGRIVSVDQSAVTFAEEKGSRLRYGVNLSGSFGKPDPNMRRGPMAGMRGPGGPGGGPRMGAGGPPGDGPHGAGRPGGGMRMRGGPGGRGGFNSDGRGRWNLSVFHTVRFQQSVQIAPGGEVFDLLDGEAISSGVARHSIEMEGGGFYRGFGLRLNATYTGGSRIESSGAPGASTLHFAPIATFNFRAFADLGRKEKLVEKVPFLKGSRISLSVDNLFNAQQRVTDATGSVPLRYQPGYLDPRGRVFEIEFRKQF

SEQ ID NO: 2570 - protein, 1198 aa, Acinetobacter baumannii
MQVIRTGALLAAATLFVPWSAFAEPVPRPSPAAGSVIARKSGEEVRFVDVSSWRIVDLAQDLLPGDVLRTNATGALAVLFKDHTQIRLGRNTALRVKQIGAGDTKLGLESGTIWARAERGGDGLVIDTPAAAAAIRGTDWTLSVGTDGKTSLVVLEGVVELSNAHGSVTVNQGEGAVAAIGSAPTKVVIVTPKDREQMLFHLSLRNAFVWMPATPFSVPEMRRERARIETEPAASRTAEEWLTLSEIYLSLDGRRKALAALAQATSRGLTGAQAARADLIRALIAGSSNQYREAARLFAKSERGLDPSRRTIAAYGGYFARGLANPDRVENPPRDASGRYAGMAQAWTAGFREDIPAAIAVIKRAERQYPDDPTLPAARAQLAMLLDDRDELRDGVERALSIDPEDPTALEARAHYRYHIDNDLEGALSDLNRALQTAPGSSSIWNALGLVQGARGDNRAAEAAFKQAIALDPLDPVSHANLAIQYLDEMRMAEAKREIDTALSVDPSFDVALVARGRYQMQNGDVDRAVEDLLAGSTANPAYSNAQLLLAAAHYEKGDRIPAAQALDNADRLDPNDPVVATVRTAIAIDAYDADAAILNAQEALRRTRAKGGDTAALGANQEQGSTLNDAFRLQGLDAWGQYYGDAVFDPFTGASYVDQAVRGSVSPFFNSYDFAANAITNTVNTTSFSALIQGLLIEPHMLASRERTVNLLRSPFFETEIGGGFIANEDHTGWVGEAAVRGFTVSPFPISVYGTFQWEEPRDTFESDGLRVERELRIIGGNGYVTASPTPDDRVVAFTNYSDVDDARELLPVPLQVEIGDDSSGVTSGLAWSHTFGYRSIGNAALFFKELRTGDSEIQRASGAEISADVDAKERTYIAALNHMYGEGDLTWRYGAEAGKIRSDIRTILNINVPPLPSETGTDYRSSTQAVAKAYVDGLYEITPDLKIEGALFARYIEDANDNNIRLEPKLGIAWAPAERHWLRAAIQREGYNFGSATLAPIGIVGLQPNQFLIGTDGYADTLALRWDAEWNDWLFTAVDYQHQEILNGSIDLPFSLADFDFEKARVNRVALTANLALGHGFGLSATVARTESDDLSTGRSGDLPFLPENSGQIALTYVSTASIKTTVAANYIGKRNDSSTTLDDFWTLDAALQWEPFDKRFEVELAGFNLLDEEFELRDGLPGWGPTVKGTVKVRF

SEQ ID NO: 2571 - protein, 461 aa, Acinetobacter baumannii
MNFVVNKKIFILGIASICTSTLHAAAFDKTGQSVAAFLQLGNYFEASLGITDADLSGVESGTNPSHHSISDIANTDYRPTAALKLQLALQYSFGLLYDQPFGADTEYSGVNGFVATPKDTVMLPGITTTGLASATLGHAPTGNAKSEFDIQNLSFILGYQPTKNWNLYAGPVYQTFKSQVELRGNVFSLYNGYDFHTKTVSDLGWLAGLAYQIPEKAVKVSLTYRSAITHKVNATENAPLIDMLSTQQGRDLVNQHLDYMISIGQMTPQKKAYLNQIIANLPEQEDTGTTKFKSPDSVNLEFQTGLRQGTLLFGSLRWVNWSDLALQPYRFGEISKVVGVLSTPSRPEGFNLVRYYDDQWSLNLGLGQRFSPKWLGSVSVGWDSGAGDKVSTGGPTKGYYNLGVGAQYSPTSQYFISGGVKYYWLGDAKAQLGAQAGSDYYVGEFKDNHSVSYGLKIGYKF

SEQ ID NO: 2572 - protein, 626 aa, Acinetobacter baumannii
MMSLSSVSPRRAVLAVGLSLCIATVAQAEAAIDLDQVVVTASRTAQTQDQTLAPVTVIDRAQIERRQVNSLQDLLRGEAGVSLANNGGPGKATSLFLRGTEADHVVVLIDGVRIGSATAGGAALQDLPIEQIERIEIVRGPFSSLYGSEALGGVVQIFTRRPQGGLVPTLSVAAGSDNARRYGAGIAGRSPGDLSDAGGWYSVNAVHDETDGINAYLDTGSSAYDPDRDGYRNDSLSAQGGWRFNRQWDADVHVLRAQSRNEYDGSAFGGNLSKGVQQAIGGRVRYAPSDALKLTASVGSSADLSDAYYQGAYLSTYDTRRKQGALQADLDTGPGLLTVGFDWQRDAIASSDTYDADSRIDRAAFAQWQQTFGSQSLQASLRRNDNSQFGGKTTGSLLWGWDVAEHLRLTASYGTAFKAPTFNELYYPEYGNPLLGPETSKSAELGLRGRYDWGTWTLSAFQTRIDDLIAYDASLVDATHPFGQPNNIDRARIRGVEAGYDTELAGWTVRSALTWLAPQADGEVNHGNWLPRRARQSGRIDADRNIGAFGIGASLFGSGARYDDLANTDRLAGYGLLDLRVSYAVNADWKVQLAANNVFDRHYETARWYAQPGRNYLLTLRYQPAH

SEQ ID NO: 2573 - protein, 447 aa, Acinetobacter baumannii
MTNSPTLSLAALLALAGVGPAAWAAEEQQEGFIEGSRLSVLNRNYYFNRDHRDGPAPTYNRGKESDNGYSEAWAHAIITRFESGFTQGTVGVGVDAFAMLGLKLDTGGGRNGGRSSFDVLPVDSDGQARDEYSKVGGAAKVRLFDTVLRVGDVFPVNPVVAAGDSRLLPESFRGVTLENTSLQGLTLQAGRLHAMSQPVSSDLRDNFVTFYGGPVDSPWIAYGGGDYAINENVSVSLFGSRLKDVWNQYYAGTSVTWPLSDDLALIGGFNFYNARDEGRQRLGQFDNDIWSAKLGVRYGAHTLALTHQRNNGDNDFDYLRQSDSIFLDNSIQYSDFNSPKERSWMLRYDLNMAAYGVPGLSFMTRYGRGSDADYSHANAYYMRRDDNGDPLTDQKRWERDIEVKYVVQTGAAKDLSLRVRQATTRATAFESDLDEVRVIVEYPLSIL

SEQ ID NO: 2574 - protein, 705 aa, Acinetobacter baumannii
MDLKLRLLSLSIAQLCCIPAAFADTNNSSTTLATIKIKAQQASDQTYKVDSSSSATRSEIALQNTPQSVSVVTQKVIEDIGATRLVEALDLAGGVTRANNFGGQGLTGFNVRGFTSGEFYRNGFPINRGYPNAPDSNTIERVDVLRGPSSSLYGRGDPGGTFNLISKTPKSEQQTTLGAQLSSEGLYRTTVDTTGTVPDAENIGYRLNVIAEGGDSYRDHVESKRYGIAPVIQWQATDATKVTFEADILRNQHPLDRGHTRYPTQKSFNSSPETYLWETGKYYNRLYNDNNMAQLRVEHDLANDWKLNAGVQYLNGKLHGYAVEANGIQNDGETLGRNYNYRELKWQDTDAQINLTGNFQLLGLAHTLVTGLEYENYDYKSYIIRSSGDIGSYPINIYNPVLGQPLPELNRVTTHDRENLKTTALFVQDQIDLNERLSALLGLRFEHYEHDYKNLLPNTTNWNTSHDAFIPRLGLVYKASDDLSLYGNAAKSFKPNTGASRNGEGFDPEEGTTYELGFKWQALDNMLSIDSAIFYANKENVLTLDPVDSAYKVAAGEVRSRGIELNIAGQITPAWKIIGGYAFTDAEVTKDNTLQKGTALANIPKNSFNLLNIYEFQVGPLQGLGLGINQKYIDKRAGQTANSTYTMKGYAVTDLVSYYQATPKLRLNLDVKNIFDKVYDESAFNLYLCTRQISQNPYPIRVLPS

SEQ ID NO: 2575 - protein, 416 aa, Acinetobacter baumannii
MSKLWMYSTLMLSGSVWAGSFIDNSSVELTTRNFYFDRDYQEQSAYPAAKDWTQGFILKANSGYTEGTIGFGLDVLATAGFKLDADAEHGGTGNLPRDTRTNEPADSYGEIGVTAKAKMSQTELRIGTLMPMNPVLVASPARLLPQTYRGISLTSKDIKDFDLQAAYLDKVNHRDSTNYEKIKISGVNGRFKGAETDGLYYLGGNYQFNPALKLTAFYMDVDDLYNQTMVGALHQYKINDTTNFSSQLRYYRSRDDGQAKAGLVDNDLYHAHFELKHQNHKFIFGTFQHHGDTAFPYLTGGETGLLIDTWPGEFLNPKEKAYSFRYEYDFKEYVPGLCFMTRYTTGHNIYAPNLGGTNLKERETDFDLGYTVQSGWLKNLGLRARYAIYDNNMLSTANIKPVNETRINIDYTWKFK

SEQ ID NO: 2576 - protein, 1133 aa, Acinetobacter baumannii
MKKTNQRLFYPQKVKRQLFCALVACAVCAIPVNAQSGTISLNKSNVSMHTIMQEVEGQSDYTFFYNDNQIKLDKKVSVKAQNATIEQVLAQMFKNSGYTYKIVNNQIIVSKANAVAAVEKQQQQQAKKVTGCVKDALGEPIIGASVVEKGAPTNGTITDFDGNFTLTVSGNELQISYIGYLPQVVKVQSGVTSYNVTLKEDTKTLDEVVVIGYGTQKKVNLTGAVASVSTDDIKDRVQTNVLSAIQGTVPGVTIISRPGSTPSINFRGRGNLGTSAPLYVIDGAIADATVFSNLDPNTIESISFLKDAASSAIYGSRAAYGVVLVTTKGGKAEKMNVAYSGYVGVKTPTYLPDVLDSWDYATLLNEAKYNANPSGGKNQAYTNEEIGWFRDGSNPDYYPNTNWADLVLDKHVLTTQHSLNFSGGSEKVRFFSSVGYVFNDNFMPGVTDDRYNLNLNLQSDVTKWLTLKTGVKYIRNSSDTKNGTPWIANFVLVPSIMVAQQSNGEWGSIAGGKDATQTFMNSNPLRTLSFDNWSKSTTENTMYDLGFDLKPIENLVISGQLDYKRYEYKSKSYSAEYPEVVHFETGKEIPGTGNSSPNSMSMYWISNSNMMTTLTAKYDLKLGQHAVNFLVGTSYEHYKSERLYSKRTDFVSDGLEDIEQGNNISKDLPDGRGIVESKMLSYFGRINYSYKDRYLFEANLRADASSRFHKDNRWGWFPSFSAGWRISEESFMKPIAWLNNLKLRASYGTLGNINNVGYYDYFELLSSNANYNFNDEPVKGVLEAQITNKTLGWETVALADFGLDVDLFDNKLSVTADYYIKNTKDILLGYNVPAETGIWTKPVMNLAKVRNTGFELAATYRNKIGDLSYSVSGNIATNNNEIVTLAGSDNMIQNGGDVVRYILKEGEAIGSYYGLETDGLYTQEEIDAGHYYKYGRKPNAGDIKYVPQRENVEWGDDITDDDRTIIGKDVPDFTYGININLQWKNFELSAFGQGVSGTSVAFESEQVFAFMLNSNPRKYHLSRWNEDNPNPNAACPRLYGGNYYDEYNKHFSDYQLFDADYFRIKTISLGYMVPKDAVTRWGLSSLKFFLTGENLFTFRADKDMKDFDPESSTGRGISAFGAKSVAFGVNVSF

SEQ ID NO: 2577 - protein, 141 aa, Acinetobacter baumannii
MELLHRFKPCALTFATLVLMCGNSFAANPNQQPEDEWKFTLKNAYINRNFDNDALKDTGSWSQAASLFYKSKMHDTPLQIADKPITIGADASVQYAVRLSSDKHVADTVLPFNKETQSQASDFLKYGATLKLGYDKTLLSV

SEQ ID NO: 2578 - protein, 1026 aa, Acinetobacter baumannii
MKTEEVSIKPRLKVTMKIDSEMLQEVVVTGMQRMDKRLFTGATSKLSADDVKLDGLPEISRALEGRAAGVSVQNVSGTFGTAPKIRVRGATSIYGSSKPLWVVDGVIMEDVTEVSADDLSSGDAVTLISSAISGLNADDIESFQILKDGSATSIYGARAMAGVIVVTTKKGKAGSNKISYTGEFTMRMKPSYTNFNIMNSQEQMGVFKEMANAGYLNFSNVYRASDSGVYGKMYHLINDYTPNGGFGLPNTTKAINTYLQQAEYRNTDWFDYLFNSSVSQNHAISMSSGTEKASYYTSLSVMNDPGWTKQSSVQRYTANVNALYNIYSNLSLNLIGNASYRKQKAPGTLGSTPNYVTGEVSRDFDINPYSYALNTSRTLDANETYVRNYAPFNILHELENNYMDLNVVDMKFQGELKWKILKNLEASALGAYKYSTTTQSHYVKDYSNQAWAFRAMDDATMRDANPWLYTDPDKVNSLPVSVLPVGGFYRETKYGMNSWDFRGTLNYNDVFAEDHIINLFGGMEVNSMNRTKTWFNGVGMQYEMGMLPSYDYQYFKQGNEENTNYYTVEESRSREVAFFATGTYSYKGRYTVNGTIRYEGSNKLGKSRSSRWLPTWNVSGAWNVHEEAFFEDLRPTLSNLTLKASYSLTADRGPANVTNSRVVISSFNPWRPFTSVKESGLQIDDLENSELTYEKKHELNIGAEIGFLDNRINLAADWYKRDNYDLIGAINTMGIGGQVMKYANVASMKSHGIEFTLSTRNIVTKDFKWNTDFIFSQAKNEVTDLETNTRILDMVIGSGFTMKGYPVRSLFSIDFQGLNEEGLPTFINESGTLTVTDLNFQSRVKDYLVYEGPTDPTITGSFGNTFSYKGFKLNVFMTYSFDNVIRLDPVFKNWYSDLAAMPKEFKNRWTQSGDENTTNIPVIADRRLNQEYNHLSYAYNAYNRSTARVAKGDFIRMKEISLSYDFPKSWIAPLKFNNLSLKLQATNLFLIYADKTLNGQDPEFFNTGGVAVPVPRQFTLTLRLGI

SEQ ID NO: 2579 - protein, 345 aa, Acinetobacter baumannii
MMAYSVQKSRLAKVAGVSLVLLLAACSSDSRYKRQVSGDEAYLEAAPLAELHAPAGMILPVTSGDYAIPVTNGSGAVGKALDIRPPAQPLALVSGARTQFTGDTASLLVENGRGNTLWPQVVSVLQAKNYTITQRDDAGQTLTTDWVQWNRLDEDEQYRGRYQISVKPQGYQQAVTVKLLNLEQAGKPVADAASMQRYSTEMMNVISAGLDKSATDAANAAQNRASTTMDVQSAADDTGLPMLVVRGPFNVVWQRLPAALEKVGMKVTDSTRSQGNMAVTYKPLSDSDWQELGASDPGLASGDYKLQVGDLDNRSSLQFIDPKGHTLTQSQNDALVAVFQAAFSK

SEQ ID NO: 2580 - protein, 1101 aa, Acinetobacter baumannii
MEKLYLKRSWRIGTCLMVLLTFFALSLSAQNRKVTGVVVDEFGDPLPGANITVVGNQNLATATNMEGQFTLNNVPKDAILNVRFIGYAVKTIRLATLKNNDLLRIVLSEDVKELNDVVVTALGISRESKSLGYARQSIDTESLLDTRDPNLLNSLSGKVSGVNFISNGGPLSSTRVEIRGNNSLTGNNQPLYVIDGVPIMNPMGEDGDLDYGNPASAISPDDIESIEVLKGANAAALYGSDAANGVILITTRKATKKSGLGVSYGYNMQFTFLREFPAYQNVYGSASLPAVGVGDGFNYYGSNSKNGYAYDPSLPYGIFVFNWANPNQRSWGLPMLGFDLVGRNNQIRSYVPNKDGITDMYEMGVAMTHSVSVNKVFNGAGIRFNYTGIDYDGMLKNFDNMKRHTFDLRVNMDLAKWLSSEISVNYQLETADNRDYKGDSNRNPMRAIMNMPRDVVMEELLPWKRETGEAFTRGNGFYNPYWLLNEISNGDGRNNFRGNLTLNIKPIQGMNIRLRASVEKANKNGWKFDNYYTMWDIDGQYETFREASNNYNYEGVISYNRNIKKVSLSANLGTSMQKNDWYKLWNQVSQLAAPDVKSLSNNASILSGTESVNAKEKQSVFGMLSLGYHGLFVDGTFRNDWSSSLPKANNSYFYASGSASAVLTEIFPKLKSKTFSFAKLRGSIARVGNDAGFDRLINSYSYGGLFRNDMAWFQGDAVRKNPNLKPETTISKEIGAEVRLLDGRLTADVTYYDKYTRDQIVESELSYLSNYQRVIINSGKISNKGWEISVSGVPVKVKNFEWKTIFNWSKNNSMVESLPEGIDKIQIGSGVYNVKSYAEVGKPYGAIYAKTFKRDAEGYILCQLDGSPKEGQDYEYLGCVQADWRGGWNNVFRLGNFSFSVMFDFQKGGKFFSQTSIQSSVDGQSVKSLEGRDADFFSRKILGESDEERYGFMRPQNANTPTANGQIYPDWGRPKGVVLPNCRYDEDVEGLAGQQVLGYCTPERYWMHYTSRDISRFIYDASYVKLREITVSYDLPKKWLRKTPFQTFRVAAVGRNIATLFANTPHGLDPQATSTTGNAQGFERGFNLPSATYGFDIKVSF

SEQ ID NO: 2581 - protein, 617 aa, Acinetobacter baumannii
MRIIYFTLLILLCIKVRAQDARDTAININEVVINENRFSTPISKQNRNVYIIDKETIAKLPARSIQEILQYANGVDLRQRGPFGSQVDISVDGGSFEQTVVLLNGTKIIDPQTAHNMLNLPIPVEAIERIEIIRGPAARIYGINSLTGAINIITKKQDHSGFLVNAYGGSNFEKDSEGTGDTFYGRGIQLGTVLSSKKQQHSLFGSHDKSNGYRYNTQFENNKIFYQGNYQIDNSNEIMTSFGYINNHFGANGFYAAPGDRNSSEGIQTTIAAVQSRHILSERWTLLPRLSYRYNDDDYRYTPTTGRSRHFSNSLAAEFNTSYKMNSGELGFGTEVRSEDINSSNIGEHDRRNLGIYGQYRTYLLENLNINIGAYANYNSDYKWQVYPGLDASYAITSGLKLVGNIGTSQRTPSFTDLYLNQRPGNIGNASLTPENAFQAELGFKYVYRNFSLDSYYFYRKISNYIDWTRASTSEPWQSNNMGSMVTGGFNIRSNYSMALSTQAKLNINLAYSYLDSEFRDGQPNLQSKYLISSLKHQVTNTVDLQYKKFSVLFATRFSDRIAGSSYWVNDFRLSQSLQKFTVYVDAQNIFDTTYSEIGTIPLPSRWFSLGIKFVNL

SEQ ID NO: 2582 - protein, 368 aa, Acinetobacter baumannii
MKKLLLAAAVATLSVNAVQAAPTLYGKLNVSINQVDNKNFDGKSDVTEVNSNSSRIGVKGEEKLTDKLSAVYLAEWAISTDGSGSDTDLSARNRFIGLKTEGVGTLKVGKYDSYFKTSAGSNQDIFNDDTRLDITNIMYGENRLDNVVGFELDPKLLAGLTFNIMAQTGESTSDSKKGETGKDSKNDSFDSVSTSLGYENKDLGLAIAAAGDFGIKGKYAAYGLKDVYTDAYRVTGSYDIAKSGFVVGALWQHAEPTDDLTAYGQTYKSDGSIDKAGKAYRGLEEEAYAVTAAYKIPNTKLKVKAEYASAETQVSGQADRKIDLYGLGLDYQINKQARFYGIVAQQKRDWLNDDDKQTVVGTGIEYNF

SEQ ID NO: 2583 - protein, 733 aa, Acinetobacter baumannii
MERRGNHRRIVAALLATATVAALPSPAAAAPTAEDRTGADNGEIGTIVVTARRREENLQNVPDTITAFSPAVIEERRLDTIGDFLQLTPNVNITADQDAATNNISIRGLGSNRNQAAAVAFSVDGVILPDADAFTMDLSDVERLEVLKGPQGALYGKGAIAGAINITTPRPTDTIEGKAEIGYESGDIFRAFGAIGGPIAGDKILARLSVLYRNGDGTIDNDLTGKPANPQDQFRIRGRVILQPSEGLEVDLRASWYDEKAGSVYFSGFDVLGTTGGAITEDIAGRNPNYDGPSSTRRKVTDLSMLVNLDTAIGTLTAITAYDDIKVDFHEDIEVSPLPLVPDTNQLRRTKGFSQELRLTSAGDQPLRYILGGYYQRTTRAIRNVVTLDLCLFAGTCFAPGGGFTSGGVLTTPLADYASRFNQYSLFGQLNYDLTDRIELTAALRYDTIDGRQDDRAAGVVDTATFSRLQPKLSLSYRPTEALTLYGTYSQGFKSGAFNPVSAGPGFPRVVAPEVSKNYELGLRTSLFDRRVRANVAAFYTQHLNPQIFQLDPATFGQGSLNAKEARIKGFEFDVVARPTRFWDVNVAFGYVDAKIHDFDGVTNAYVGQQLPNAPKYTLNLGTGYRLPLKDDLSLRVRADYKLTGRESFQDFQLPTNPDLYLYQKAFGLLDGQVGLEADRWAVTVFGRNLLKRRYATSAFSRYIFSVALVPLGTDAVQPDPGRTFGVEARVRF

SEQ ID NO: 2584 - protein, 1012 aa, Acinetobacter baumannii
MKKKTLLPLEKASWLKSLFLLVCLVLSGTTVFAQEKTVTGVVTDSFNEPLIGASIVVQGTTNGVITDLDGKYSIKVTPGATLQFSYVGMEKQSIKVGNQSIINVQLKDDSQMLAETVVIGYGSAKKRDLTGSITNIKGDEIANKPVANPLSALQGKVAGVQVINSGRAGEDPEIRVRGTNSINGYKPLYVVDGLFNDNINFLNPQDIESMEILKDPSSLAIFGVRGANGVIIITTKKAKVGQTRVNINGSFGFKSVPNQIEMVDAAGFKELYNEQLRNEGNPEFDFTGWNGNTNWQDEIFQTGFITNNNVSITGASEKHSFYLGAGYAYEQGNIKNEKYSKITLSVSNEYKLTDNFRVGFQFNGARILPADTKTVTTAVRATPVATVFNDQYGLYTTLPEFQKAQMNNPMVDVDLKANTTRAENYRGSGNVYAEWDFLKHFQFKAMFSMDYASNNSRKFTPIIQVYDASAEGNIVTLGDGKTGVSQAKQTEMKTQSDYLLTYTNTWGDHSLTATAGFTTYYNKLENLGAARAQGVGLVIPDNPDKWYVSIGDAGTSTNESTQWERATVSMLGRILYNYKGRYLFNGSFRRDGSSAFSYTGNQWQNFYSVGAGWLISEEEFMKDITWLDMLKLKGSWGTLGNQNLDKAYPAEPLLSNAYSAVFGTPSAIYPGYQLSYLPNATLRWEKVEAWEVGAEANFFRNRLHLEGVYYKKTTKDLLAEVPGISGTVPGIGNLGSIENKGIELAINWRDQIGDWNYSIGGNLTTIKNKVLSLVQEGYSIISGDKSQSYTMAGFPIGYFYGYKVEGVYQNQAEIDNSPKNTLATVTPGDLKFVDVDGNGEITPADRTMIGDPTPDVTYGINFSVGYKNWELGVDMMGQAGNEIYRTWDNYNWSQFNFMKQRLNRWHGEGTSNSQPLLNMKHTINNLNSEYYIEDGSFFRIRNVQLAYNFDKTLLSRIGVQALKLYANIQNLKTWKHNTGYTPELGGTAIAFGVDNGSYPMPVVYTFGFNLTF

SEQ ID NO: 2585 - protein, 987 aa, Acinetobacter baumannii
MCSLNLYAQVSVTGTVNDNTGESLPGVSILAKDGDRTFGTTTDINGRYEIKVNQGATLEFSFIGFTKQKVKVGTNNVINITLEPENEMLDEVVVIGYGSVKKKDLLGSISTVKEDALAERVSGNVVEAMRGLTSGVKITSSGQPGSSATINIRGLGSLTNNNPLFIIDGAYGGSDLGVNVEDIESIQVLKDASSAAIYGSRAANGVVIITTKQGKEGDLKVKFDSQLTLSWLPRYDLMDAETYKIYNDRAYDEAILAGVSGVTKRQNHYDGNTDWQDEMLGTGVLQNYNVSLSGGSKTVKYYASLNRMVDDGALYRTGYDKYGFRINTSGQKGIFSYGENFYYTKSDRKILNGNPWSDFIGMPPTIPVYDESHVGGYGYGDVDRANSYGLNSVAMQDLYIRNNEEEYLTGNIYGQISLFGMFDAKLNVAYKSYMGVTNSLRKKGNWVMGQGDDAAHLGYDSAKNHDILIEQTYNFKHKFGKHDVNALFGITYNKFHEEKRWITKLDPLTIGDKYITSLDAATGNTTAGGSYGESALISYLGRINYSYADKYLAQVTARRDGTSRLPKNDRWGNFLSVSLGWRISGEKFFNVPWIDDLKIRANYGTLGNSSIGYWDYQSTINTAPRAVFGSPENILIGMTQSQLTNNDLVWEKKTTANVGFDLVAFNNRFRLSAEYFYSKSKDLLVYLPILMSSGNEGGAPAVNAGSLENKGFEMEIGWNDQIRDFAYSASLNISHIKNKVLDLGYGQTVYNTTLAKTVIGEPLGMWYLYKMNGIFQSEEEVRNYVNSEGKIIQPNALPGDIKYDDYNGDGNISSEDRQIVGSPWPKLELGISLGASYKGFDLNINGYGRFGQKVWNGSASAAGDFANNQNNFNGIIPWTQEHPVNDRPRIVYGDSRNSRSDQDRWLENGSFFRLSDITLGYTVPTRYIKKIGLERLRASVTLQNLVTFTGYSGLDPEFADSGIFTMGADYCSFPNPRAVQFALSFTF

SEQ ID NO: 2586 - protein, 691 aa, Acinetobacter baumannii
MNYHPTRHRPFLRIGLGILLLVKPLLGDTDEISDLSLEELGDFPVVQSAKGKKRLFDAPAGAFVFDEKAIENLPVDSIPEMLRYAPGVHIMRSSNGNWGLGIRGMNSRFLSRALLTVDDQSLYGTLFAGLFGSDHDLLIDDVASVEVVYGPGGSLWGPNSANGRVNVIKKSAFETEGSVLRARVGTQNRSVEGRHGWSINEKTAARVYARYNDRQSNENPVFDDDWETKRAGFQYDTRPSSSDLVSISAEIFESELGSARTILLPETGAISTLDQNELHDGLNAQAKWTRQFDSENGFNIRAWIGSTNFESSWSNYEIGIVGIEGRARFRLSDRQKIVFTTGITVDEEELIDSEFITFQADYNHNNTTAHAGGEYTHTLIPDRLDLSIGMSGNYDTYSGEIAPLPSARMLFKPNESERFWLSYSRSTRSVPSGLNDVEYMYNGYTPIPPTPIPTPFGTFIVENQLVVTTRTPQIENENLDTFEAGYRKQFSNKGSFVLSGFYNKYDNLLGAQDFGVTPVLTVPNPYLLTPIVVSNIAKGESYGLEASLKWDLNESQNFTLNYSAISDSFSNKLPPGTPPEYYPVIASEVDTLSNNVPNQMASLWYSTRFSRNWSADLGLRYTEGFNSIRTNQADIFQSDVRLSWSSSERLKISLVGRNLLNPTTDETSLKDSFGQSTELKREAYIELSYKL

SEQ ID NO: 2587 - protein, 483 aa, Acinetobacter baumannii
MPNRVRRPLVRLTTAPLWAALACAAGLPAHAAELTIEQLAQRLKAIEQRLGTAAPAAAGAEGGEGLADLDQRLRIIERKLELQAEESAAKAASTPVVALSASKGLSIKSPPPGDVEVKLKALVQADGRFFIGDSQVPQNDTFLWRRIQPSIEGSWGSLVGFRIMPEFAGDTATINDAYLDLKFDPRATLRIGKFKSPVGLERLQSSGSTGLIELGLASELTPNRDLGLQLQGEFAGSTVSYAVGVFNGAVDGRDSPTTNPDNEFEYAGRIFLEPWKNAGGALQGLGFGLGASAGDRAGSGNNFLPRYRTPGQSQFFNYRSTVLADGATKRWSPQLYFYRNAFGLLGEYVSSSQEVRVGAVREELDHRAWQLTAGLVLTGEDAGYRGVSRPNHPFTVGSAGWGAFELVARYGRLEIDDAAFPRFADPNAVAAAARSWGLGLNWYLTSNLKLVANYTQTQFDGGAAAGRDREDEKAFFTRAQLAF

SEQ ID NO: 2588 - protein, 698 aa, Acinetobacter baumannii
MKRSVLFISSVGVMTSHVYALEADQQAVTNLPTISVKADKEISLKQEVGQASSATKGLMQLKDVPQIVNVVPKQVLREQTVTSMQGALQNVAGLSFSVGDGQRDQVMIRGFSAITDNYVDGIRDDALYFRDMSNVERIEVLKGPASVLYGRGSAGGLVNKINKKPMDQSLREVSLIGSTTGQRRAEVDVNEKVAENVKVRLTGAVEDSDGYRDQAFLKRQAVAPSVQWDITDKTKLLLQADYLHDNRLADQGFPTDPITGKPVKTNPKTFYGALNGKEVGDVDTEISSQTISLDHEFNDNFKYHGAVRHYNYSLDRQYSVDSHPAADKSKITLTQNKRLRNEDGVYVQQELSALFNTGFLKHNTLIGAEYSKQHKDEILWQGAKTTTDLYNPKLEYWAPINTGTTTARNNNSNTFENYGVYLQDLMTVTDQLKVLVGLRYDNLSQDRDDKTSTNLDLNRTDNTYSPRIGVVYQPVNNISLYTSYNRSFQPLADSFVFYKNSDDLRPTKTENYEIGAKWDVNDQLNVTLALFEMSQTNIQNQDPANPNQALLAGEQKTKGVELSLTGQLTDQLSVLAGYSYMDGKIEKSAIGFTGNHSALTPNNTANLWLKYQINDHWYAAVGGRGESSRFSAPDNKNVLPGYAVVNAALGYQSERYDVNLNLNNLFDRDYFVSGHSGANDSNMMGDPLNAQVALRYRF

SEQ ID NO: 2589 - protein, 567 aa, Acinetobacter baumannii
MKIKLRITIILISVLCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGDGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 2590 - protein, 243 aa, Acinetobacter baumannii
MQFNAMYSIGEKPDNPATGDQHNYLEMEFGGRSGVFDLYGYVDVFNLANESSSNGDKNPGSGTSKIFMKFAPRVSIDALTGKDLSFGPIQEVYFSTLFNWDGLNGDGVNSSFWGVGADVNVPWLGKTGMNLYGFYDLNAKEWNGYQFSANWFKPFYFFDNKSFLSFQGYIDYQFGADATNDIYVPKTSNGGNIFFGLYWHSDRYALGYGLKGFKDVYLLEDKGGIVGLESTGWSHYLTATYKF

SEQ ID NO: 2591 - protein, 312 aa, Acinetobacter baumannii
MSTILLPKTQHLVVFQEVIRSGSIGSAAKELGLTQPAVSKIINDIEDYFGVELVVRKNTGVTLTPAGQLLLSRSESITREMKNMVNEISGMSSEAVVEVSFGFPSLIGFTFMSGMINKFKEVFPKAQVSMYEAQLSSFLPAIRDGRLDFAIGTLSAEMKLQDLHVEPLFESEFVLVASKSRTCTGTTTLESLKNEQWVLPQTNMGYYSELLTTLQRNGISIENIVKTDSVVTIYNLVLNADFLTVIPCDMTSPFGSNQFITIPVEETLPVAQYAAVWSKNYRIKKAASVLVELAKEYSSYNGCRRRQLIEVG

SEQ ID NO: 2592 - protein, 628 aa, Acinetobacter baumannii
MTKKTVAFLAACMVCQSALYAGEPSERFYTTDEVVVTSSHFSEKEKESARFITVADSEKLKKTGATNAIEALSRIGGLGYKSLAPLGVNKLGMNSSVYIRGMADGELILVNGMPVQQAASKGYDLSAISIDQIERIEVLKGAASTLYGADAMSGVINIVTKKPSGETSATASVEFGNESWMNHGVSVNLPGATVGFRYQHMDELDNVGRQFTNKYTNALDETDRYMFNLNLSPFADTYIDYQYSGYETGFIDRYDSGLVERTDQQSDFHFLNVRYESDVFKAKLYGVYDNRVQTEYVDGVFESEVERLNYNYGAETDYRFLFSRGLELSVGADYVHRYAEYSNIYGEKSRDDYGVFAELKKRFGDDLILTFGGREQFIDNEAETTDYNVFLPSVGLMWKASDDLNLFANAGKAFQAPTFTQLYYDSKTIKGNPDLKPESGWSYETGFKWNCDCASARVSGFWMTYDDKIQIDRKKKPYRYFNAGAYETKGIEWELGLRPFYGEAGILGRVSLSAAGYWADPVSEDIYGEKYQPGPKFQNTFGITYASIPFGLDLRCRILAGRQDNLDNYTAFDLSGRVKAGPGNVTVAVENLFDTEIQTSGNLVETASSRYVYYDPGRLLRVGYAVAL

SEQ ID NO: 2593 - protein, 867 aa, Acinetobacter baumannii
MDCVTSHNPVATFRCEVKMKPGKILFLLLLTGSVWSLISHPGKTQEAPSPTQLNTQSPAPNAQELTQVTGVRVVPTVQGLEVILDSTAAEKLQVSTQNQGNSLIADITNAQLNLSEGNTFSQNNPATGVTNVTVVNHNDNTIRVTVTGEKSLPKFELFDSDTGLILAFTATEVAQDSPAEVDEPIELVVTATRTETPIQNVPRSITVIDREQIAAQASTSRNLIEILGKTVPGLAPPAQGASNFGLTLRGRNPQVLIDGVPQSTTRNASRDLRTIDAAAIERIEVVRGPSAIYGDGATGGVINIITRRPTEEKLTSRTEVGVSAALGNLEGDSFSTNLQHFISAKQGNFDFTFNFAVAKNGGFFDAQGDRIPSDPNAQGGFADASSINLFGKFGIDIDANQRLQLTFNRFDEKQDTDIASDPRVNTIPGRQKARALEGLSLDERPGNENTFINLQYTHDDLFNSKLQAQLYYRDYLTRFFPFDGRSFASLGNEIFQSRVESEKYGGRLQIETPLFNQGAAKLLWGVDYSQEDTSQPVSVFDQAAFVASGGLAFRKTGDRSWTPPLELRSLGLFAQLNWEISDRFVFNGGVRYENADVSVNDFRTLANPNVTIGGGDLNFNATLFNVGAVYALNPQLSVFANYAQGFSLSDIGLALRNAPPGFSVESLNPEPQKVDNYEIGIRGQWDTVQASLSAFYNESDLGTTFTAPGTVIRAPERIYGLEAAIDAQPSSTWQVGGTFTLIGGEIDSNNDGDYESLDGFRIPPLKLTAYVENETLPGWRNRLQALYSGNREVFGNNNTAFGRRPVESYLTVDYISSIKLGAGTLQLGLENLFNSQYFPVVSQLQANDSAYAAARGRTLSIKYSFDW

SEQ ID NO: 2594 - protein, 721 aa, Acinetobacter baumannii
MVTDGSDAIPDTAMIVPRATARSVLALLLAAPAGAEEIPLDAIEVAGRRPGESGLSLTAPARTGSRLDLTPLQVPASLDVVAGETIRARGQTSVADAVTQNATGITSLAAPGNGNLSFASRGFAGAGSVQQLHDGTRLYVGAGTVTFPFDPWSAERIEVLRGPASVLYGEGAIGGVINVVPKRPVLAPLGEARAALGPDGTARLALDSGGPLGEAAAYRLALSGNRSDGFVRPDGDLRNLALSASLTRRVAPDLSVTLSQDLGASEPSRSWGSPLIGGRVPARIRFVNYNVQDSRIAWLDSWTQVKAEWTPRPDFAVRSTAYRLSAERHWRDVEQYRYDPATGRVVRSDYIEILHHQEQVGARLDATLRGSLFGLPHAVAVGFEVNRVAFDRDSNTPFGGESTVDLLRPVPGAFLNLAGTRRDIVSRLNQAAVFAESRLEVSPQLALVTGLRFDSPTVAVARPLAAAAFTRTFDSLGTRIGVVYDPVPGLALYAHYATAADPLGSLLTTSVAQSQFTLATGEQVEAGAKGLFTEGLFAEGRGEWTLAAYAITKDNLLVPDPDRPTLSRQVGRQSSRGMEVALSFALDERWRIDANLALLQARYDRFAQAAGGRVTSFAGNVPVDVPERVANLWIAHAFAPGWTARLGLNAVGPVFGDFANAVRRPGYALLHAGLDWQVTPDSRLSLRATNLTDRIYAVSGNANSWLLGPPRAVELAYRVTF

SEQ ID NO: 2595 - protein, 419 aa, Acinetobacter baumannii
MTVGLQGKLRVFTSRLIASSALMTVSFGSVGIGWAQDNSAEEATQLAPIVITGKSDRVVGPDRTIVAKDTATGTKTDTPVFDVPASVSVVTQKELEERHVDNLQQAVAYTAGVFSDEFGNDDRYDYIRIRGFDQTALGTYRDGLAARISAWFTASRLEPYGLQRVEVMKGSTSTLFGLNGPGGLVNAITKRPLDEKHGEVYTSYGDGTKEVGADFGGPIDADGVWTYRLTGLAKDGDQGLDYSNDDRTYIAPALTIKPEEGTSLTILTDYYKRDGTGARGVPTGANIDIDAFLGEPDFNRFNTEQTDIGYQFEHEINDNLTFRSNARYTQLDYAEVYGASLDPTANRTAFSVDGMSNRYAFDNQLQYDTGWDGIDSKTLVGVDYTSDNTRENILFGTAGPIDIDNPVYCGLSCINLGPS

SEQ ID NO: 2596 - protein, 760 aa, Acinetobacter baumannii
MNQNIKGLSMNNVSYNRNFKTGNDQRINHRSFVLNGVASAQIALRLGYALGTVFVLCASNTYAAVIDNSAKTLEQQTAQTNVAALPAITVKAEQDDTYAGGQVSSKSSVGFLGNKTVMETPFNTIAYTDTYIADKQAKDITSVIAKTDPSVFTNAASGGWSENYYIRGFESSPSDMSMNGLFGITPYYRTSPEMFEKINVLKGPSALLNGMPPTGSIGGTVDLTTKRATDEPLTRLTTTYMSDSQFGGHLDVGRRFGSDKEFGVRANAVYRDGSGPVEKQDLKTELFSLGMDWHGDRARVSTDLYTSKDRVDGVTRGINLGKDIAIPKPPKPETLLNPDWSFVDIQDKGAMIRGEYDLTNNVMGYATYGQSKTEYKYNGAMSATVLDNTGTFQTSIGQLAFNVDKKSADVGLKGKFNTGAVGHQWVVNATYYKHNQDDYGVRNVAGAEWTTNLYDPIWGKAVPFNAPLISNSELQLNSYGLADTLSFIEDRLQLTLGVRYQEVESSNLFVPTSTLTKYKKNATTPGAAILFKATDKVSIYANYIEGLTKGDAAPLTAANYPTIFAPYKTKQTEFGVKFDQGTFAHTLSLFEIKKPSAYTDLVTNIYTSGGEQRNRGIEWSFFGSPIENVRLMGGASYIEPEVTKTAIQSNEGNMAVGVPKTQGKLGVEWDNEVAQGVLTLSSNATAVSKQYIDQENTLHIPGRTLIDVGARYKTSISNHPITFKADINNLMNKAYWGMPKLSNLALGAPRTYMLSVSYDF

SEQ ID NO: 2597 - protein, 689 aa, Acinetobacter baumannii
MLGCTALVAFPLAAMAQEDPGTGTYRLSPIIVDLSFAADDDANSIVAKELWTGGKVATSVLDTPAAVSVVTQKEIEQRNADKVEDVLEYTPGIVTDYYGTDDRNDYYLVRGFQASTYRDGLTLGSMRGVREEPYGYERLEVMKGGNSTLFGTSDPGGTVNFVSKTPRFERFGEVYGSYGSHDHKELGFDFGDVLNDEGTLAYRVVGKVQDAGLEYATSKDDEQFFLGSIAYEPTDYTRLTFTVDYLRRDGTPNSGGYPLDRLYDRGQFFGEPGFNDHEVERLTVSAGLRHEFENGLRLSANLRYSDLSDDFAYVYLSDNAARVGTMVNRFYFGTDSTAEELIGNVIVQYDTSFGSVDSSTLAGIEFRDASTTSSSIYGAHTQIDVSNPVYTGAPSGFAPYSVQANDYTTRSVFLQQNLSFSDRLIATAGVRHDWLDITNTDRLTATTTQADFSETSFRGALTYKITDEISTYASYVQSVAPPSIGTQPERGEQYEIGLKYQPESINALFTASVYDLTKKNVVVPVVLPSGAIDRQTIGQSRVRGLELEARAELAEGLTLSGGYSYQKSKFVRGSVRGVRVDGNEFATVPNHIASLWLTYDLPTTGALGDMSVGIGARYVGPYYYNVFNNNGKSPGQTNIDASFTYGVSENTELSVNVSNLFDKQYVVGRGTADYYNNGRTITAALRHSW

SEQ ID NO: 2598 - protein, 503 aa, Acinetobacter baumannii
MKLKHLSTAMILATLPATGVFAAALDRSGQSMSAFFQPGNYFEAGISVLDPDVAGKEAGSSATRRDIGDMANDYYFPSAALKLQINDQFSFGLLYDQPFGADAEYSGNNVFVSNPGSDTILSQKALGDLASSSIQKLVQASGSAFTPALIEVTKVTGGDPTKPTQTEILGALQQVAAGGNTTVGAGLTALQKTQAAINAANNYLGTGGTKVKVDTQNLSFVFGYQPTKNFNFYAGPVLQTVKGNVSLRGQAYSLYNGYDANIKETTGAGWLAGAAYQIPEIALRASVTYRSEIDHKVNIDENLSILNFPGLTSVLAGLDVPASKLQAINSSGKTTITTPQSVNLDFQTGIMADTVAFANVRWVNWKDFSIQPYKFGKVSEAVGGLVGRPNGFNLVEYSDDQWSVNAGVGRKLNDKWAGNVSVGWDSGAGNPVTTLGPTEGYWNVGLGVQYSPTPQTFIAGGVKYFWLGDAKAQTGAQAGSDEYVADFSDNNAIAYGLKLGYKF

SEQ ID NO: 2599 - protein, 681 aa, Acinetobacter baumannii
MSLLLAASLAHGETGTPPAERRSDAPPATALAPIFVTANPLGASALSSPTASLSGDALTLHRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 2600 - protein, 417 aa, Acinetobacter baumannii
MKTHKSLMVSCLSVLSITLFVQHAQAAAAFDPNGSWMLGDWNGQRTALQAQGYDFSFGYTGEYAGILDSKQTSTHGSAYTGQLALGSHLDLGKILGWQDTEAQITLTYRDGQSLSEHSPALAGHQSSVQEVWGREQTWRLTDLWIKKKFLDQKLDVKVGRFGEGEDFNSFDCDFQNLALCGSQVGNWVGDQWYNWPVSQWAMRVKYNLQPDLYTQVGVYEYNPENLERGKGFNLSTDGSHGAIIPAEVVWSPKLGVQSMPGEYRLGYYYSTADAKEIADSTKTSHKQGVWVTAKQKLFQPADQTDRGLTGFVNLTFHDSDTNKVDNMQNIGLVYKGLLNQRPQDELALGVARIHINDDWNDVQAKEYDTEYNTELYYGIHATNWLTIRPNVQYVRHVGALKNGDNTWVGGIKFSTAF

SEQ ID NO: 2601 - protein, 715 aa, Acinetobacter baumannii
MEHVMKINTLQFNKCKLAVVCASALSLNSYSAIGEENVEETKGSIETISVVGHKLTELSSNNNGGALGNKTLLETPFSVDVISLEDIEIRQVNTLDSLFSREASVSVDGSAYSTFGSTIRVRGLPLDYTNSFKINGMSINNFSGELPYEAFEQVTLLKGASGFMYGMAAPGGVVNYVTKKATGDKFIVDVGMRSDSVFSGHIDASKRLGDNDEYGVRVNLVKESGDTYLEDGTIDRNTAALAFDAQLTDSLYWTVDVIYNDRLTENSWTTMNNSLGSTDLLPDTVSGTRSIGADGTFDDYKNIVALTSLNWDINDNWSARLEYDYSKNETRWVKSLAYLLNSDGDVNISLYDQYFDVNYDQIQAVINGEFETGSIRHNLLLGASYQKSTTYRNDPHRVVMWGYGTDNLFNPVEIPTYNSTLEDNLSMAWIDKQQSVYLSDFISLTDQWEVLLGIRSNQIEHTPSEYFSSYQAYNEDRALSPTAALMFKPDDKTTYYVSYVESFEGTTSYVGETYANADELLEPLESKQYELGVKTAGDGWSLTSALFRIERGATLVTGDNYLVQDGLSIYQGLEFSGAWEVTDNLSLYGDLMLLDATYDKTNSAVEGNDVAGTPNQQFSLQTNYEVDAVPGLAVNLGAKYFGETTLDSNNTWELPAYTLFYTGVSYSTMIDYKTLTVIGTVDNLFDEEFWAAGDAYGALRIGEPRSFAVKVKMSF

SEQ ID NO: 2602 - protein, 685 aa, Acinetobacter baumannii
MLFYKNILTLSILAAISIPVFAAENENVEKLETIRIKAHPLEQTSKDFAVADTVVDQKHLTEGAATIGDALNSEVGIYANQFGAGSSRPVIRGQDGPRVKVLQNSSENVDVSTLSPDHAVTVDPVLAKQVEVIRGPSTLLFGAGTVGGLVNVIDNKIPTQMPENGYEGQVGLRYNTGSDEKLASAGVTVGLGSQVALRVEGLTRDANNYIAPNYIHEGEKERRVDNTFAQGDSVNVGLSWIYDRGYTGISYSNRRDQYGLPGHSHEYETCHIHDLSLHCGDHDHEGHSDEEAHDHEHEHGGPWIDLKSERYDFKTELNDPFAGFQKLRAQASYTDYQHDEIEEGTIATRFQNKGYDGRIELVHNPIADWEGVIGTQLGQQKLNLTGEEAFMAPTTTKKWSVFALEHKQWKDVHFELSARADQQEIDVDDNSKQDFDGSAFSYAGAANWEFAPNYKLSFVASHQERLPLAQELYANGAHFATNTYELGNDQLGKEKSNNVELGLHFDHDKLDYHLHVYHNWFDDYIYAQTLDRYKDFRLVQYTQDKARFYGAEGEIGYQITPIYKISAFGDYVRGKIDAEGNAPRIPAGRLGTKVDADFGDGFSGSAEYYHVFNQDKIAAYETETEGYNMLNLGVAYSGQYGAKTDYRVYLKANNLLDDTVYQHASFLSNIPQVGRNFTVGVDFSF

SEQ ID NO: 2603 - protein, 925 aa, Acinetobacter baumannii
MTTRVRKHPPAPRPSNPTPFRLSPLAALIAGMAIAGSAPLHAADTRSVAELQAEIARLQQELAAKTAAEGGTAAAPAAAPAASSPAADGSPQALDTVVVRSRHRLERLQDVPVSVAVVTGAELEREGASDLDAIAKRVGNFSWNPGNARTSSLSIRGLGKQSQTDAMDPSVGINVDNVAYSYNPLSSFDLFDVDSVEVLRGPQGTLFGKNANLGVLKITNKRPSFNPEADYSLTFGEEQRFIARGAVGGGVVDGLLAWRGAFQFDRGQGYVKNVEKGYLESTFGNHDRAAGRVQFLLTPGPDFDARLSIEMAPTTGEAFNGKTVYTPTPTRYADGSVNTLSSDASTRLARRWFRQLSSYDYQRDYLYGGNTVNLDHQTPTYTDTKGISAELNWRVAGHTLTSITAYKDFRFQVRNDEGTPFDITKRGGGHVDKFEQISQEFRLTSELGGFVDYQTGVLLLKSSNRYDSNAGFGSDAGAWFASNSQYNTLDANSNGRYLLENSLNELQVSPLQKIETQSAAIFGQANWHLTEPLTLTTGLRFTHEDRDNRTSRLIINEGYGAELNPVAVNGVQLGGFSSNNTTGELSGTNSTAQLNVADFVANKYFGTAITATPGQAYASLTAAQKRQVAAAKAIRRTNIGVLWAETKAKGFRETQPTLLLSPSYKVNENLTTYFSAQYGEKAGIAQITNGYSNPVKPEKTTSFELGFKSTLLDRTLVLNANIFRTNIRDYQQAVQVYDEYTTNLNNDGTTYYTSATGNVPKVRVNGVEIDATYSGIRYTTLRFSGAYNDAVYKSFPNAGKAAEVNNIAAPYVDLSGKNLPGAAKYTFSVGAEYRRPVLGDKEFHTSFNTYYTSKFNSDNTLSSYGWIDAHSTTDFSIGLGRRDKSYDVTLLVKNLFDDDTPLAKTWNTYVPAPPRWVGIVFSGKL

SEQ ID NO: 2604 - protein, 803 aa, Acinetobacter baumannii
MSARRTSLACSIRQATLALSLCSAALATSTAWAAPQRYDIPAGSLASAISQFAAASGVTISFSHDETTGLQSSGLRGSFELEQGFAALLQGSGLRVQPMGEKRYVLSKAPTDGAVELGATSIDAMGLGSTTEGTGSYTTGSANTATGLRLSARETPQSVSVVTRQQIEDQNLTDVAQVLEQTPGVVVNSMGPAGSDANHIYVRGFEVGSIQVDGVNRPDTYGFRDDLADMVSYDRVEVVRGATGLMSGTGDPGATINLIRKKPTVETQRKLTLKAGSWDNYRTELDMSGKLSESGHVRGRFVMSTTDGQSHIDRQSLEKEVAYGVVEWDITDSTMLTVGAEYQELDSDGAGNHGFPMYNTDGSHFKPSRSFNSASDWSYHKRRAKTLFTTLEHQLDNGWQLKLNAEHSRRSYDDAFATAASGTVNPDGSGINTWTGRWAGEPRQTSFDLSANGPFELFTREHQAYLGASHYKAYYRNNGYPLWSFQTIDNIHTWDGSLAIPDAIHTKSTKDALDETQDGLVASVRWSLADDLSLITGARVIDWKRDEANTTLATGDTSRTSRSETGVVTPYMGLVYDLNENWSAYASYTTIFKPQSKQDVSGGYIEPEEGVNYELGLKSEFWDKRLTTAFSVFEVHQDNLAVADGSNLAPDGNQAYRAESGTKTRGFEMEMAGEVLPGWQVSAGYTYAVARDSDGKRLLTDVPRDTLKLFTSYRLQALPQLKVGGGVRWQGAEYSKNAGPDGETFNQGAYSVVDLMAQYAFTPQTSVALNLNNVFDEKYYTAIGSRGWYGTPRSATATLVYAF

SEQ ID NO: 2605 - protein, 183 aa, Acinetobacter baumannii
MKRLFLLLTLLISTTAYSADETHGFSAGLGFGSTENYGAITHYDFAYRYQFTPNWGVEVGYTPFQSEPFTGAINAIFDDYVLVNSYSSRLAGTYTYQISARHNAILKVGLSQSKTNYELDDYTNNSDDAITIDEYSDDGYGLYAALGWRCRFYNGFEFMTTLAYQDSGTLEMTSFTVGIGYSF

SEQ ID NO: 2606 - protein, 241 aa, Acinetobacter baumannii
MQLKQLAATCALLSATAMVQAKPIWQDFSVTGLYGENYEVVDDKETTITLEYAAKVKYADVFFFMDRMRGEDDYKSTYFELSPRLSLGEVSGKKLAYGPIKDVLISTTWESNSQNGNNFDNFLYGFAVDLDIPYFQYANLNFYRANNEKTDDDYQMTFVYGIPLKLGSEDFLVDGFLDWSTAEDDHASELNWTTQWKWNVGKHISPDTRLYLGIEHSVWNNKFGIKGADENNVSALVKYHF

SEQ ID NO: 2607 - protein, 254 aa, Acinetobacter baumannii
MLNKSIVAALLSTVFISTSIYADVAKTSVDLGYKFYTNSTEDDNPGVFNQPFVKLNHLGIADWGTYFANVKLENPAELAENQKNQDGKTTLKSLMILENKIGESNFNFWTQNFVSASETLVEDNLYFGFTHNAKIKALSLNYGVGFNYTFGNFSPTSEKFNDLSGYAVVLNAKYPFELLGLKHSFSLNYEAQIDRDKAHQELFSYDSYGHQIITTLQTLLTDSIYTKLHLTHYDSWGSQYNDGIEYGVSIGYQF

SEQ ID NO: 2608 - protein, 864 aa, Burkholderia mallei
MWSKALKRRQRAYLGIIGTIVLLGTQPANAQASPNVAENTEVPNTQIPQTNIKGLLAQEQPQNAAVTIVTGVRLNSTANGVEVILETPSSDKLQTATQNEGNNFIADISNAQLRLTTGDSFRQEKPVAGVAEVIVTNQDANSIRVVVVGETSLPKVELFDDDAGLVFGVTPDATSTPPPQTPDTEKPSSETPPTQPSAQEKEPIELVVTGERDSYSVPSAITATKIEAPLRDIPQSIQVVPRQVIEDRQIVRIGETIENVSGVQELPGYGGSTSLTGYYFRGLSLAYQSLRNGFRDIGVIGSRDIANIERVEFFKGPASVLYGGRFSLGGLTNTVTKKPIEEPYYNLGATIGSYDFYRPTLDISGPLTSDRSLLYRLNLAYQNSGSFRDFNENESFFVAPAITWKISPKTSLTVELEQQNYNYTFDYNFPPEREVFQLPISRFLGEPNFNDATFNSTSVSYNFEHKFTDTWKFRQGFSAIIVNGDTRQVELFDPLGNDRRTLPRSPLRTEEEQEDYVLQNEIFGEFKTGSIQHKILVGLELSRWGYDFNYFRGTLDPIDIFNPQYGAQAINFEQELHRKQSSDNLGIYLQDFIEISQNLKLLAGVRFDINDVSVVNKITNTTINQQTTTRFSPRVGIVYQPSSTTSLYFNWANSFNPQFFRVSRTGEQFPPTTGEQFEVGIKQDFLNNRLSTTLALYQITQQNVLTSDPADPRFSIATGEQKSRGVELDIAGEILPGWKIIANYAYANGFVSRDNSIPEGDRIAGIPQHSASLWTTYELQKGNLQGLGFGLGLVYASEREAQLPNTFTLPSYVRVDAALSYRRDNLKVGLNFRNLFDTKYYNTDTFYIYPQAPLTVLGTVSVQF

SEQ ID NO: 2609 - protein, 926 aa, Burkholderia mallei
MAIQFTLGRFKPIALSLAVTSALVSQSAIAQEISFSLPEQGLASTIEQISRQGQVSLLYDKSQLNGLRAPALSGSYTPQTALQKILIGSGLELVNENGMLVIRPQTLNQGTLVLPETQVSGVVQNHPAMDVMSAPQYVTSEEIRQKNTGDGNITDLMKTNPAVQFANNDSNSMNQGEIKPSRISIHGSSSYQNAYRLDGISFNNDFDPADSGLGETATRLSSSDQGIYIDSRLIDSMAVYDNNIPVEFGGFTGGTVEVNSRRWQGENSAHAYYRLTRSGWNNLFHDSTQAIDTTKNDTANPARFQNRYDKNDFGGWFELGVTENSGVVFSASRRSSTIPMTVTGGAGAVIENGEVEMAEFAPGSKNQHRTSDNYFLKYSIDLSDVNSLDLSANYASYESRLFSSSVMNSGYDSTHNGFGLTAVYKHQLSLGQLELTANTQDLKDERDNDQKYAVILRAAVDNDYSNMVDANSGGLGDLISQQRSQSAKAVMRFNPLEDGLGATHKPTVGTEISYTKGIYKRDKDYLQYTFTGNIDKDDMFNGMLWNAARFKAGKYTADYTNYALFLDDTIEYGRLTLRPGIRLDRDDFVSRTNIAPRLTGTYDVFGNGKTQIIAGANRYYGRSMLNYALYGAQNGGMQTCDMMSDVCTVNPNMNTWENKKDYEGLDSLKTPYNDELTLALQQDILSTTWRLQYVHREGYDEVRSRTKTKKLDMYDPESKIRVFDNDGRSSHDTVTLSVNNSQPWEWADASHVMTASLTWQQTDSNTPKDSGYNYFEGRNDLNLNKVYYNGKVIDASKLPSTSFNSPFKVNLELTSVWDNYDLTWYNRLQWWGARDQVVRYGNGDGTYTDPEYGLIRRYTDQHYSSKYTWDTRLGWKPEFAYGFGVSVEVNNVLNNKNVADTFTYSNRTIKSYDPGRQFWLQVNYDF

SEQ ID NO: 2610 - protein, 719 aa, Burkholderia mallei
MEHFQRSRRARFLLASVPAALMGAAVARAQSDVSAPSPDTIALETIDIAGRSGGAANTVGYLTRRTSSATKTDTPLIDTPQSITIVTQEQIRDQNFQNLTDQLRYVPGVIPAQGESNRDQAIIRGQNTSADFFVNGIRDDVQYYRDLYNVQRVEVLKGPDSLIFGRGGGGGVINRVLKEADGLRIREIGAGGGQFGDKRVTVDVGDRFSDSAFFRLNGMFEDSGTYRQFGELTRYGVNPTMTFLIDPVTTLKLSYEYFHDDRFPDRGIPSQFGRPYRYRQNISTFFGNPEVNFTKVDANIATATFDHLFDSGVQMHSQLRFADYDRFYRNTLPGSAVNNAGTAVTITGYRNETDRTNYFSQNDFIYKFLTGPLKHTLLGGFELGYQEGLVFRQTGFFGSNLATSVVVNPLAPITRVPVTFRNNGTTDANSRYSLGLAAVYAQDQVEVTDWLQLIGGLRYDHFDFASTDQRTLVTNARIDNLVSPRAGIVLKPLPNLAFYGSYSVSYLPSSGDQIGAFTPGLVIAKPEEFENTEVGVKYDVSPTFQLTAAAYNLDRRNQRLADPNNPGFFILSGRTNTQGIEIGANGYVTDWWQIAGGYALTDARIESATSATIVKGNTVGLVPFNSVSLWNKFAVTKEFSIGVGYIYQTHTFASSDNTVRLPGYNRFDLGLFYEVNESVRAQINIENLFDRRYIYTADNNNNITPGAPRTIRAQVIVRF

SEQ ID NO: 2611 - protein, 890 aa, Burkholderia mallei
MDSICNRRPHRAHAGVCADTANAPAGLPEAAQPAARLGAGRPRDAAAPRCARQATSHTSHASHTLHAPCMPQFAPQFAPRRVAPRRVVARVAAAALFSACAAPGVSGAAEPAAATRGYDIPAGSLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYAGNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 2612 - protein, 754 aa, Burkholderia mallei
MIPSLRQAAPSLHLFPSRPAALSPAPKPPTRRTMKDAEKRDGRKVYATRSALAGLLALSMGATNAWAGVTFAEKGGDGTDKNPFYYALATGTAINTTPIKHGTPAGPMTRNGGDIFIYGIKITGGNLDNKGEIRIHSKNDTGSTNLLAIKSTGDASSTIQNEANIELEAKGGSSTSSSSAYTFGIMGEITRNEGNMTIRSTGGTLTAASAEASAEAGAAGIGSYGDLYNQGRIEVVAQAGRYSADGGATYQSDSATALGILFAREGTLDSRAPIAVQARGATNTADSERSIFSGTEELKSGKFLRAYQVLTYSALTIKGYSMVFNNQEEVDEHYRGAIGTIGDGTATFAPDAVLYVFTDNNFAKATTYKIPTLVEDAAISDQFTSAQLALTSPDYRANLVDGDGKKLQQLAIAYAPEVSTPLVSAQVNQKILASGTTIVRASSLSPMLAKMERSNPRASAYDGVLLASTSPVLAVPDMEILPQKRGWAFAMPYYSNVSNNASPMGYDADIYGATAGYNHWIDSDLILGFHAGYGSGDINYTGKGYEQKKENLKAGSLGVQSLYRFADDWLLQSIASFYYSSNDYSDNNPLNREQGDYHGYGVNANLDLDYVFSFTNNRLVPSVGLRYLWQHVDSYTAYNLDNADVNYGDMDENQLYANLGLDWYGDYRTESNWQIVPSLGLGVEQALTDNEFGNSMGVGSIIIPVTNSMDKTSVSARASIEFVKDSYALSAGYAGAYSSDTKNSSFYLQMKYFF

SEQ ID NO: 2613 - protein, 379 aa, Burkholderia mallei
MKKTLIVAALSGVFATAAHAQSSVTLYGLIDAGITYTNNQGGHSAWSQSTGSVNGSRWGLRGAEDLGGGLKAIFVLENGFGINNGTLKQNGREFGRQAFVGLSHEQYGALTLGRQYDSVVDYLGPLSLTGTQFGGTQFAHPFDNDNLNNSFRINNAVKYTSVNWAGLKFGALYGFSNNNQFANNRAYSAGVSYSYAGFNIGAGYLQLNNNFGPTVSNASGAVALDNTFVGKRQRVFGGGLNYTFGPATAGFVFTQSRVNRATAIGAGASGVSSGIALDGTFMRFNNYEVNARYAITPAWTVAGSYTYTAGFIENHHPGWNQFNLQTAYALSKRTDMYLQGVYQKVNNDGTGLGAYINGIGGMSSTEKQIAVTAGLRHRF

SEQ ID NO: 2614 - protein, 391 aa, Actinobacillus pleuropneumoniae
MKKTALAAIVLASSSGAALAQSSVTLYGIVDEGFMINTNAHGARQYGLVSGSESGSRWGLRGSEDLGGGLSAIFNLEGGFNSSTGALGQNGDIFGRQVYVGLAAPTWGQLTFGRQYPTGYDYVGSLTASPQWALGGAGYGAHPADLDNLDGTYRVNNAVKYKSPSFSGFSFGALYSFGGVAGSFSRNQIYSVGAGYTYGPFVLAAEYTDVRNPNFSLWGNKANDSTTASNMSGPVISGLATAGSQDVAAVGANYKLGSATFGLVYSHTSFNDLGTTTVSGLTGARLRGTAVFNVIEANAKYMLTPALQLGAAYSYTAGGSLGGRSGARYNQVDLGLDYNVSKRTDLYLVGVYQVASGHDSTGADAVAQIAFATASTSNRQLVAVGGIRHRF

SEQ ID NO: 2615 - protein, 367 aa, Actinobacillus pleuropneumoniae
MKNLTTAGAILLMTTSMVQALGLDRSGQNIGVIFEEADNYVELTFGSISPSASGTDIAGVATGNVTQDFTQMGLAFKQQYTGQFSAAFIVDQPYGADILYPAASPVLGLTAADLNSVAYSVIGRYKLDNGFSVHGGLRMQTLDANITLGGAAYGGLNGYNVDLGEDTELGYLFGAAYERPDIALRVALTYFNAVDHSFDTQENINPGVTTQTNVTSPQAVNLDFQTGVAANTLVFGSVRWADYSQVIVSPATFSTVTGGASLTDIDSGFAYNIGVGRRFSDAFSASLSVGYEPTGDDLVSPLAPTNGNYSVALGGAYTMDNGFEISGGVRYIVLGDASPETGTPDVARASFTDNDAIAVGLKLAYSF

SEQ ID NO: 2616 - protein, 1096 aa, Actinobacillus pleuropneumoniae
MKQFKLICVSIALLLCGVGEAVAQTHKVVSGTITELIGKAAEPLVGVNVNIVNAQNRSLGGAITNLNGQYNVKIPEGESNLTIVFSYIGMKTQRVKYAGQTNLNIRMESESKTVDEVVVSAKRIERNDLGITSKEMISATQKVNMDDLVAAAPIVSVEEALQGQLGGVDIVLGGDPGTRSSIRIRGTGTLNASADPLIVIDGVPYPTDISDDFDFSTANEEDLGALLNISPNDIATVEVLKDASATAIWGTQGANGVLVITTKKGTVGKTRFSFSSKWTLKTEPKNVPMLNGDEYTALMQEGIWNSAKYTGLDNASNHYLDLLFNTPVIGYTPGFEHFNEYNQDVNWLDYVRQTALTSDNNFSMSGGGEKATYRLSLGYMSDDGTTIGTSLKRLNTSLNVTYQFSNKLKFGANFSYSQSDQDANWAKNVRSEALSKMPNKSPYTIDRRTGLMTGDYFVYHDPDFEGSFKGTVNKDSQNFNPVAMVNEAVNNTMQREAKITFNADYTILPGFTYKGWAAINMRTIKAHRFLPQVVTGVAQNSEYANQSVDSYSDKLVLQTENKFMYIKNWNDKHNLIANALVRTSQQVTTNYLSATYGNASSGLSDPTVGTSVLGGENGMNSSEAETRTVSFIGLMNYTLLNRYVFHASLNAEGNSAMGRNKRMGYFPAAGIAWNLQNESFMESLRDRWLDEAKIRVSVGQSGRAPSGTSIYLGAYVKGDNYMNMSGTKPERMQLDDLHWETSTEYNYGADVMLFGGRLKFTFDYYQKYIKDLLQKDYKLPSSTGFGSMRYYNSGKMENKGWEFRADAIFWKNKDWQISGYVNLSRNENRITELPGNMAQETYEANNGKYAARVEVGQPVGAFYGYRYLGVYKDKDATYARDASGNIMNDVHGKPIVMKNLTKACQPGDAIYEDINHDGVINQYDIVYLGNYNPVLTGGAGLTVKYKQVSLSAFFHGRFGQSIVNTARMNNESMYSDDNQSTAVLRRWRNEGDVTDIPRALYKEGYNYLGSDRFVEDASFIRLKTLTLNYLFPKKICNRLGINTLSCFVTGYNLFTWTNYTGQDPEVEIPTKPTDLAEDKATTPVSMRFAFGINLNF

SEQ ID NO: 2617 - protein, 978 aa, Actinobacillus pleuropneumoniae
MHKKRLLPLCIALAASGHLYAQETDTREVVEEITVTGVRQAELNAREAERGKSIFSSVISQDDAGNFADQNVAESLQRLPGITLQKSEGEGRFISVRGLGPGFVSVQQNGSELASAGSDDRAFALDAIPADLLGAIEVFKSLTPDMDLNSIGGAVNVKTVSAFDRKKDSFRVTVQDYYQDYMEEHSPKVSMQGTHLFLDNTIGLGYSLSWEERKTANYEMLHHETTDMRYVQENITGVETPDPTDLDSYMLIPFEFQNRQEIAERERTAASIDLGWKPTDSGEYYLRSSYTKFTDNDLAWREYYRFGQAGPGDIAYLDRDTNTFGMVDTDIQQQMFIQYGESETSSASVGGKHEFEFNSGRLIIDGDISWSDSTYDKPDGKRVQFRVRDVPVIGRAGKEFIVGQAISADALAELAGTTTTGWTDIGGYSGAGINLAAFSFDNLFLEASSRADELQSYGMNFKFEIDEGFVSYWKAGFNYKERTRDRNQDRWSIVPRDESQHCPQTEDFAICQDVARNTNLSRVETAEVDHPSFVYPAITLNGANQLIDTVRAIATEGNQSGLESIYRDYNMSEDSFAAYFMGEFRLADNQWLIAGARWDETKFSSTGFLAINNDNFSLGNDETVKVDYSIPLDSQANKYDNVLPSLHYRWEPREDVLVRSSIWTSFTRPSYDQARAFANIESNFELCNPVTNVCSTTPDANTGIPLSEFTLGPNNTLRLGNPNLVAMTSVNYDASVSWYIDENIFLQAAFFYKDIDDYIVEVRGARAALDELPVRLPVDQVDAFIIPSDLELNNVSWTANGDRAKVYGAEFSYNHNFDNGLFLHNNLTVMSSAAYAGDSIRAGKTQLPEQADTTFNTTVGWENDVVSVRLIGNYVSDILKRIGSCPAGSEGYLIVQAGDDRSPCNKWADVYQDDTFSLDFKATWQVNKNIKIYFDAMNITDEYMTQYYEGNQYSGGNVMYKSEVYGRSFQIGLNYKFL

SEQ ID NO: 2618 - protein, 452 aa, Actinobacillus pleuropneumoniae
MLEIVMAHQPAQAESCTVDPFGSEVCLPDSTPEEPDKPKRSNQSKKSNKPDKSKRMVIVPSCFGPCTQFPPAPPYRQFQEVMEEAALKATPDATPEPRPAEPLRPLWFKSDQLDDVEAETYLERTLDRNDMAQLNAVGIEADTDADGMVITVDGLSYGEVLEPHGLLFTNEVNEPGLNAWVRGFGGGSSNGAAGDRYANFSNGGSQIGFDIPINDETRIGLFGTYAVMNGTDGARGSWDSDGWGGGAYAEYWTSDFYLRGMVSAGGYDGEHRRKIDGETAKGDRSGNSWTGVLNIGAPLQSGDWIIEPQAQLSYTNTSLDKFSEHGANRRDRLRFHEMEVDQLGSELSVKFAIPIRDGERSLLLPSLRVGWAADWGMSGDHQKVSYLESGKSQRWDVNGNDDHAALVELGLDYTTFNFQDTSMGVYARGGGLLWAGNRGTSWQVQGGLNFKF

SEQ ID NO: 2619 - protein, 445 aa, Actinobacillus pleuropneumoniae
MQAAPRSLSLLSVSLAALFAAAPAAQAAGFQLTEQSVTGMGRAYAGAGMAGDDLSAVFYNPAGMTLLSGTRVQGGLTYAEIDAPFSGRNTSVSHLPGTPPATVTTSANDNGRGAGEVIPNGYLTHQVNDQLFLGLGVTTPFGLGASYSDNWGGRDNGISSSIMTVDINPSLAYKLNDKWSFGGGVSAQYAKADLKQGAYLPGASGELKADSWGFGYNLGVMYSYSADTRVGLSYRSKIHHDAKGDYTNAGFPAPLGGLLNGTYSGSAEVTTPEWLMLSGYSKLNSKFAVGATARWTRWSRFDQLVVKGSPVVPKLPGLTPAPIDTTTTIDNHWKNSWLFSVGGDYFYSEALTLRAGLGYETTPVPNPQHRNVLIPDADRMWLTLGAGYRISKQASVDVSYAYLRAVGDTKIDNTSHSPFGTTSRLQGDYSSISGHLLGVQMQYRF

SEQ ID NO: 2620 - protein, 372 aa, Actinobacillus pleuropneumoniae
MKKTLVALAVTAFAASASATTVYDAEGSKVDFDGSLRIVLDRTNSKELDNHNVVKTKKDAHTGIRNTGSRFGVRVKHDLAQDFYALGRVEFRFNKNTSDDGFGDLYTKRAYVGLGSKQYGELTFGRQVTIADDLSQSVDYNYGINPKGDYIQTDGNQVIRYNYRGVENLHVSANYNFAQDRKDGKVLANKLQNAYGIGALYTVDNWDLRAAYGHTNYKTATDSTKHRKDGVLGSVGYKFGDLKLSVDTGYSREKGLAVTDDNGVTTFYNGVKSNAFYVSPNFEYQVVPASKVYGNYLYERVKSKSNGSTYAAGKEKTHGFLLGVDYQFHKQVVAFVEGSYTRTKDYDKVTNGYEYSGKSTNKAIGVGMRVYW

SEQ ID NO: 2621 - protein, 1117 aa, Actinobacillus pleuropneumoniae
MLIRTLPATPIARVLSAFAFFFIIINPAIAQIDAGAIVGTVRDSSGAAIPKAAVALTNAATGLNQTTATNDAGEYQFIALPPGTYSVKATAPGFGPQVQNDIDLHVQSRPSVDFSLKVGAVTDTVEVQSTGALLQTQSADVGGVVQEKQIRDLPLNGRRYADLALLEAGIQKNFTNPNNTAPDRFSSNGNLETQNYFSLDGVDNNSGSTNLQEGSVQTVQPPPDALQEFRVQTRTYSAEFGTSAGAVINASIKSGSNAFHGDVWEFLRNNRLDSNSFFNNAGGVPRGHFSQNQFGGTIGGPVMKNRTFFFFDAQNFTSRKATTVNSAVPTPLMKQGNFTELKASLANPTVPSQNGCIAGNIIAASCIDPVGAKLLALYPDPNIPSAVARQGAAGSWTGSPNYQFQYSVPNDTYSWDTRIDHNFTSTNRMFGRFSDYHVDRQDPPWAPDPLAGNGNFATQYRIRGKSVAVAWTDLLKPSMLNELRAGFSRDYAHSDPIGLTLGASKAGDYGLTGIPSGPNDAGIPPINISGLQRLGSSPWRPQFQVSQVWQLLDTLSWLKGNHSFKFGYEHRHTSDNFLDIQSLQGQITASGIYSGNSGLGVPDFLLGDISTAAFTTPTVVHNYQYSNNFFAQDIWRVRPNLTLTLGLRYELFSPMLNHQNALSNFTPANGGGFVTAQSGDWYARGLVHPDKNDFAPRVGFSWGPKEHIVLRGGYGVFYQHIIRIGSESMLALNPPWVIDGSLAQTLGSTVPAFQLKNGFPAAQFTPALVDLTKLQTRAQDPNERTGYVNQVSFGPQFEISQSTVLDISYVGNFGRKMNRLRNANQGFVTGFDSTGKPITLFPYANLNTTLNSTSGNHAFLELATNDGNTNYNGLLVSLRRRFSKRLSYGISYTWSHNFSDYVDNLTGGSTPASAYNYSLERSNSPFDVTHRFVGNAVWDLPIGRGGAVLNNNSVASRMIGGWQLNSIVTLETGTPFTVTAADVSQTGGSHASRANCVGDPFAGASSDRSQFVGTGSPGFFINPAAFAAPAAGFFGTCAPRAFHGPGIQNVDLSLFKRFTITENWRVEFRTEFFNALNHANFNNPSASYTASSLGSFGKSFSTVTDPREIQFALKLYF

SEQ ID NO: 2622 - protein, 463 aa, Actinobacillus pleuropneumoniae
MNHTFNKTLIASLLTLSAGGVSASLFQLAEVSTSGLGMAYAGNAAVADNASVVANNPALMTKFKRPEISAGGVLVDTDLTVRGITSNGNQAYAGNVVPTAPIPNIYFVLPVNDDFSFGLGYNVNYGLKTKYPTDFAAGSLGGNTELQAHNFNLSGAYKLGYGFSIGAGLNVVYSKAEFIRHLGDNVEAGAARAKAGAAQARAAAAKANAAGLTAQAQALTATANQYQALGNLLSSYKRSTEVARVSGDEWSLGWNAGLVYELNENHRWGLAYHSPVDVKFKGHYSNSISAATGSSIVAFPTAGQEFPGKLTLNLPAFWELSGFHKLTDRLAVQYSWKRTEWSRLKTLDAYGTKGEHYLHKQEDFSDASRYALGVSYDVSEPLTLRAGIAYDENASTNHPSISIPDTNRMWYSVGATYRVTPALSVDAGYAFLRGTANSFDEKGTAFKIKARGNLYGLNLNYKF

SEQ ID NO: 2623 - protein, 948 aa, Actinobacillus pleuropneumoniae
MIVIKLRFNLSIAALCVLQYNSALAQEQMQLDTVIVKDGIQQQKISEIKKSAKQLAKQQVQDSRDLVRYETGVTVVETGRMGSSGYAVRGVDENRVAITVDGLHQAETLSSQGFKELFEGYGNFNNTRNSVEIETLKQATIRKGADSVRVGSGALGGAVMFETKDARDFLTEKDYHFGYKTGYSSADNQKANSLTFAGRYKNFDILALKTWRDGHELENYDYKTADGSVQGKEREKADPYSIKKDSTLIKFGYSPSDNHRFSVVADLYEKKNRGHDFSYNLKPTTYINVDEYELRHTNDKSKRQNYAFVYENFSANPLWDTLKLTYSTQKIKNRARTDDYCDGSHCKETENLAGLQLKDGKVVDRDGNQPNLGVDELGLTTITDSKGTYTEGVNLVRAYWFDCSVFDCNKSVTAYYKDYSNNITSEEVALTKTYTDEKGRKFATLDPKSKFKSILLPGSKGYTENIYTERDLDTDTKQLNLDLTKSFSLLGQEHSLEYGGSYSRTEKKMVNRGGFGATSNTQWWTKRFLGMRNNFFKGTEEVITCKNATGSDQWNGLICPNEDTFSFLIPVEAKNGSLYFADNLKANDYLSFDIGYRYDDISYKPKYVAGQTAKIPDDMLQGLFVPLPDRPTKEQIRQNAEENIKYLSRNVKYQKHSYSLAATADPFSFLRVQVKYANGFRAPTSDELYFTFKHPDFTVLPNVDLKSERAETKEAALTLHGDLGFITTSYFKTDYDNFIDLKYLGPKNLMNAFGGSATARPYQIYQNVNRQEARVNGLEISSKLNFGQLWQALEGFNASYKYTYQKGKMEGNLPLNAIQPRTSVFGLGYAHPEDKFGVDVYVTRVSAKKAEDTYNMYHSEEKAKDSYLKWRSDAYTLLDMIAYVKPWKNVTLQAGVYNLQNRKYLTWESVRSIRPFGTSNLINQATGKGLNRFTAPGRNFKLTAEVTF

SEQ ID NO: 2624 - protein, 193 aa, Actinobacillus pleuropneumoniae
MKKAVKVTALSLALAFTSSLAMATENIAFISGDYLFQNHPDRKMVAEKLESEFKARVEKLTANKKSIDEKIAASQKKVEAKVAALQKDAPKLRSADIKKREEEINKLGNSEQEAINKLVTAHDEEVSKYQDDYAKREREETAKLVDSIQNAVNTVAREKNYTLVLNEGAVVFAADAKNITEDVLKVIPATQAK

SEQ ID NO: 2625 - protein, 707 aa, Actinobacillus pleuropneumoniae
MRFSPSKLSMAVFLATTSLAYAQENTVNLDVVSVVSENAGAKSRTNVVTLKDLNKGTKEDLRGVLSAEPAINFGGGAGGTSQWTTIRGMGQDQIDIKVDNTYSDAQIFHHQSRFMLDPSLIKRIDVRKGAGSASAGIGATSGSIEATTVDAKDLLREGQDFGFKLNAGVSSNKGHSQGASVYGKSGAFDALLSGNWETAENYKGGKGYSNKEGSDTVKNSALGQRSLLAKFGVDINEDHRVVLSHRQERYHGERALREEFDFSQDWTTTASLTSEQRAAGYQLGAAAGVDRNGRPTRYLLDKNGALVANDANNDPRYRITTQNTTNLEYIGKNLGLINEVKANAYLLENSREETDTNSKTKVVIKGANINFDSEIGSDHFVKYGVNYRHQEGKPNSLEAFAENRRTRRLEATGVTNNQEKEDIGAYVEGIWGFGPVTMTTGLHYDHFDFKANDGKKVSDGAFSPSVGLIWEVVQGLSLNTNLNYATRSPRFYEVALSGSSARSVADDLKAEKARNTEIGFNYDFNDQISLNGSYFWQKVKDAHAVLNNTLVNSALLRNKGYELGAAYKYSGFTFRLGVADSKPETWVFNDASLDSTVYAVATGRTWTTGLSYKFENPSLEIGWKGRFVEGETGTPSRGSNATTAPVKQSGYGVNDFYASWDANKNLTLNFAVNNAFNKNYKSHSQRAGATSLPSAGRDFRVNVNYTF

SEQ ID NO: 2626 - protein, 369 aa, Actinobacillus pleuropneumoniae
MKKSLVALAVLSAAAVAQAAPQQNTFYAGAKVGQSSFHHGVNQLKSGHDDRYNDKTRKYGINRNSVTYGVFGGYQILNQNNFGLATELGYDYYGRVRGNDGEFRAMKHSAHGLNFALKPSYEVLPDLDVYGKVGVAVVRNDYKSYGAENTNEPTEKFHKLKASTILGAGVEYAILPELAARVEYQYLNKAGNLNKALVRSGTQDVDFQYAPDIHSVTAGLSYRFGQGAVAPVVEPEVVTKNFAFSSDVLFDFGKSSLKPAAATALDAANTEIANLGLATPAIQVNGYTDRIGKEASNLKLSQRRAETVANYLVSKGQNPANVTAVGYGEANPVTGATCDKVKGRKALIACLAPDRRVEVQVQGAKNVAM

SEQ ID NO: 2627 - protein, 935 aa, Actinobacillus pleuropneumoniae
MKNKLNLISLALLSLFAVQSYAEQAVQLNDVYVTGTKKKAHKKENEVTGLGKVVKTPDTLSKEQVLGIRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSQNITRVGVETNELDTSNRYTATTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGTYEHSKQRYDTRDMTYTAYWQPSDLLRTGRNWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLGKLWSSTKNEQSSYEEKHDTIQLSLDKTVQTGLGKHQLNMLLGSDRFNSTLKRHEILSEFSVGSWGLVRDIGYRNGSYNNPYVYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPDELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 2628 - protein, 475 aa, Actinobacillus pleuropneumoniae
MKKSLVALGVIVALGAVWTGSAWYTGKSVEESAQQRLDLINAKFVGAKPGSEVKFDNLKIERGIFSSNVTYDFVAAFPDMSFKIPFESTVYHGPFPLDRITHFDLVPILFSTHDRIVKNEDTQAWFDYAQGQNPFESKIKVGFDSTFTGQVKIAPAKLAFSDVDIVWKGVDVNFNKLTAEGVGQSDANIDGLKFLFESDDNNAKTLVELNNIKAKSDLKHSEWEHIPLGKQTMEVDSFRLSLSEQDMREFNVEYRNMSLDINTQKNDAFVDYNVFTKAPEMLVNGKSVGEFQAGVKLAHVEGNTMNTLFDIVEKTAEHEALPDDQIQALAKTILKNQPLLQIEPFKLTTDGGDLKANLVVEMANGDVDMLEQGKVLSLFKQLAVNVDLSKDAMIKLLAMTEEAQGKNKEEAMLSATQIMEETFAETINQGVFVENEKTINLGLLLENDALKLNGQPIPEEQILMMVVLFFLGMGY

SEQ ID NO: 2629 - protein, 719 aa, Actinobacillus pleuropneumoniae
MTPIAVFVAVSALPVAAKNINSKDIQTMDTVVVTGSSPKSINDIPGSVWVVNGMDIEEEYKGGKDLSAILSSKVPALDIGSGGRTSYGQNLRGRKMLVMIDGVSLNSSRSISRQLDSIDPFNIDKVEILSGATSVYGAGATGGVINIITKKGESGKTRFESYVSTSSGFNASDDYDYKLAQSISGGTDNMFGRVSVVYGKNNGFYDAKGTIVTPDTTQGSLQFNDMVDLQATTTIMPDDDKTITFLAQYYNSQQDSPYGLYFGKDFEDASDPEVREGFDSDRNMGTERYMFNAQYHDADILGHELLLQGSYRKEVLTSTPYFYGDYLAASEQTTDVVSMRAAMIKSFEKAKLTYGFEGYIDKLKSDQAIFDQSTSFETGGLVNKTSDLIGRYPGTEVQGLAAFIQGSYDITDAWKLEAGYRYQYVNNKINDFVKASIQKEIAMGNGTSADMLPGGENNYGLGLFNIGTIYKLTDKSQVWANFSQGYDLADPAKNYGRGDYTLIGDHWTLDSAPDINNSTQAGIKTDSYEIGMRQELGDFTWQGAAYYSYSNKRTKINSDFTIDLINDPKRVYGLEADVSYWLSQNWQAGVSGNLVKSEQKNTESGKWEKMSAADASASKAGAWLGWYEDSYSVKLQSQTLFNLSDDQGQSIDGYTLFDLVGSVDLPKGTLGFGIQNLLNEEYTTIWGQRATFLYNTNPASMFDYKGRGRTFSLNYSLRY

SEQ ID NO: 2630 - protein, 338 aa, Burkholderia pseudomallei
MAVNLLKKNSLALVASLLLAGHVQATELLNSSYDVSRELFAALNPPFEQQWAKDNGGDKLTIKQSHAGSSKQALAILQGLKADVVTYNQVTDVQILHDKGKLIPADWQSRLPNNSSPFYSTMGFLVRKGNPKNIHDWNDLVRSDVKLIFPNPKTSGNARYTYLAAWGAADKADGGDKGKTEQFMTQFLKNVEVFDTGGRGATTTFAERGLGDVLISFESEVNNIRKQYEAQGFEVVIPKTNILAEFPVAWVDKNVQANGTEKAAKAYLNWLYSPQAQTIITDYYYRVNNPEVMDKLKDKFPQTELFRVEDKFGSWPEVMKTHFTSGGELDKLLAAGRN

SEQ ID NO: 2631 - protein, 457 aa, Burkholderia pseudomallei
MKKFALHAVATVALLAFSHPASSTDVFRLEGYGAVSRGLGGAATAVDVGAPGMMTNPATLSLIKEGASVHLGLDMVNTDIDVRNQATGEVVSSNSHSHNRGPYVAPEAAFVYRRGALALGVGAFAQGGLGTEYGNSSFLSRATGALESGLENSSRLLVLSIPFAVSYAVDERLTIGGSLDAVWQGLNLELLLGADQVGSLIGSGRASGSLIGVLAGLPDLRGAHFSLTRDQPLNSGVDAWGFGGRVGLTYKATDATLLGVAYTLEASMEDMKGRATLTAVDGAAGQIPLNGRIKLRDFKMPAHVDFGVSHRIDSRWLVAADISRVFWRHAMKDINVGFVADGGIGNIDILLPQGYRDQTVLSVGMAYGVDNWTWRGGFRIASQALRSETLFAVIPAIPRKHLSAGLSYNFPAGSRIDVAYSHAFKQSMSNSTLPNTSDPISISHSQNNMSLAYVLPF

SEQ ID NO: 2632 - protein, 732 aa, Burkholderia pseudomallei [sequence omitted]

SEQ ID NO: 2633 - protein, 358 aa, Burkholderia pseudomallei
MKSSFSRALQTTFACAAVAALAAGASGACAQSSVQLYGQVDEWIGAQKFPGGQRAWGVQGGGMSTSYWGLRGTEDLGGGYQAIFTLEDFFRAQNGHYGRFDGDTFFGRNAYVGLATPYGTVRAGRLTTQLFISTILFNPFIDSYVFSPMVYHVFLGLGTFPTYTTDQGVVGDSGWNNAIDYTSPSFGGLNAAAMYALGNTAGDNRSKKWSGQLNYSSGPFAATAVYQYVNFNGGPGDLGALVSGMKSQGVAQLGLSYDFKLAKIYAQYMYTKNELNTGSWHVNTAQGGVSVPLGPGSALASYAYSRDSGGLDQTRRTWALGYDYPLSKRTDVYAAYMNDRYSGMSGGDTFGAGIRAKF

SEQ ID NO: 2634 - protein, 147 aa, Burkholderia pseudomallei
ADHDMKKGDIAVVWDPNWAWWEIGGWHFAFVAEGHLSYWRYTGDRAINSSIWEVGATPIIRFIKSAGYVRPFVELGAGVRFLSHPTISQNYSMSTSFQFADMVGVGAQFGNRQQYQAGFRFQHVSNAGIKDPNPGINFSQLYVQYNF

SEQ ID NO: 2635 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDARDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 2636 - protein, 770 aa, Burkholderia pseudomallei
MLGAIPIFGKKTQQPFKALPVVCRREAKDTGPWCKRLDFPGVSWRLSNPSFCRLSVVPSRNCRSTMTSKNMISLTRDRTMKRGAVASRRVRGVLAAKSLPALGLALASAGLWVAAPSLAQGIDLSPSAWVVDESPLTDEELAAVLPTGMTLEEFKRGMEAWAPGSVASLQPSAPKNGAAGAVGGEHGHSSDSPKVNVPSSEPSVGDASVGGGGGGSNSRHENGDGGVGNGKGGAGGSASGPGAVAGTAPGGAKHSDSGPSAGAPVSPGVAPGPGAGVASGMGASGSAGEAHSPPDKKVPAEGGQGKGPGAGTGGAGGSPVPGSGGGGSVPSGAAGGDSPPKPPSTGGKPGGGDQPPQKGEGNANGQAPDGGMDPVPPRDGDAGAKPPGSGADPDRPEGGGGDGAVPNLPEAGGNGPRPPAGNDDAGPRPPQGGDGNDAPAVPPAPPAPPAPPAPPAGNGVYDPGTHTLTTPASAAVSLASSSHGVWQAEMNALSKRMGELRLTPVAGGVWGRAFGRRQDVDNRVAREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFHAQGADYTASNGLRIKDDGTNSMLGRLGLHVGRQFDLGDGRVVQPYMKLSWVQEFDGKGTVRTNDIRHKVRLDGGRAELAVGVASQLGKHGSLFGSYEYAKGSRQTMPWTFHIGYRYAW

SEQ ID NO: 2637 - protein, 752 aa, Burkholderia pseudomallei
MKVRPSRPLCNLEQRKMEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNASRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAVDNSLTVPSYTLFDAALHYELRNWRFALNATNLFNRRYVAGCQSDAVCMYGNQRTVIATAKYNW

SEQ ID NO: 2638 - protein, 786 aa, Burkholderia pseudomallei
MSAQTVHGKGFGPFSPAVSTPAFTTLLSRSRKMERALSNVRRGSLAVLIGVLCVSGRSLAAPVAPPAGSDAVMRRAELPPVATEARFLAQQEPLVPVTPTAQTPDPEKPAPSPQQEEELEEVTVQGTRSYRVKRSSTATKTDTDVMDVPQSIQIVPQQVLLDQNVNTLTEALRNVASVTTEFRDGTGADFYAARGFQIGADNIRLDGFRTSTRTELYNVGIEQVEVLKGPSAVLYGDMEPGGLINLVSKKPQPVPFGTVALNVGSYGNVWTTLDTTGPLNAAKTLTYRLSTRQESANSFRDLVNGNKFFVAPALSWQISERLRWDLRVGYQYLFRVSEFGLIAPTREFSSVNTLPLNRFYGEPSDNVTSYQTNVTSTLEYKFGDDWTLRNLLGYSGYRVIWQPTQPLAVLEDGRTLERNQFVFDETTERYNAELNLTGRFATGAVRHQLFAGIDYTRSSRPSVFLDGPTTPIDLYNPVYTNPPRSLQPTSGSASDSSEFNNRFGISLQDQIDLGDNFKLLLGGRYSFYDAGRYQELPPQAPTFNNAQRFSPRVGAVWRPTDWLSLYASYSDAFTPASGRSATGQLFKPITGTQYEVGAKAELFGGGLLATVALYELTKQNVLTRDPDNPQFSIQTGEVQSKGFEVDLSGRPLPGWDIYASYAYVDARFTRDNVIAPGTEVGGVPRNTLSLWSKYEFGGDLRGLSVGAGLYWSDNRWNVFSTANLFQVPGYTTFDAMVAYRFDPRWKVQVNLKNLFNRRYYTDSDDSLVFIPPGAPTTVDVSLSYTF

SEQ ID NO: 2639 - protein, 214 aa, Burkholderia pseudomallei
MRRQTIRTCTTAIACAAGLAMIPSLSHAASPGEGINQGDIIARVRGISIMPDERTSNTLSALNVGVNNAIVPELDFTYMIRDYLGVELILGTSRHQITSSLGDLGGVGVLPPTLLLQYHFNHAGKVRPYVGAGINYTLFYNNGLHAGGEGIGINNHSFGPALQFGVDVQVTKKVFVNVDVKKIWMHTDATLGGQPLGRLNIDPLVVGVGVGMKF

SEQ ID NO: 2640 - protein, 355 aa, Burkholderia pseudomallei
MTTLRLRSPHRCRPPALAAAATLAALSGPAHAQSTLTLYGVADAGVQYLSRADGQHAAWRLQNYGILPSQLGIKGEEDLGGGWRARFQLEQGINLNDGTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSRGLSASAVLHRSHGTAQGGADRSAQRRDIGTFAARYAFASLPLTVHAGVQRLTGELDPARTIVWGGARYQASGRFGFAGGIYHTDSPTPQVGHPTLFIASTTCSLSKRTVAYLNLGYAKNSGRSAQTVYEYDPTPLAGASQFGAMLGMYHVF

SEQ ID NO: 2641 - protein, 610 aa, Burkholderia pseudomallei
MTIGSKTKLALGIALAMPAAAWAYTFYALGDSLTDNGRVVRLTGILPNATSTIFRGGRSSNGPVWAEYLPGLIGARFAPDDDYAINGALSGHGGYLNIIPTRPTWRTLPGFVDQVEQLIAAHPRLRRDDLVGVWIGTNDQDLTKASLNGIEPFLGVPRPANIAEMSAYTLTNLNAQLQRLIGAGARQFVILNLNDAGGTRPGYVDYNGKLPEDLARFSRQGVNVHLFDVSALLNQMRRNPSAYGLNDTPDVQCRYVPSCSGGSVELQNTYLTADGTHMMTSVHEYIARYLANQLNAPAAISTAPVLGLDVARAGALSALNAADGGPLGPARVAWSDRLSLFADVGYTRNFHGAAGGMNAFDSDVEMFSIGADYKLSEASRAGALLSSGNANGSLAGGQGRIGLHAYRLGVYHAFERAGLFVRAYAGAGWSRYRLDRAAVLPGAVRASTSGFDFGALVKAGYLFALGGVRLGPVADVGYTQLVARGYTEDGDPILAQNVGVQRLKGVSAGAGVRFAAPLAAIGLRAGELSAEAQLRHDAFGDRTLVTAQRYAPGLPIGTAVDGASATYERLSVALTVNPAKRWRGKLVVQTDLGTAQRRSYTLLALLGGTF

SEQ ID NO: 2642 - protein, 778 aa, Burkholderia pseudomallei
MFHQLAAPGARRRLAAACAAALAWPAAHAASTAAAVPADSTPAAAAEMTASGKTLDTVKVTAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSAIASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPDWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 2643 - protein, 379 aa, Burkholderia pseudomallei
MKKTLIVAALSGVFATAAHAQSSVTLYGLIDAGITYTNNQGGHSAWSQSTGSVNGSRWGLRGAEDLGGGLKAIFVLENGFGINNGTLKQNGREFGRQAFVGLSHEQYGALTLGRQYDSVVDYLGPLSLTGTQFGGTQFAHPFDNDNLNNSFRINNAVKYTSVNWAGLKFGALYGFSNNNQFANNRAYSAGVSYSYAGFNIGAGYLQLNNNFGPTVSNASGAVALDNTFVGKRQRVFGGGLNYTFGPATAGFVFTQSRVNRATAIGAGASGVSSGIALDGTFMRFNNYEVNARYAITPAWTVAGSYTYTAGFIENHHPGWNQFNLQTAYALSKRTDVYLQGVYQKVNNDGTGLGAYINGIGGMSSTEKQIAVTAGLRHRF

SEQ ID NO: 2644 - protein, 756 aa, Burkholderia pseudomallei
MSRAPHAPSRRRAFGRGFAAAARAAHGAPVAHGVHACFAAASRRSTAVECCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGARLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDVDLAFYARNLANRTYAASTSNGGAQWLLGPSRSVELVATLRF

SEQ ID NO: 2645 - protein, 209 aa, Burkholderia pseudomallei
MAGGFANDRLYGAALQYQRGGLTVGASYPKMNRARSADAAGAVTGDNTFDASSQRNVGIGATYAFSKALIGFAYSHVGVYDPTSNAYFTGTTRPAGGHWQSWKFDHFEINGRYRVTPAFYAGAAYTYTQARADSTAGAFHPKWRPLSTKLDYDLSKRSSGFAEGVYQHAQHAMNARTGTDFDHAYIPGAANIASGPNQYVVRPALLHPF

SEQ ID NO: 2646 - protein, 773 aa, Burkholderia pseudomallei
MARQPAQLPVSSPRLLASAIGVAITAGSAGHMVFAAEKTDSKATGNAIALDATAITGEAQDSTSYQVEKASSPKYTAPLVDTPRSVTVIPQQVLKDTGALNMQDALRTVPGITFGAGEGGNPQGDRPFIRGFDAQGDTYLDGVRDTGSQSREIFAVENIEVSKGPNSAIGGRGAAGGSINLVSKKAHLGNSFDGGFTWGSDQTQRYTMDGNYQFSDTAAGRLNLMSHESNVAGRDKVDYDRWGIAPSLAFGLGTDTRVNLDYYHLESNDTPDSGIPYTIPAGGSAVRTKSNPDKPYAGGDHSNFYGLDRDFRKGRTDTATFAIEHDLSDSLTIKNTLRHGTSMQDYILTQPDDSKGNVNNGSVWRRANTRVSNTETTTNQTDLFGNFYVAGFKNSFSTGVEYTREESSKSSYNVNTDTTPRTSAVTTNCNPGLIGAASGYNCTSLSNPNPNDPWNGAISRNYAGTDTQSDTYALYAFDTLELSEQWLVNMGLRYDHFETGYKTYTNAGTTTSKGSDTSEFVTGQFGIVYKPAENGSIYASYATSATPPGNTLGEGQEGNPLGGTPDRNGNLLKSDMEPETTKNYEIGTKWDLLNDRLSLTADIFRTEKENARVQVDTTSYENAGKTRVQGIELSASGKITDKWQVFAGYAYMDSEQVDGGDLPANKANNGNELPNTPKNSASLWTTYQVTPKLTIGGGAFYVDDVFGNVANTTMVDSYVRYDAMAAYKLSKNVDLQLNVQNLTNETYYDKAFSTHFANQAAGRTALLSTNFHF

SEQ ID NO: 2647 - protein, 251 aa, Burkholderia pseudomallei
MKIYQYLLFTTLSLLIITTVNAETISKNNIIVGYEFLLDAEENNPNLYDQPYFILGHSTSADWGNIAGWLRLENPTDSANTQQGTDAGSATKVWLKLDYNIGQSPFNTWVQSFTSSNKAAVEQDIYLGASYDINYAKIKGSFGLGMQYAYGSFAPTGKSFNGISGVGITLILGYPITPEWFTKLYYEAQIGRSTEHKDVLSYESYGHQFVLGIDYLLQPQLFASFLYKHRHSWGGAINDGGELFIEIGYTF

SEQ ID NO: 2648 - protein, 486 aa, Burkholderia pseudomallei
MFGRKFKRVLWRLLIVCSVLVVNTMRPCMAYGDELEELKGQLKQMEEAFSIQQKMLKQMEIIALSQQEQIKELKSRVESISEKPVVIATEEIKDEVKHEVENYLSSDEVREKLGIGLPDIPLLERSRTEADICDIFYTPDDSSYALSIRSHSGDYSLNIGGRLQMRYQYNDKDGDFGGVDTQNIDVRRARIYMGGNIYSKTINYYWAIDADSFDVQLRDFYLYWTPYKELNAKIGYFKVPFNREMVVSSQRLLFQDRAIASDAFGQYRDYGLDIYGRPFDGHIEYHAAVFQGAGDNPSKRITGKDENLDNEIMSVLSLRYNPFGKFNYYDGTDIGYSKTLKATFGSSVAFNGKKRDVKRDDTDIIVGVIDFGLRYKGIAWDSEYYMMTENPESDGGGDSVGSDGFFTQAGYFVIPKKLEIAARYSMVDPDDDVSNDIQREYTAGINYYFRGHRSKIQADFGTFITEQGDEQDKRENKYRLQYEIAF

SEQ ID NO: 2649 - protein, 236 aa, Burkholderia pseudomallei
MNKKLLTTAILAATASAAHAQSSVTLYGLIDAGVSYVNHSKSASGSDKLFKYDDGIAQGSRWGLRGAEDLGGGLKAIFVLENGFNSGNGTIGQGGAIFGRQAYVGLSHKDAGTLTFGRQYSFTTDILGANYSTGGNTVAGNYAYHVNDIDQLTSSRINNAVKFQSANYAGFTFGALYGFSNSTSFAGAPATTTGTTTTPGSSRAYSFGLNYANGPIGLGAAYTDIRYPSQATPAFT

SEQ ID NO: 2650 - protein, 1848 aa, Burkholderia pseudomallei
MAGIFRLVLIASPFTAVTSVSFAQTLPTDYLLALTDGSGANTTAYSTTGTLQTYTVSFTAQTTGTNYILFAFRNDPDYWTFGDVSLAVQGRTTNLLTDPYFLSGGTVSGSTNGIEAPASWGVVYQTGTPPNTAGTWQAPSSSAGASTPSLAAGTAGTWFDGAVGSFDGIYQGINLVAGDTYTISFTTSSGVASTATDGGVQLGVYTGPCTSLTSGANCTPAGGSGFTAAATPEQTINAGSSATPITTLQNASGLASSPATILPILDGGTLTLDGTNITPYSFSITGNNGTIDLAGQSATISNPISDQSSGVPGGLTIANSGTGGTLILTGANTYTGATTIDAGAALDLQGGSVAGALANAGSLTLDGGSVGGTLTDSGALAVTASGGTAASLAGTGTGTLAGTLTLSNAADSFAGTLGGTGGLTIAGGSETLTGANTYTGATTIDAGAGLNLSGSVAGALANAGTLTLDGGTVGGTLTDDGALAVTASGGTAASLAGTGTGTLAGTLTLSNAADSFAGTLGGTGGLTIAGGSETLTGANTYTGATTIDAGAALDLQGGSVAGALANAGTLTLDGGTVGGTLTDSGALAVTASGGTAASLAGTGTGTLAGTLTLSNAADSFAGTLGGSGGLTIAGGSETLTGANTYTGATTIDAGAGLNLSGSVAGALANAGSLTLDGGTVGGTLTDSGALAVTASGGTAASLAGTGTGTLAGTLTLSNAADSFAGTLGGSGGLTIAGGSETLTGANTYTGATTIDAGAALDLQGGSVAGALANAGSLTLDGGSVGGTLTDSGALAVTASGGTAASLAGTGTGTLAGTLTLSNAADSFAGTLGGTGGLTIAGGSETLTGANTYTGATTIDAGAGLNLSGSVAGALANAGSLTLDGGTVGGTLTDSGALAVTASGGTAASLAGAGTGTLAGTLTLSNAADSFAGTLGGTGGLTIAGGSETLTGANTYTGATTIDAGAALDLQGGSVAGALANAGTLTLDGGTVGGTLTDSGALAVTASGGTAASLAGTGTGTLAGTLILSNAADSFAGTLGGSGGLTIAGGSETLTGANTYTGATTIDAGAGLNLSGSVAGALANAGSLTLDGGTVGGTLTDDGALAVTASGGTAASLAGAGTGTLAGTLTLSNAADSFAGTLGGSGGLTIAGGSETLTGANTYTGGTTIRAGALTGTTTSFGSGAIVDNGIFNLAQNSDGVLTNTVSGSGILTKSGAGNVTLAGVNSYAGGTLLRSGTLTLTNASALGTGALNMAENTTLVLAGSNLALGNAIVLNGDPTVQVDSGTDSLTGTLVDGSTAGILVKTGVGTLVLNGNSTYSGGTEISGGTLQVDGSLASSVVADSGTTLSGNGSVGTTTIRSGATLSPAGSGAVGTLTVNGNLTMAAGSNYIVSVNTAGDHDSVRVSGHVSLGSGAITVLAADGTWNITHPNTIMTATGGVSGTFGTVVSNFAFLTSNITAGADGIVVNLQRNELNFADVSTTRNQTAVGVALQNVTSGQLYNELVQTDAATARHALGALSGELHASARTALIQDSFYVRDAAVERLRGTECAPGADSGMKTAASDGTRTDGTCRPDHASLWMQGYGTFGHNTANGNASAMSHSAGGFVMGADAPVVGWHVGGLVGYGHSAFDSGAAASYGHGNTISLGGYAGTHWGRLALRTGVSYSWNMLSMTRNVAFTGYSDRLNSGYDGGTAQAFGDLGYRMDLGPLMVEPFADVAYVNLHTDRFTEHGGAAALTGRAMDTGTTYATFGARLAGRLKVGGVTLIPNATLGYRHAFGLTTPTTRESFVQNGGAFDVAGVPLSTDAALLKAGLQARLTDRLDVGLTYIGQYGDQSTDSGVTGTLSLKF

SEQ ID NO: 2651 - protein, 719 aa, Burkholderia pseudomallei
MLIAAHPGAAALAGTAAKSDAQKNDMQRNENVREDTRRLAAGAPPAGGELKAISVSAPKDAADDPSVATVGKMPLALREIAQSVSVTTRERIEQQNLFSLDDVMQQSAGVTVQPYVLLTTAYFVRGFKVDSFEFDGVPVVLGDMASAPQDMSAYERAEILRGANGLLHGSGNPAATVNLVRKRPQHRFAASASASVGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERELGGGWKAKVSGEYQAVRSDLKYAGAYGAIDRATGAGGTLMGSAYQFSSYSRSVDANVQGPVRAFGLTHELLFGATYASSSSGQLTAPLLAGAGTPVNVYRWNPDGVPEPGVGPYRQDMQNDISQKGVYGLGRIKLAQPVTLVLGGRLSWWNQDSLGAHYNAGRQFTPYGGLIWDVARDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 2652 - protein, 363 aa, Burkholderia pseudomallei
MKKHRRIAGTTAISAGLATCASLASGHALAQSSVTLYGIMDAGIEYVNHAAPDGGGAFRMKSGNKNTSRWGLRGVEDLGGGLKAVFRLESGIDLANGAFDDGPDSIFARRATVGLAGKWGELTLGRNFTVTYDYMLPFDPMGYSQNYSWATSSTATGGRKDGLFTRSSNAVRYDGAYGGLRFGAMYGFGNVPGSMKTSSKYDFALGYKNGPFAAVVTFDRQNGAADSVTPADPVNYVQGIHAGVSYDFGHLKTMAGYRNYRRTYHTAAATQLSDTYWLGGSYNFTPAFSLTGAVYHENIKGATDADPTLVSLRAQYALSKRTMLYAAGGFAIAKHGQNVSVSRDSIGYASTQVGVTVGMQQRF

SEQ ID NO: 2653 - protein, 1047 aa, Burkholderia pseudomallei
MKKRTARLALFLAILGGPSAMAADFDVSNHNDSGAGSLRAAIEGLNGAGTGTHAINFASGLDPINLLSHLPTIVGTDQTITVNGAGNTVSGQDTARLFFVADGDVTFQNMTLKQGYAEGGDGGNSGGGGGGGAGAGGALFVNTGANVVISGVAFDSNKAEGGDGGDHDSSSDAGGGGGGFSGTGGSTSHDGGGGGGGFDGNGGIAHYYGGGGGGGVSGNGGDTSGDGGGGGGGIGNGASTSDDTGGDGDGGAAGGGDGDPGATGTPGGGGGGHQGAGGDGAVNGGGGGSGFAGSVAGNGGTFGGGGGGGGSTDGGDGGDFGGGGGGGFLGAGGDGGDFGGGAGTGYNGGSTGGSGGFGGGDGGRYSFGGDAGDAMGGAIFVREGGTLSIIDSTFTNNGLIAGTGGAGDTAPEDGANGQAIGSGMYLHTGVTAGYQVNTGTLTLADDIGGSGSLNKTGTGELVLSGTNTYTGTTTVSAGRLVVNGSLAGNTTVDTNSELGGSGTINGDVINNGTFAAGNSIGTMTIGGNASFNSGSTTEVEIQASATPIAGTDNDLITADTATINGGDVSVLGAVGSYTNGAKYTFLQTTHGLSGTFDTITDDLAFFDAQLGYDANSAFFTLMANSTDYASVGGSGNRQTVGFYIDENSIGASGDFGSVLDEFRVLTNAQVQSGLSQLSGEVYGSQSQVVIQGTNQLVGTIGGQLRSGMFGGGSGGSGSSGSGFVNATRSTRPSVTGSSSDIALVSYVNASSTQTPCDALIAPTCHAAYHWKGWMTGYGLGGSAESDGNAAGIHYGLGGTTFGIERYLGDNARLGFFGGYVGSSVSADSMDQTVRANGGNFGSYLTHSAGSHYGIAMGGLQFDGYESDRTIQVGALTRTASGESDGWQGFAYGERGMNLNLSRSRVLQPFAGLQYVYARQNAFTETGAGAMNLAMSGVDTHSLRSNLGTRLQWQSWMSRRGWAITPEIRGSWMHEFLDTTSVVNAQFAGVGGAGYTANGLDLGRDWAILGGGFEARPSDRWELRADYNTQFNENQVLHIGSGTLAYRW

SEQ ID NO: 2654 - protein, 358 aa, Burkholderia pseudomallei
MAVAGIGIGAAVPPALAQSSVRLYGIVDSGITYTNNQKGHSAWKATSGNEQAARWGLVGREDLGGGTSAIFRLENGFDIENGTASQGGRLFGRRTYIGLANDRWGAFTMGRQYNAVQETLAPLHIATVLGRYAHHPFDADDLDSTFRTNNSVQYQTPDWGGVRAIATYGFSNSTSFARNRTWSVGASYARGPLQLAAAYVRVDYPAIDATGAIASDNYYGFVKGVARQQIWGAGGAYAWGDATFGLLYTSALFSLQTGGAERFNNFEGSVRYRVTPAVQVALGETYTQVLASHAAAHDAHYLQTSAGIQYFLSKRTDVYLNVSYQRASSNAVAWIKGLDGASSTRTQIVAVTGIRHKF

SEQ ID NO: 2655 - protein, 384 aa, Burkholderia pseudomallei
MKNIRFACATAGVLAATAAHAQSSVTLYGLIDAGIMYTNNVASGNSHGGLVQATTGAVNGSRFGVRGTEDLGGGLKALFVLENGFNAENGKLGQDGRLFGRFAYVGLSDNRFGTLTIGRQYDSLVDFVAPLSATAGTFGDASFAHPFDNDNLNHSLRINNAIKYTSNTYAGLKFGGMYAMSNSTDFATNRAYSFGASYTRGPLNVAAGYLQINGSKGTTAGSPGTVDIVESAANGKGGFSLGADRMRSYGGGLNYAFGPATLGFVYTRAEYENTASFGSTGGTVRFNNYELNGKYQLTPAFSVGGAYTYTDGHVENTVKYGSDPKWHQVDLMAVYRLSVRTDVYLEGMYQHASGRNYVAMINTAGGASSTGNQVVAAVGLRTRF

SEQ ID NO: 2656 - protein, 400 aa, Burkholderia pseudomallei
MHIRTWIAAGVAGAAVAPACAQSGVTLYGTVDTGVIYSTNQQVTHADGSTSGGHAWQMGGGNLVPSRWGLQGTEALGGGLKAVFALEQQFLSASGQALQGGAAFSRQAWVGLRHDRYGTLGVGRQYDSYTDTLGAYVSSNSWATPYGSHLGDVDNLNAAFNFNNAIRFTSADFHGLTFGGTFGFGGQAGDFSARRGYALAVAYNRAPVSFGIGYLNLRQPLDAALGGANGYIGDFACGNAGAMYCLLQDAVSMKAFGVGGSIAFGEATVALTYTHTRLGDSAYFAAAARAQRASIAFDIAELNATYAFTPMLRGGIAYVFNRAKADSRGVTRFHQLNVGVNYSLSKRTALYAVAIGQIASGRGLGSDANGDPVNYAQIPVLANSNSNRQLAMMAGVKVDF

SEQ ID NO: 2657 - protein, 374 aa, Burkholderia pseudomallei
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHPLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTIRADNYEANVKYNLTPALGLGVAYTYTNAKANGESAHWNQVGVQADYALSKRTDVYAQAVYQRSSKNANASIYNGDLSTPFSTSINQTAATVGLRHRF

SEQ ID NO: 2658 - protein, 966 aa, Burkholderia pseudomallei
MVKGTTNGTVTDLDGKFTLKVSAGDILEFSYIGYASQSVTVTNANSLNITLSEDTQALDEVVVTALGIKRAEKALSYNVQQVKSEELVRTKDANFVNSLNGKIAGVTINKSAGGAGGSTRVVMRGAKSIEGDNSALYVVDGIPLFNTTLGTGNDVLGEGRATTEGIADFNPEDIESISVLSGPSAAALYGSSAANGVILITTKKGKEGKFSISFSSSSEFSKAYMTPEFQTTYRNKSGIYESWGDLMTTPTSYDPKDDFFNTGTNFINSLTLTTGNKNNQTFASISSTNSKGIVPNNEYDRLNFTIRNTSTFLNDKLQLDLGASYVKQTDQNMVSQGQYWNPVMAAYLFPRGESWDAIRIFERENSARNISEQYWPISEGTYASQNPYWTAYRNVAPSEKSRYMFNVGLTYKIFDWLNVAARYRMDDSYIDFERKIYASSYDVFTEGSQKGLYEYNHYKDRQEYADFMVNINKQIKDFSLSANLGYSYSNYWAELSGYRGPLALIPNKFTAGNINASKARVIEGEGDSRVRNNALFANLELGYKSMLYLTLTGRNDWNSRLVNTDEESFFYPSVGLSAIVTEMFDLPDFISYLKVRGSYTEVGSPVSRSGLTPGTVTVPIEGGALKEDMIYPFTDFKAERTRSYEFGLSLRLWNKLSAEVTYYKSNTYNQTFLGDLPESTGYKQIYLQAGNVQNRGWEASLGYNDKFGDFSLSSSLTFSRNINEIKEMVENFHTDITSEPINIPEVRKDNGRTLLKVGGSIHDIYADRFFKKDSQGFVEIKEDGSYGMENTDPVYLGQVAPKFNMGWNNSFSYKGFGLSFLINGRFGGVVTSSTEAILDRFGVSKASGEARDLGGALLPGQGRVDAEKYYKMIGTGDYHTSGYYVYSATNIRLQELTLSYTFPNSWFKNVLKDVTVSFTANNPWMLYCEAPFDPELTPSIGTYGQGNDYFMQPSVRSFGFGIKLKL

SEQ ID NO: 2659 - protein, 1131 aa, Burkholderia pseudomallei
MLMTRHKKRKMMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASDGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVRETALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 2660 - protein, 240 aa, Burkholderia pseudomallei
MGFNKQAVLLSLMGFYTGLNALDYDTLDPKYYKYIKYYKAYEDKEVEELIKNLKRANAKSGLILGINTGFFYNHEIMVKTNSSSITGNILNYLFAYGLRFGYQTFRPSFFARLVRPNIIGRRIYIQYYGGVPKKADFGSVGFQSVMLNGDFLLDFPLPFVGKYLYMGGYMGLGLGVVSHGINYTAEWGMSFNAGLALTILEKNRIEFGLKILNNFPFLQSSSSKETWWGAIANIGYQYVF

SEQ ID NO: 2661 - protein, 881 aa, Burkholderia pseudomallei
MDSICNRRPRRAHAGVCADTAHAPAGLPEAAQPAARLGAGRPRDAAAPRCARQATSHTSHASHTLHAPCMPQFAPRRVVARVAAAALFSACAAPGVSGAAEPAAATRGYDIPAGPLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYADNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 2662 - protein, 748 aa, Burkholderia pseudomallei
MKSRSDELKLGKFTTLCSVLAASPAFAQDAAPPAASADHDKELAPIQIKGAAEHSYKADFSSSVKFTAPLVDTPKSVTVIPQELIHNSGAATLTEALRTVPGITFGAGEGGNPLGDRPFIRGYDTQGSMFVDGMRDTGATTREIFNTERIEITKGSDGAYGGRGGAGGSINLVTKAPHLGTTAEASAGLGTDRYRRFTADGNWQFADHAAFRLNLMSHNNDVAGRDAVNNERWGVAPSIAFGLGTPTRVSASYYHLSTDDLPDGGIPYFYTTANKPANVDTIYPANVDRHNFYGLVNRDFRKTTSDIGTLRIEHDITPSLTVRNTTRYTESTQDYIWTQPDDSQGNVVNGRVWRRNNNRNSAINSIANQTELFGEFRTGPFKHSFTTGIELSREWGKRDSYSVATGTGKICQQGIGAASGYNCTSLGSPNPNDPWAGSITRNNDYAHARTVTKSLYGFDTVELSKHWQVNAGVRVDDYSTRFIDTRANGGKTYTRDDTLVNWQLGLVFKPARNGSVYASYATSSTPAGALLGEGSETQSLTPGRGGVGANADQLAPEKNRSIELGTKWNVLDDKLSLTAALFQIDTTNARVTLPNNQYAMVGNKRVQGLELGFAGQLTRAWQVFGGYTYMKSELRDNGRNTADNGHQFPNTPKHSFTLWTNYDVTPKFTVGGGAFYMSKVFGDTANLRAVPSYWRFDAMAQYRINKKLDLQLNVNNLFNRTYFDQAYPAHYASIAPGRSAFVTLNARY

SEQ ID NO: 2663 - protein, 1374 aa, Burkholderia pseudomallei
MVDGYVSGGSGGTPKSTGDYTKGQVPEGSPGGGVYMRSSTTVNLSSTGSILSGAISTPKMKSPPALILDGSDSVINNQGTIARLFPSIPELFSVDANVVPAIYVRGDRNYIINSHIILGNATINNGQFASTSEAIEFDGNDNTLELWGGQSMRGVVRVTGGGTGNHLILGGANAGTFNFGLLDQIDPGSENRQQMGYMGFVDFVKNGTSTWSGSGASMATGPWTIDAGTLALTDDGSLASHASVTLNANLDISGITNSTTMQNLSGPANSTINLGSKTLALKNTTTQTFAGVASGAGGNIELDQGTVIFTGDNTYTGTSTIAAGATLQLGTGGTIGSIASDAAVNGQLIFNRSDSFTYDKVISGTGSIQKLGAGILTLSGNSDTYTGSTSVDVGGLFVSGTLGGMVAVKGGTSLAGTGTIVGDTTIADGATLIGQQNHTLTFQNNLELASGSIVNVTLGKAPNAPGLFNVLGDLTLNGTLNIQDMGDFGPGLYRLFDFGGTRSGNLTLGSVPTGTDPSLLQLITTTPNQYNLFFGGQPGFNIWDGGNSADHDNGAVDGGDGVWDAANNNWTKLSGADNGSWVNGALAQFGVKAGTVTISDNPITIQASGLVFSTDGYLLTGSSIILDDPVDGIPTVRVGDGSRAGAAMSATIESEIKGNQGLKKVDFGTLVLTGTNSYTGTTTVGEGTLQLGNGTATGSIPGDVIVDSNSYGYGTLAFNHSSAVTFGSSISGGGKVVQKGSGTTTFTGNNTYSGGLTVEQGTAEAGIADNAFGSGPLTVQAGAKADLHDFNTSVGGLIGAGDVTLGSGTLTVNQGFDSIFSGVISGDGGLNKSGAGQLTLSGANTYGGATTIDGGVLLQGESGAFSSSSAYRTGASGTVDLGGFDTNMASLDNAGLVNFGGTGCATLHIADNYVGHNGIVAINTVLGDDNSLTDMLKVEGNTSGTTSLKVINRGGVGMQTANGIKVVEVVGQSDGVFSLLGDFTTADKQQAVVAGAYAYTLHQGSVDNLDGDWYLRSQLKDTPTPTPTPQPQFNPGVPLYEGAVQNMQRLNRLPTLQQRVGNSYWNGPSYPAIEQGGAPAGADPASSPVAGVVTSDNGIWARIGGDYSKLQSSRSLTNMSQNIRTVIIQSGVDGKFYEADTGKLIGGINALYGSAISRINSPSGDGDATTSAWGLGGTLTWYGESGFYVDGQAQINWYNNDYNSDTAGKGLADDKKATGYAVSIETGQRFNIGERWSVTPQAQLMWSKLSMDTFNNIWEANVSLNDSDSLIGRAGVALDYRNAWQDDAGQIVHTNIYVIANIYQEFMGNGRVGVADTTFSVKQDVTWGGVGLGGSYAWADNKYLIYGEGAINTSLNNFADSYDVRGTLGFRVRW

SEQ ID NO: 2664 - protein, 745 aa, Burkholderia pseudomallei
MTSTFLRHAPAARGDHARRRRRAITLTVPALAAGAFHLAPAVAQTSEAVHGHGTLGASGVASRAETDAASAKSDGAVREAASRTTTGAAPDATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKRDKLDAWVSAYAGYVQDFILFDYATGPMGQTTRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 2665 - protein, 698 aa, Burkholderia pseudomallei
MDDHRRIAPPFARRLHPLSLLLAASLAHGETGTPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGKLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 2666 - protein, 359 aa, Burkholderia pseudomallei
MDKRLSALCGLGLASAGACAQTSVTLYGVADAYVEYATNQADAKGEPAALARMGSGGKSGSRWGIKGTEVLGGGWRAAFRLESGVNLNNGAGTGAVGFDRSAWVGLEHPRWGALRFGRQYTTMFDIMEHYSPTGAYSTLYEPDGAIVGISFRENNVVKYLATAGPLTFEAHYAFSNEPGAFQASAAHGAGFEYTGGALSFAFAYDDVHTPQAGGFAYLRRYAAAAMLTVEATQLIAGAAHGQGNVATPSVVTRYTFWWIGVRQAITPVVQLIGALYAERVRAQNPASPPAARHASGTPQQATLQLNYFVSKTTTLYAATGYARHAALDFDNYNYGFLHYSLAGARAGSAGVAVGVRKLF

SEQ ID NO: 2667 - protein, 354 aa, Burkholderia pseudomallei
MGATTWPIAIGLALAGPAFAQSPVALYGIVDQSVRYTTHASAANDSAVQMANGAITNSRWGMKGAEDLGDGLKAIFRLENGFEPQSGQADGARLFGRYAYVGLSGRLGTVELGRQTTEGFNLFGDLDPLTIGNYTANMWPYFLTQGYANNVVSYANTLGGLAVGASYGLGGVAGAMSRNAYWGVRSAYTHGALTVGAVYQQTRDADGRAQQMWGAAGRYAVGPATLFAGYIGGKDATGAIDRDYLNAPGRTVAYGSFADHPRYDAIGYAGVAYRVDPALMLTGAFYYDAIRNVNGVGGNGGKRRAGVLEAEYALSKATQLYASADYNQVCGGAATEMPGRGNQTGVALGLRHMF

SEQ ID NO: 2668 - protein, 886 aa, Burkholderia pseudomallei
MPAAQDTGAPAKLETIEVTATKRSESIQDVPVAVSALDGKALENLGIDNFQDYVEFLPNVVFQGTGPGQNEIYIRGAATTQSSITLSSVQALQPSVAFYLDEMPVSMAGRNLDIFATDVERVEVLPGPQGTLFGASSQAGTVRLITNKPDHSGFAAGFDTSISTTKGGDMSNTVEAYFNVTPTDNLALRVAAYNESQGGWIDNIENDPNNGGYIGSAVVIDRISGGALQAQGIDPADMDARREINGFNRSEAAVVTPRNSEHVEDNFNDAVYSGARFGLSYIINEDWDLLVQHTEQTLDTEGVFAYDPTVEGESSAIRFQSDENSDEFGLTTWTLNGRLEKLDVVYTGGYLDREIDTLTDYTGYTNGGLFSAYYVCTHYETPDNPDDARCLDPSKYYKEDTTSTRLTHELRFSTTMDTPWQLTAGVFYDEQEVGSVGQFKIASPEIFENLASSWNALAGDRGINSDGGPFSPEISFVNDVTHTIEQIAVFGQLGYEITDTVTATVGARWYQIDDIYRGATSTRDVTSRLEAYGQGVLDPAVYDDLGLDGQGVVDAIQDGSLDIGLLGDDGVLTVDDTIFKFGLDWKVNENVLLFANYSEGFRPPVTNRLGGDAAANNTGAFADFRVPVYSTTDTLDNYEIGLKGDFLDGILRVNATGYYSEISDLQTSRFDPTNISFLVFTDNVGDAEVKGIDADITWLASDNLIINAAFSVLDTELVSINSELEGIAAGVGSKLPYSADFSGNISARYFFELDGGKEGFVNASLTYTGDRLAGMVMNAYAMEDATRLIYGTGSGLKIEDEGEVFNGATYPGADGETIRGGRYIQESYVIGNVSVGMSYESWKVEAFIDNVFDKSAILNIDTQQYTPKVVTNRPRTIGLRFSYDYY

SEQ ID NO: 2669 - protein, 377 aa, Burkholderia pseudomallei
MKQTTKITGLIGGAMLAIAGQQAMAQSSVTLWGVADVSLRYLSNSNAQNDGRFFMTNGAITNSRIGLHGSEDLGGGLKAIFNLESGVNLQDGAFSDSKRIFNRAAYVGLTSQYGTVTLGRQKTVLFDLLSDTYDPLTVGNYLENAWLPVALGAGLYADNSVKYRGTFGGLTIGAMYSFGTDSTATGAGGFSGQLPGHMGAGNMYGFSLSYVAGPVSVAAGVQQNSDNSNRKQTIYHANVVYAFSKAKIYAGYLHSKDDTGFVDTVLAQQPGLFTSGAPKRTGRIDDGPFAGVSWQATPALTLTGAFYYDRMRNATIANGQLDSGNRYTVVGLVEYALSKRTEIYGTVDFNKVNGAATVEMPGRSNQTGVAIGLRNIF

SEQ ID NO: 2670 - protein, 180 aa, Burkholderia pseudomallei
MKKKTIFQCVILFFSILNIHVGMAGPEQVSMHIYGNVVDQGCDVATKSALQNIHIGDFNISDFQAANTVSTAADLNIDITGCAAGITGADVLFSGEADTLAPTLLKLTDTGGSGGMATGIAVQILDAQSQQEIPLNQVQPLTPLKAGDNTLKYQLRYKSTKAGATGGNATAVLYFDLVYQ

SEQ ID NO: 2671 - protein, 358 aa, Burkholderia pseudomallei
MKSSFSRALQTTFACAAVAALAAGASGARAQSSVQLYGQVDEWIGAQKFPGGQRAWGVQGGGMSTSYWGLRGTEDLGGGYQAIFTLEDFFRAQDGHYGRFDGDTFFGRNAYVGLATPYGTVRAGRLTTQLFISTILFNPFIDSYVFSPMVYHVFLGLGTFPTYTTDQGVVGDSGWNNAIDYTSPSFGGLNAAAMYALGNTAGDNRSKKWSGQLNYSSGPFAATAVYQYVNFNGGPGDLGALVSGMKSQGVAQLGLSYDFKLAKIYAQYMYTKNELNTGSWHVNTAQGGVSVPLGPGSALASYAYSRDSGGLDQTRRTWALGYDYPLSKRTDVYAAYMNDRYSGMSGGDTFGAGIRAKF

SEQ ID NO: 2672 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDARDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGEDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 2673 - protein, 790 aa, Burkholderia pseudomallei
MMKKVIFLSMLLAFCMLAYGQTYRIEGTVIDKTSRKPLEFVNVLVVGLGIGSSTDAEGHFSVEQVPPGIYRLQASMLGYKTVFTSEYRVNHRTPHIQIEMEEEGTQLEGVTVTASPFQKVAESPVSLRVIGLQEIEKAPGANRDISRVVQNYPGVVFSPIGYRNDLIVRGGGPSENRFYLDGVEIPNINHFSTQGASGGPVGLIDADLIRNVKFYSGAFPANRGNALSSVLDFSLRDGDMEHNSLKATLGASEVSLTSNGHLGDKTSYLVSVRQSYLQMLFKVLGLPLLPAYTDASFKLKTRFDARNELTLLGLGGIDRMKLNFDIEGEDAEYILGYLPKINQETFTLGGVYRHYAGPHVQSVTLSHSYLNNRNLKYHDNDESSEDNLTLRLRSVEQETKLRMENTSTWNLWKLNAGVELNYSQYSNTTYQRVFTDEVQIFDYRTNLDIFRWGLFASMDYSAPDERFTASLGVRTDGNNYNDKMKELWRQLSPRLSVSYRLIDRLFLSGHMGLYYQLPPYTALGFKGNDGSYLNRNLDYISVSQESVGLSWQPNENMEISAEGFYKFYRDMPLSVSDGIPLACKGNDYGVIGNEQLISTAEGRSYGIEMMFKWLLVQRLNLSSSLTIFKSEFRDGKEGDYVPSAWDNRFIFNVSGTYNFPKNWSVGMKISCIGGSPYTPYDVEKSSLVEAWNAQGKAYYDYDRYNTERLPAFGQLDIRVDKMFYWKKCMFGVYLDIQDITASKLRQPDVLMSTGQIENPTAPLSERRYVMKSIKQESGTLLPTLGITFEY

SEQ ID NO: 2674 - protein, 145 aa, Burkholderia pseudomallei
MTTEPFQASNTNRHVIGAACAAVLGATATAAAHAQSSVALHGLLDASIAYTNTQSGKHAWQQGRGLPSNTVFGLRGSDGPGARLRVAPRAGRIVDAYASRGDDRHPASVPTVRSDGAPRTPPSVRRANSACRRRGRKHIGGPDRW

SEQ ID NO: 2675 - protein, 407 aa, Burkholderia pseudomallei
MSARAARQLPGNRRLARLAGAAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGPFGNNAAWSAGLSYANGPLKLGAGYLRINRNPNAANANGALSTTDGSATITGGSQQIWAVAGRYAFGPHSIGAAWSHSATDRVSGVLQGGSIAKLDGNSLVFDNFTLDGRYVVTPRLSLAAAYTYTMGRFDARSGETRPKWNHMVAQADYAFSIRTDAYLAAVYQRVSGGNGIPAFNATIWTLTPSANGNQVVVALGLRHRF

SEQ ID NO: 2676 - protein, 806 aa, Burkholderia pseudomallei
MKKLLGAVSLAALTAATAYAQSADNDDVIVVVGTRSEGRTALETTAPVDVVDVSALENTGITELNAALAYTLPSFNFPSPSITDGTDHVRPATLRGLGPDQTLVLVNSRRRHSSALVNLGGSVGRGSAAVDLNTIPTSAVGSVQVLRDGASAQYGSDAIAGVIDVQLREASEGGQVSATYGQYATDIPLTTGERSASDGDTLNVSGWVGLPLGRDGFLTLSAEYLDREPTNRAGPDSRQQYPSLPGGGLDPRELSFDRINHRFGLAEAEAFSFFANAGLPINATTELYGWAGYQTREGEAAGFYRRAQDSRNTPAIYPDGFLPLITTDIEDFSAVGGARGEWAGWDWDASLGYGRNELGYGVENSLNTSLGASSPTSFDAGALIYDQITANLDFVRSYDLDAFAGPLSVAFGAEYRLEGYEIQAGEEASYITGDPTKAGGSQVFPGFQPSNEIDEDRDSIGVYLDLEADVTDRLLLTGAVRAESYSDFGETVTGRVSARYELTPSLALRGAISNGFRAPSLQQAYFTSTSTVFTGTPPTPVEVGTFPADSPVAAALGGEPLDAEESVNYSGGVVFTQGAFSLTVDAYAIDIDNRIVLSENLSGATVENLLQAAGINGVTSARFFINGVETETRGIDIVATYGVGTERYGDFDFTLGYNRNDTEVTQAPSSEVLPGVTLFARREIARFEEGQPDDKLIASMTWSRGAFGGVLRATRFGETVDPGSAADGSGDEVLDPKTIVDAEFSADVVEGLTVSFGANNLFDEYPDATSLNPNLAGTFSDIFPFSGFSPFGFSGRYVYGRIRYTW

SEQ ID NO: 2677 - protein, 355 aa, Burkholderia pseudomallei
MTTLRLRSPHRCRPPALAAAATLAALSGPAHAQSTLTLYGVADAGVQYLSRADGRHAAWRLQNYGILPSQLGIKGEEDLGGGWRARFQLEQGINLNDGTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSRGLSASAVLHRSHGTAQGGADRSAQRRDIGTFAARYAFASLPLTVHAGVQRLTGELDPARTIVWGGARYQASERFGFAGGIYHTDSPTPQVGHPTLFIASTTCSLSKRTVAYLNLGYAKNSGRSAQTVYEYDPTPLAGASQFGAMLGMYHVF

SEQ ID NO: 2678 - protein, 610 aa, Burkholderia pseudomallei
MTIGSKTKLALGIALAMPAAAWAYTFYALGDSLTDNGRVVRLTGILPNATSTIFRGGRSSNGPVWAEYLPGLIGARFAPDDDYAINGALSGHGGYLNIIPTRPTWRTLPGFADQVEQLIAAHPRLRRDDLVGVWIGTNDQDLTKASLNGIEPFLGVPRPANIAEMSAYTLTNLNAQLQRLIGAGARQFVILNLNDAGGTRPGYVDYNGKLPEDLARFSRQGVNVHLFDVSALLNQMRRNPSAYGLNDTPDVQCRYVPSCSGGSVELQNTYLTADGTHMMTSVHEYIARYLANQLNAPAAISTAPVLGLDVARAGALSALNAADGGPLGPARVAWSDRLSLFADVGYTRNFHGAAGGMNAFDSDVEMFSIGADYKLSEASRAGALLSSGNANGSLAGGQGRIGLHAYRLGVYHAFERAGLFVRAYAGAGWSRYRLDRAAVLPGAVRASTSGFDFGALVKAGYLFALGGVRLGPVADVGYTQLVARGYTEDGDPILAQNVGVQRLKGVSAGAGVRFAAPLAAIGLRAGELSAEAQLRHDAFGDRTLVTAQRYAPGLPIGTAVDGASATYERLSVALTVNPAKRWRGKLVVQTDLGTAPRRSYTLLALLGGTF

SEQ ID NO: 2679 - protein, 778 aa, Burkholderia pseudomallei
MFHQLAAPGARRRLAAACAAALAWPAAHAASTAAAVPADSTPAAAAEMTASGKTLDTVKVTAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSATASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 2680 - protein, 290 aa, Burkholderia pseudomallei
MRGPRAHRAIEVSGDLMKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGHGVIRPPGPSGSLGNVDLDKPANQPAVKNARQWSPTIILNYYFNAPTAKFRPFVGIGVAYSWFSNIELNGNFAKDINDNLGSVLAAGAGKPGPTSVEGKASSSFTPVYNIGASYAIAKHWALTATLSYMPLKTYSSLVIKAADGTTLATTRTRLKADPLITFVGISYKF

SEQ ID NO: 2681 - protein, 756 aa, Burkholderia pseudomallei
MSRAPHAPSRRRAFGRGFAAAARAAHGAPVAHGAHACFAAASRRATAVERCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGPRLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFSQRVGDTVVQRAGNVPHDIAQQSANLWIGWAFAPGWRANAGLRYVGPRYGDDANRVPVPSYTVFDASLAWRATRDVDLALYARNLANRTYAASTSNGGAQWLLGPSRSAELVATLRF

SEQ ID NO: 2682 - protein, 1667 aa, Burkholderia pseudomallei
MTNTTSPTQAPLTAPLAQPKRPRKASALLLGTALGAIVGLGYGRGAYAQTILSGTNTVTLDLDGPGEFVTDDTFSVDTSGDGNADGISITTEFGDTAETVFTDNNASPITGGEDGIDAKTNNIGQGAIRITTSGVVIGDQKGILAESDEASLYISASRRVQGTNDDGIVASVERDDASASLYIEVSEVYGFLYGIDARNYASGVLQITANGHVEGKDDSGILAKSQKETDVVIDVQSVTGKNAGIYAYTRGSGDIIIKATGDVTSYGGNFSNNEGIRAVSGGALSITTDGTVKSQDGYAASEGIYARASGVGAAGAEDLAGNSLDGLSLAITTNNVTGETDGIYAVNDGTGALSITTTGAVTGNGVYGAGIRADNSGTNLTIEAANVYGNYDGIIADNSGSGELQIEVTGKVTATNNYGITAFNRSTGTNATIEVNDITSFDFGIYAKNYGSGAIDITATGDVENSGSTSAVYAYNSDNGTSLDVKVNNVRSPDNDGIRAYNKGSGDLVISATGSVEAGDTPGDDGIFANNYNTTTGDIEITANNVTATSEAIKVENNGSGSIRVETTGRIEGGYHSAISLLNFSNTSKDLVVSANNVYRTGRDGSTSGSGAAIEAKQYGSGALSITSTGNIVDDFYSGIYARAYGVGAADTTDLAGNSLEGVSLAIDANNVTGGTDGINALNEGSGSLSITTTGTVTGTANDGIYANNSSNSTGDLTITANEVVSDSVGIYADNDGSGALKIEVSGTINTSSGGASNETNRSGARAAAGIYANNAAIGTDLIIEAADISGESYGIYARNFGTGDLHVTATGVVQNESTSYGISATIEADTSTSDVILDVNSVIGNEVGSGGGGIIATNEGAGDIHITTSGIVSNANYTGIMMAPTSGNVYAEINGDIEAGYNGIWTWVYGEKTVINVSGHIRQTGASTYQNGSSYYAVGGISVYGGSNEKGVAEEITITTNDITANGHGIRPRHYGNGPLTVTSNGDVNSQGGRGITAYHGGAGSVTITANGAVSGGNVIENALCCYNGTGIYAKHTGTGTIDITANGAVTGGTGDGIYASNASADDTTITINETGSVSTSGTDADDWAIEANAPNGAIIVNNSGTVTGRVNLTNSNSFTNSGTWDLAGTTSDFNANGSSLVVNEGLIMAALPNPAETTTRSILSNLDNFRSDVGGIIRLSNGVAGDIFEISGGTGTGNFVANGGTVELDVVLGGDNSAADKLVVSGDVILDSAPTALDIKSVGGGTGADTTNGIEVVSVGGTSDEGAFVLARIVEIGAFAYELAKGTCGGEANENWYLCSGPRREPPAEPEPETETDPTPEPPAEPEPETETGPTPTSQGTIGTTGAVFEAMPGIILATFARSDAMQQRLGARVTGVRGTISTRGAGDLPVDKAVGPWMRVWGDFADITPETSTARSSWEVNSWGLEAGIGAKLGEHVGGDLVGGVNLRYGASSANLRNPVGTGSFDSEGFGLGTSLTWFGNNGFYLDAVGSVDFVSIDATSQGGGELLNGYDDVVYSASAEIGKRIELQGGTALIPQAQLSWGKMRDGQLTDNLGNVISFADRETVTSRFGLTVEQDVTDTAFGSGKIYGFGNVLNDLSGSRTQTVAGTNVTQSGTGDWVELGGGFSLRPSEGTNLFGQVSYREAFDGVSGEAIAVSAGWKMQW

SEQ ID NO: 2683 - protein, 759 aa, Burkholderia pseudomallei
MARRPLRAALFGAFGLYAAAARAAGPASEPAAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEVSPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRQYWNWSDVRGIAADSNVLDAYTAPGRSVAVSMKVDF

SEQ ID NO: 2684 - protein, 867 aa, Burkholderia pseudomallei
MVADRSRRDKKHNKQLRAKMMTIQDTKKFGLSSLSLAVSLALTGVMGASAAWAEEAQEEAQASDNIEKIAVVGSRAAPRSVGESPVPVDIIGNEEFTKNGTTDMNDLLGKVVPSYNVNAQPISDAATLVRPANMRGLAPDHTLILLNGKRRHRAAVISFLGGGVSNGAQGPDISVIPAVALKQVEVLRDGAAAQYGSDAIAGVINFQLKDNAEGGTIEARYGEFYEGDGSSPMIAANVGMPLTDNGFFNVSAEYKTADATSRSVQRDDAADLIAAGNTAVANPAQIWGAPETKEDFKFFFNAGLDLNANQTAYMFGNWARRDVEGGFYFRNPNNRGGVYSGDDGETLLVGDLTGDMSGNCPVITITNNVPDPVALAQVKNDPDCFVFNEMFPGGFTPRFGGVIEDTSLSAGVKGTTASNLNYDFGVSYGKSDADFYIKNTVNASLGPDSPTDFNPGRYVQMERGASLDFSYFEVDEWSFAAGLEFRRETFEIYNGDPASFELGPLYTQGFGIGSNGFPGFKPQDSGSWSRNNYAAYFDAEHDLTDSWLVTGALRYEYYDDFGSTTNWKLSSIYNVTDDFSLRAAASTGFRAPTVGQSNVRNVTTAFSGGQLEDQATLPPTNPISIQKGATPLEPETSVNLSFGAVLTVGEFFLTADYFHITLEDRITQSSNQELTQADKDALIAQGVLDANSYSSVLYFTNDFDTTTQGVDLVASYAPDWLDGANFALAYNWTETTVDRFNPDNISEARVKVLEEALPHHKGTLTWTQELGANLRSMVRMNYYGEFYEDHLDSEGDLPIYNGSTVTFDAEVGYDFNDNWSLAVGAQNLFDTYPDDNPWAGIAGAAYPVTSPYGFNGGYYYARLNYNF

SEQ ID NO: 2685 - protein, 89 aa, Burkholderia pseudomallei
MAGIGIGAAVPPALAQSSVALYGIVDSGITCSRNQKGRSAWPATSGNERARVWGLLGREDLGGGTSALFSLRTGGAGRFNHFEGSVRTA

SEQ ID NO: 2686 - protein, 719 aa, Burkholderia pseudomallei
MLIAAHPGAAALAGTAAKSDAQKNDMQRNENVREDTRRLAAGAPPAGGELKAISVSAPKDAADDPSVATVGKMPLALREIAQSVSVTTRERIEQQNLFSLDDVMQQSAGVTVQPYVLLTTAYFVRGFKVDSFEFDGVPVVLGDMASAPQDMSAYERAEILRGANGLLHGSGNPAATVDLVRKRPQHRFAASASASVGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERKLGGGWKVKVSGEYQAVRSDLKYAGAYGAIDRATGAGGTLMGSAYQFSSYSRSVDANVQGPVRAFGLTHELLFGATYASSSSGQLTAPLLAGADTPVNVYRWNPDGVPEPGVGPYRQDMQNDISQKGVYGLGRIKLAQPVTLVLGGRLSWWNQDSLGAHYNAGRQFTPYGGLIWDIVRDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 2687 - protein, 400 aa, Burkholderia pseudomallei
MKKRTAVAMTAAGLAAVATAHAQSSVTLYGIADNGIAYQSSSTSLGSTTGGRSAVKMSTGVWAGSRFGLKGSEDLGDGSKAIFQLESGFSTANGTSQFAGGIFTRQAWVGLTNPTYGTLTAGRQYTAYYTLLSPYSPTTWLTGYFGAHPGDIDSLDTSYRTNNSLVYLSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSAFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 2688 - protein, 358 aa, Burkholderia pseudomallei
MAVAGIGIGAAVPPALAQSSVTLYGIVDSGITYTNNQKGHSAWKATSGNEQAARWGLVGREDLGGGTSAIFRLENGFDIENGAASQGGRLFGRRTYIGLANDRWGAFTMGRQYNAVQETLAPLHIATVLGRYAHHPFDADDLDSTFRTNNSVQYQTPDWGGVRAIATYGFSNSTSFARNRTWSVGASYARGPLQLAAAYVRVDYPAIDATGAIASDNYYGFVKGVARQQIWGAGGAYAWGGATFGLLYTSALFSLQTGGAERFNNFEGSVRYRVTPAVQVALGETYTQVLASHAAAHDAHYLQTSAGIQYFLSKRTDVYLNVSYQRASSNAVAWIKGLDGASSTRTQIVAVTGIRHKF

SEQ ID NO: 2689 - protein, 1092 aa, Burkholderia pseudomallei
MKNIPLPDLYYLENPDLKQLFRIMRISIFLLFFCLFSLMAENSHSQNARVTINRSDAPLESILNEIESQTDYLFIYKEDVNVKMRKTIQVNGKPVSEVLPILLTGSSIGYKMEGNHIILTRDVALAAQQQGVTGVVTDVLGEPLIGVTVMLKGDMQGTVTDINGRFSLSAEQGDVIVVSYIGYASQEIRLKDTKLLRIMMKEDVELLDEVVVIGYGSISKKELTSAVSHISGKDMLQIGSGNPAMQIQGKVSGLAVENSTPSDPNSSPSIQVRGVSSRSAGLGPLIVIDGIPGGSLDNLNENDIGSIDVLKDGAASAIYGTRGSNGVIVVTTKKGTMDGKIHTSYSGFVNITTPVRELNVLSATDFREQKRGDDYGADTDWFDELTKVAVSHSHTLQVMGGNTKTNYKATVDYKNTDGIDLRSERQQVGARLSLNHTGKSDLYNVILNVAPRTVKYQDADYDTFRSALLINPTIPVMDPEQPGKYTQITTYSTNNPVEILKLEKSGGERTILSWDGTFKLNLFPLLCRDKNHYLSTQITLAQQIIETDYSWFRPSISTIEDKSGFQGEASRKYDKNKQESLEWLVNYGYDTGNHHVKFMGGYSYQYFVNDGLNAENKNFASDLLGPDNLGAGTYNSEVEGRLGMGSYRNDSKLIAFFGRLSYNFRDKYFATFSLRHEGSSKFGVSNKWGSFPAVSAGWRISEEDFIKNIQWISDLKLRGDFGVTGNQEFDSYKSLALMQAYDLIYYNGTYIKGWGFSSNANPNLKWEKGKNWNVGIDFSLFNYRLNGSVNYYSRKQQDLLGVYDVALPPNGASQSFVNVGTMKNTGVEIELDWNAVKSKNFNYTISFVGSTSNNKFVSFSNQFYEGPKYYWMSNFPLYPGNPGVLQRIEEGERIGNFYTFQYAGLDDNGGWLIYSKDGEVIPIDKGTDEDKRVVGNGLPKFTMSVTHTFRCKNLDLNLYFRGNLGYQIYDVHDLYYGLQDAAPNTNVLESAYKENRKITTGKNVHSSYFVHNGDFMKLDVATLGYTWNINNKWVEKARFYITGRNLFTISGYHRGLDKDAYCVNGMEPGLPYSKNGYYPSSRQFLFGIQLNF

SEQ ID NO: 2690 - protein, 379 aa, Burkholderia pseudomallei
MRHSARLLACGALCVTAAHAHAQSSVTLYGIVDTGIEFVSHASAKGGSAWRMPAVTGELPSRWGLRGVEDLGGGYRALFALESGFNLRGGELGQGGRLFGRQAYVGLRAPFGTLAFGRQYMMTYVALQGADIIGPDIYGLGSLDAYIPNGRADNAVTYVGSYRGVTLGAGYSFGRDSAGTGNSPGQGTCVGSVPGRAVECRSESAMLKYDAERFGVAASYEEQRGGANAAANFFDGAAPMPIASSADKDTRAHVSAYANAGPVKLGAGWIGRRVSTDAPAAPAVRTDLFFVGAAYRATPFVTIDGEAYRIVDARHDARATMATLRASFSLSKRTAVYAQTAYLWNSAHARYSVSGGGGGTTPAAGVGQLGAMVGVRHMF

SEQ ID NO: 2691 - protein, 400 aa, Burkholderia pseudomallei
MHIRTWIAAGVAGAAVAPACAQSGVTLYGTVDTGVIYSTNQQVTHADGSTSGGHAWQMGGGNLVPSRWGLQGTEALGGGLKAVFALEQQFLSASGQALQGGAAFSRQAWVGLRHDRYGTLGVGRQYDSYTDTLGAYVSSNSWATPYGSHLGDVDNLNAAFNFNNAIRFTSADFHGLTFGGTFGFGGQAGDFSARRGYALAVAYNRAPVSFGIGYLNLRQPLDAALGGANGYIGDFACGNAGAMYCLLQDAVSMKAFGVGGSIAFGEATVALTYTHTRLGDSAYFATAARAQRASIAFDIAELNATYAFTPMLHGGIAYVFNRAKADSRGVTRFHQLNVGVNYSLSKRTALYAVAIGQIASGRGLGSDANGDPVNYAQIPVLANSNSNRQLAMMAGVKVDF

SEQ ID NO: 2692 - protein, 376 aa, Burkholderia pseudomallei
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHPLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTIRADNYEANVKYNLTPALGLGVAYTYTYTNAKANGESTHWNQVGVQADYALSKRTDVYAQAVYQRSSKNANASIYNGDLSTPFSTSINQTAATVGLRHRF

SEQ ID NO: 2693 - protein, 733 aa, Burkholderia pseudomallei
MSSCILSSATPPRRATASVAFAMIACAAAPACAEEGEPGQAQHLDPIFVRGAHDAGSRVDRSGSAKYATPLLDVPQTITIVPRAVLDEQQALSLREALSNVAGITFNAGEGGGGSGDSFNIRGFGANANMQLDGLRDSAQNNRSDLFNIDAVEVIKGPNSVFGGAGTTGGSVNLVSKTPKAGAFTEAGAVLGTSDYRRVTLDTNQPLPGADGKAAFRLNAMAHINDVPGRDDIRKRRWGVAPSLAFGLGTPTRVTLGYFHQYDNNLPDYGLPARDGQVLAGVSRDSYFGWRNLDRERIMSDTFTVKAEHDVSPHLKVQNLSRYTHLNRDTVVSASHANLQGLPPGRYKPAGPQGYGRDASTAMWANQTNVTSEFATFGIGHTLVTGFEISRETYGRTTYSYGLNRFYPANGFALAAPPGVWLGPAKRENSARSDTELIVKALYAFDTISLGRYWDIDVGLRHDWIDGWAESTPAGKPTDRAASSDRHLSTRAGLVFKPTDNGRVYFSYGTSFNPSAEFLVSNGSGLSAATESLAPEKNESFELGTKWEGLAGIALNGALFQTEKKNARERMADGSYALVGRQRVRGIELGAAGKVTPQWDVFANYTYLASVTLSSPATPRRDGQALGNTPRHALNLWTTYRLPAGWTIGYGSHFVGRRNVTSEGGSQLGAYWVHNLMAGYEVNRRLRFQLNIDNLFDRAYVERVRQVLGSESRSSAVEFGDGRSAMLSAVYKF

SEQ ID NO: 2694 - protein, 1131 aa, Burkholderia pseudomallei
MLMTRHKKRKMMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFNAALPAGTADVWSNDISDVALAARKREDDAEHRAWLDTLRTKGWEHGLPAGASDGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVREAALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 2695 - protein, 882 aa, Burkholderia pseudomallei
MDSICNRRPRRAHAGVCADTANAPAGLPEAAQPAARLGAGRPRDAAAPRCARQATSHASHTLHAPCMPQFAPQFAPRRVVARVAAAALFSACAAPGVSGAAEPAAATGGYDIPAGSLDAALTRFGREAGILLSFPGELTTGLRSPGLHGRADPAAALDRLLTGTGLVALRQPSGGYTLARLPAPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYAGNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 2696 - protein, 748 aa, Burkholderia pseudomallei
MKSRSDELKLGKFTTLCSVLAASPAFAQDAAPPAASADHDKELAPIQIKGAAEHSYKADFSSSVKFTAPLVDTPKSVTVIPQELIHNSGAATLTEALRTVPGITFGAGEGGNPLGDRPFIRGYDTQGSMFVDGMRDTGATTREIFNTERIEITKGSDGAYGGRGGAGGSINLVTKAPHLGTTAEASAGLGTDRYRRFTADGNWQFADHAAFRLNLMSHNNDVAGRDAVNNERWGVAPSIAFGLGTPTRVSASYYHLSTDDLPDGGIPYFYTTANKPANVDTIYPANVDRHNFYGLVNRDFRKTTSDIGTLRIEHDITPSLTVRNTTRYTESTQDYIWTQPDDSQGNVVNGRVWRRNNNRNSAINSIANQTELFGEFRTGPFKHSFTTGIELSREWGKRDSYSVATGTGKICQQGIGAPSGYNCTSLGSPNPNDPWAGSITRNNDYAHARTVTKSLYGFDTVELSKHWQVNAGVRVDDYSTRFTDTRANGGKTYTRDDTLVNWQLGLVFKPARNGSVYASYATSSTPAGALLGEGSETQSLTPGRGGVGANADQLAPEKNRSIELGTKWNVLDDKLSLTAALFQIDTTNARVTLPNNQYAMVGNKRVQGLELGFAGQLTRAWQVFGGYTYMKSELRDNGRNTADNGHQFPNTPKHSFTLWTNYDVTPKFTVGGGAFYMSKVFGDTANLRAVPSYWRFDAMAQYRINKKLDLQLNVNNLFNRTYFDQAYPAHYASIAPGRSAFVTLNARY

SEQ ID NO: 2697 - protein, 384 aa, Burkholderia pseudomallei
MKKLALSTLSLALLGAAGAAQAQSSVTLYGVIDTSITYVHGNDGKANNAWLMGSGNLQGSRWGLKGTEDLGAGLKAIFQLENGFNSNDGTLGQGKRMFGRQAFVGLQHDQYGTLTLGRQYDPLVDLVQPVTADNYFGSLFATPGDVDNNDNSLRVNNTVKYTSPVFAGFQFEALYGFSGIAGSPGQGQTWSAAAAYNNGPIGVAAGYFYTSNPSPTAGSRSTWSGSSDAIFDGAINSGYTSAKSIGIAQVAGQYVFGPVTVGLGYSNAQYKPDGFSGFSSTEKYNTGRGFVRYQATPALLLGLGYAYTKASGDTDAKYHQVSIGADYALSKRTDVYLAGAYQHASGTQRVDATTTQTAQASIGSYGVNGTKSQEMVALGLRHKF

SEQ ID NO: 2698 - protein, 745 aa, Burkholderia pseudomallei
MTSTFLRHAPAARGDHARRRRRAITLTVPALAAGAFHLAPAVAQTSEAVHGHGTLGASGVASRAETDATSAKSDGAVREAASRTTTGAAPDATMLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYHVSKTVQISVGVDNVLDKAYAEHLNLAGNAGFGYPANLPVTEPGRTAWVRLSTKL

SEQ ID NO: 2699 - protein, 318 aa, Burkholderia pseudomallei
MDDEDHFNLAYTSSFTPEQHSNSLTSGNYQASNVDKYVETRMHNVTLQYHSGSGFDVGGDYTHYTSDNNQTLFADYADGAQSGFSIIGGQKIDRYSIYVDRKRSLAKEWDLGYGMSYRFAKDRDFQTYDKVTGDIPTENTDSRLREQTANVYVSLSKNYATGTSVSISATGEYYTIGNYRKWAVYPQASLTYVKSSEHLFQFSLSTDKTYPGYWDMQSSVSHLNGYTELWGTPGLKPSTAYNLNGNYIWKQKYIFGLFFMHTSDFFVQTGYQSTDRLALIYKNTNWNYMQMWGTNVILPFKAGNWLDSRLTLVGMQVH

SEQ ID NO: 2700 - protein, 421 aa, Burkholderia pseudomallei
MDKRLFSLAALLLATTFANHAYSQGVYISAAGPINRSMGGASTAAPISALSAMYWNPASISGMENTELEVGVDLLFADHNVTSTVGGTTGSTDAEPGTFPVPNFAWTHRLADPRFTFGLGVNSVAGFKTSLPASTTNPVLAPQPTGLGQITSEASFLQIAPVLSMAVTERMSVAAGPLVTTGQVGIEPFVFDSANADNTYSSGRATRYHWGGGFQLGTYFLMTPDWQLGASYKSKAWMETFEFTGADENGLPRTLTCDLDLPSVISLGTGYTGFDKWLFAADIRYFDYANTDGFGDDATYDGTGALSGLDWSSVFALALGAQRTIGERVVLRGGYSYNQNPIRESKSFFNMASPLIYEHVLSMGGSYNLNEKVAVNLAWSHYFENTRTGAVILPGVGAVPGSSITNRLSADFLSFGIVMKQ

SEQ ID NO: 2701 - protein, 1017 aa, Burkholderia pseudomallei
MLPFWAIGQGTVSGTVTDAETGQPLPGVTVLVQNTTTGTTSDFDGNYTIDVPANATLVFSYLGFVRQTVAINGRSTINVVMQPDTEQLDEVVIVGYGTQSSRKVTGAVQQINTDELADLPVPQVTQKLQGRLVGVQINQTTGRPGEGVQVRVRGQASILAGSDPLYVVDGQPIVGDISSINPDEIESISVLKDAASTSLYGSRAANGVVLITTKSGKVEGGELSFNYYGGVQTVPQKGRPDMMNAQEFAQFKKESAEDLGVAVPEPFQNPEQYAGQSYDWYDGMFRTAAIQSFNLNWSSRSERASHAIVAGYFDQEGVMINSDFKRYSMRANSSFQLGDKLDLGFSVAPTYVVDNIPNSDGAFYGANIDGVGGGGLINNSLLTWPIFPYQNDDGTYPLTAWIPGVSAFPTPNWVRAAREITNETKETRILGNLYLTYEPIDGLTVKTSINGDFGQSNFFSFSPSTASNTFASLPPILATSTRAQTSYLSWLNENTLTYARSFGDHNLEILLGASYQKYESEYQQLRLSNFPDDRVQTIQSALNIDRGATFNNINDWSLTSYFSRLSYDYMGKYLLTLAVRRDGSSRFGSENRWGNFPSISAGWVFTDEAFMEGTDWLSFGKLRASYGIIGNNNIGNYTQYALVDNSLNAVFGNTIASGAAVTTLGNNNLGWERTKQFDIGLDLRMFNNRVEFIYDYYKKNTTDLLFNVAVPQESGFTNFNDNVGEIEFWGHEFALVTRNFVNDDFTWTSNFNIAFNRNEVVALAEGVDRIYSGFGAYQSLTRPGEPLGQFWGLIWDGVYDNQAEFDNSPQAAESQVGTIKFADVNGDGVITYGGDNDDRTVIGNPFPDYIFGFTNDFRYKNWDATIVMQGSVGNDIAITSDQGTTNLDGVFNVLRNVQDRWRSPENPGSGRYGKTTAATFMERDWFSTRFIEDGSYLAVRNITVGYNFQLRDDSFLKRARLYGSVQNAFMFTKYRGANPDVSTTSTGAGELNALALGFDWAAYPLPRTFTMGINLSF

SEQ ID NO: 2702 - protein, 430 aa, Burkholderia pseudomallei
MPAARARNHIHRRINWFSVRFPVRIVQRFERQIDHEENHHMKQTKHLAALAVPAGFLLSAGVHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAVIDAQASVGSYGANSGTDSQELAIVGIRHKF

SEQ ID NO: 2703 - protein, 1010 aa, Prochlorococcus marinus
MNFKNNTITYKNIVAFASIVFFSTQTQAKTPYLALKSTVDPIKNEAVQQTITGTVTDSDGVLLPGASVMVQGTSIGTTTDFDGNFSIDANPGDVLEVSYVGFETTIIEVTQETKYSIQLAANTSELDEVLVVGYGTQKKSDLTGAVSSVVAEEFNKGVVNNPGNLLQGKVSGLNVTNTSGEPGAGQDIIIRGVGTLRSGTSPLYVVDGFVLDNSGNGLATNPLNFINTQDIESINVLKDASAAAIYGSRAANGVVVITTKKGKAGRTQMNFSASTAISSIANKIDVFSAEEFRTIVPQIGGSLSDNGANTDWQDELTRTAITNNINFSMSGGSANTSYFASIGVDDQEGIINKSDLKRYSARANVTQKGWDDRLKIDLNLTATRTENTRPNIGTMVSNMLSLNPTTPAYTNGEPTVFGTGINPLIIENIYGDFSNNNRMIANIAPSLEFVDHLTYKLNLGVDYSTTDRDVQYIPYAADPDYAQGSINTSFTTNRNTLVENTLTYNNVFGDHGLTLLAGHSYQKFYIHDKGFYFENFPNNGIEPRYQLEAARGENATQYSNAVSNELQSFFGRVNYTYQDKYLVTATLRSDGSTKFGENNRYATFPSLALGWNIFKEDFMADSGINNLKLRASWGKSGNQEIPAKQTRLSYGESFADNDIYPLNDGITTREGYDYGLVFARTANPDLQWEETTQTNIGLDFGFLDYKLSGSVDYFLKETNDVLLYFSTQDPIDEVGYKWQNIPDMKIKNSGIEVALDYQSDRTRDFSFNIGGNISYIKNEITDSPFTIVTTGTASGAGQTGATINGYMNNQPIGNFFLREFTGIGADGFSTYTDLNGDGQIDDSDRISAGSAVPDILYAFYLKFKYKNFDLGLNFNGVSGNEIYNHTRMSLFNKTQISNSLNTTDQAIAYPNEDPSNTNTVSTRYLENGAFLRLNNATFAYSLNPQVIGMDKWLDNVRLSVTGQNLFIITDYTGFDPELNTGSSSDSKSYGIDYYTYPKARTVVFGLNVSF

SEQ ID NO: 2704 - protein, 733 aa, Prochlorococcus marinus
MSALISLSCRALSMSATFPLLSRCPLALVLALCCTPALAQQQPDANAVELDAVNVRGERVETSTALSGFGATRLLDAPASIALIDRQQLLDRQARVLSEVLRADASAGDAYAPIGYYENFVVRGYSLNAANSYRINGMSAVGEQSIALENKQQVQLLKGLAGLQSGVNEPAGLIDYRTKRPEHVRSVTLGTDEQGSRYLAADLGDWFGAERTLGVRINAAREDIDSDVDHADGYRNFLSLAGDWKITPQALLQLDVEYQHRQQRSVPGYQLLGGTQVPRDIDVHRLLGYQPWARPVEMDSLNAQFRYAYQFNDDWRATADASRSRSTINDFSAFAWGCYGAASCADFATPNFFSAQGEYDVYDYRSPDDTRVHNQLRATLEGRVATGALEHRLSVGGEWLRRTIDRFGSVNAFVGSGSIDRDPEVFAQTDVPLAPKQRRLDSRQRALVLADRIGLGAQWELSLGGRYVQLDERSFDRDGLLERRMRKDTVLPQAALLFKPQQNVSLYASYAKSLAAGGTAPWFADNADEILPPTNAYQLETGAKIDLQSLRLGAALFDIRQAYQFTQPQADGGLLYVQQGRLHNRGLELSADGAATRQLRLFASIAAIRARAEDTDIAEYEGHQAINVPKLRASVQADYSVPGVDGLALLAGVQYSGRKFADRLGNASVPAYAVANLGARYATALGGLATTWRLNVDNVFDKRYWRDSGEYQGDAYLFPGAPRTARLTVQVDF

SEQ ID NO: 2705 - protein, 432 aa, Prochlorococcus marinus
MKLFQQMLVAGASLSLLAPVAAQASDVVNIEEMNSYVRSQSKSSRLNSKTFINEVSADIANLKGRVDGLEVKQKEFEAGGFSDTTVMDQKVVFDIGAIDLSETDGSDEAAKFAYSYRANLNTSFTGDDNLYVRLLSGNHGGWMKSNVDGGYLTSVGKGDSLTVDKIWYSFPVGENNTVWVGPKIENYYMHGAAPSIYKPVTKQFTLGGNGSAYGASTDTGAGWAFKADNGFSISSNVGTKSHSTQKVGGSYVDSGLLTDETKTSWATQIGYTQPQYSVSAIFNLKYNGWTDGYLHTTTAKAAISGADGNHTAVGLRGWWRPDGTGTATPSISVGYDTTQYSGVPSGTSDSTDMWFVGLQWKDIFNPDDKIGLAMAQPTKFDDETNDPFAYELYYSYKVNDGMTVTPTIFGGTDRDGGTEDIFGAVVQTTFKF

SEQ ID NO: 2706 - protein, 805 aa, Rhodobacter sphaeroides
MKTKHAQKYRVARFVLSAFCLTATLMPLPALGADYGIVKGKITDKADGEGVYGASVSIAGTSIGTTTDMNGNFTLPSVPAKQQKISISIVGYAPASQVVTVANGQTYQINLQIGQTTIMASEVVVGASLYKQNRLDVPVTANVVSQEKIKQQANPTLDRVIEDVPGVVVTRAGGQTSSGVQIRGSNTYQGGGIGTRVTALYDGFPINAPESGEVAWSSVNMNAADKVEILKGAAATLYGSSAMGGVVNVFGHLPDKLEVKAGLNGGFYAQPPSTDQSVFYNDKHTPWFWNTYVGFGNKSGKLNYNILYTTSRDDGYRQNANTILDDIKLKVRYDIDASQYLLLSAFYNQTEGGYAYEWYTGDSFTVFTAHPERGYDINNNQYYYDDMIKRNNALVGLNYVNLISDNLSIDTRLFFTHNGTRYLYNTTTAPQISIPFYNKAVGDFNETYSNRFGAGTKIDWRANDNNRVLLGAEGSTTDVMTTQLTAQWPTANVLGDIREDNRALFVQDEVKVTDKLTSLLSLRYDWSGINADLAQSSAGGSYVAIEHKSVDAFSPRVALNFKAMDDMSLRASWGKSFRAPTLYERFVRSAGPYTGSPNPALNKETMTAYEVGMFKEFGDQLSLDIAGFLNNYNDLIESVITQSTRAFQYRNITKARIFGVETGLNYRPSSDLAFNAAYTYMKAKNRSYVAGADATNDLNPDPYWLAYRPEHTASAGATWKPTGKLSLNVNARYVSLYKSVTSHPNATSANYPGDFVIFNTGLKYQAAETASVSLLCKNIGNTQYEEAEWFRAPGRSYVAGVDFTF

SEQ ID NO: 2707 - protein, 611 aa, Rhodobacter sphaeroides
MKKTAASLLTLMAAAPLQAQDIALDEILVSPSLVATETSRTGATVDVVTAEDMQATGEISVSDLLARLPGVSYTRNGGLGATTTLRIRGLGSAYQAVRIDGIDVADASGTKSEFDFGSLTAGGIDRIEVLRGSQSAIYGSEAVAGVIDIATYRPRDPGVSGQLSLEGGSNRTFTGGLSTGLLTERGELAFSVARTVSDGISQAASGTERDGFDTTFYALSGAYDLTEDLRIGAAFIARDSDLDIDGPGAGGIVDTDDRALSRLRGGRIFADLTLGQVQSVLAYAATDTRREYPGGYIEVYEGERRALSYLGTVEVGLASLSFGAERTKESFSSDTDEGDLTTDSVFGEARLALSPDLDLSLAARRDDPSDFDGKTTGRVALAWRLADDLILRGVAGTGFRAPSLYERFGPEGSDRLGPESSRSYELGLEKRFGSGATVQATLFKTDVTDRIVYLDGADFCASPWGCYDQLDGETHSQGIELSARAPLGSEWELFGSYTYTDASDEANGTETRAVRVPRHDLVLGLEGQIADRTRGILTVQHIADVMDTTGYLQPDAPLDDWTVVNATVSYDLNDRAEAYVRVENLFDEEYQTVRGYAQPGRSIFAGLRARF

SEQ ID NO: 2708 - protein, 821 aa, Rhodobacter sphaeroides
MHTLRLRDAALPASTRYSVRTLLPIVVLGAIHGAAAAAAGDSAQAVAATGSAASAPEAAAASATDAATLTLPAVQVSGQTSGSRSYAEKNLLPQTTESVTARQIAETINMTDTEDALKYLPDLLVRKRYIGDTQAPMATRTTGINASARSLVYADGVLLTPLINNNNQNGSPQWFMVAPQEIDRIDVMYGPFAAGLPGNSYGAVTQITTRMPKHFEASVDVTGAIQHFSQYGTHTGEPAAQYSATLGDRIGKLSWWFSANHLNSFSQPLTFGTVSQSKTPAGAGLPVIGGGFADTNRTGGAIQVIGAGNFIHTIQDDATLKLAYDFTPTLSATYTLGYWQNRSKAQAETYLYDANGAPYYGAGSGPVNLGGFAYSASTLAGQFSSNNVEQEHLMQSIDVGTHTQGRFDWQLIVSNMDYLQDLSRLSTGLYPAALTGGAGRTTDMSGTGWSTLDLKGTWRPQGMQGANIVSFGAHYDQFRLESPTFNTADWISGGNGSLYSNSLGRTETSAIWAQDVWRVAPALTATLGGRYEWWRAYDGFNFSTGSNGAGVSVTQPGVDKSGFSPKASLNLALTDTWSVTGSIGRALRFPTVGELYQTVQTGATFLQANPFLKPEDVWSGELALERDTNSGHLRLSVFDEYVYDALISQTALVPGFATPVSFTQNVGKTRETGVELAGQQDDVVVKGLSLSGNLTYTNSDILSDDGFRATSPGDTAVGKRVPYIPSWRATLAATYRPDAHWAYTLAARYSSRLFATVDNSDANPATFMGFQRFFVMDARVHYQYDHHWGGALGVDNLNNRKYFLYHPFPQRTFYAELKYDF

SEQ ID NO: 2709 - protein, 799 aa, Rhodobacter sphaeroides
MTEGRRMARNRTGNGRTGQDRGMIRPAAVSVFLGVAGIAAGMTLPALAQNYSFSDVRIEGNDRVDATTILGFARINRGQAISAGELNEAYQRLADSGLFETVEIVPQGGTLVIRVQEFPTINIINFEGNARIKDDKLAGLVKSQSRRAYNPAQAEADAAAITEAYRVQGRIAATVTPKIIRRSDNRVDLVFDIAEGKVVEIERLSFVGNRAYSDRRLRQVLETKQAGLLRSIIASDTFIAERVELDKQLLRDFYLSRGFIDFEVLDATAEVTRERDAFFMTFTVQEGQSYSFGQITASSEVEGIDAADFQQALRIRRGVTYSPSVVENNIARLESLALQKGLNFVRIEPRITRNERNQTLDVNFALVRGERIFVERIDIEGNTTTLDQVVRRQFRTVEGDPFNPREVRQSAERIRALGYFANADVNTRPGSSPDQVVVDVNVEEQPTGSLSFGVSYGVSSGVGFSIGFSEQNFLGRGQILGVDVSTGTDNVNTQLNFVEPSFLGRDLRFRFNAYYRETDNQYSRYDTRKIGISPSIEFPVSDSGRLELRYTLSEDKISNVDGGPNDTDDDDDVSSIILINEEARGALIASSVGYTYSWDSNRGGLNPTGRNLLRFSQDFAGVGGDVEYVSTTALAMAERKVWNEEVTVRAIIEGGALSMIGDDPSRVTDRFFGNGKIRGFEPNGIGPRDLNVSNEDALGGNYFAVARLEADFPLGLPEEYGFSGGVFADAGSVWSLDDVGGGSTGDDTVDDDFHIRSSVGVSLFWTTPIGPLRFNFAKAIEKQDYDKEQFFDLTISTRF

SEQ ID NO: 2710 - protein, 261 aa, Rhodobacter sphaeroides
MKRITTSVLLGSSLLAALPSHAGEWLQWHGESLTYLYGKDFKINPDIQQTVTFEHANKWKYGDTFLFVDKIFYNGKADPGKGVTTYYGEFSPRLSFGKIFERKLAFGPVKDVLLAMTYERGEGDNEAYLIGPGFDLDIPGFNYFTLNFYVRNTEGSRPGDNVWQITPGWSYTIPVGRSDILIDGYMDWVTDNDQTRRGTYHANLHFNPQVKYDLGKALNLGAKQLYVGFEYSYWKDKYGIDSRGNLDSNQSVASALIKVHF

SEQ ID NO: 2711 - protein, 740 aa, Rhodobacter sphaeroides
MKVWRGCDKNTSLDWLIHRIYPARISAWKWFSCLMFWLPALPLFAQQLSPEQPAQFDTISVTATREARTTKEVPQSISVVDEKRIKDVRMFNIKDAIQGQVPGLRIESNNNAYDAKISIRGAGLKAQFGVREINLLRDGVPILDPDSFGRLDFVDPDDVERIEVTRGPGDLYSAGTAGGTIHIISRSAFDDQHNVIRGGVGNWGTHNLHTRFGKVFNEHALAFTFSRRHTDNDWRRHNRFSSTNAGLKHGWQLGESSLLETEITYSDVKLNLPGSLSREQYAQYRNTGKALETQDPWKNSARDSQILFMNSRLEHRAGDWLFKPRIYYNQWKQFHPVTGQINVTDGWERNFGFDLEGIYTHSLFGIPGSMVIGGTWRRNWNDGALQYAYADVLTVPGSGRIISTLSDRKGQINSRSKSTNDLWGVYFLESLSPLDRLTVDLQMRFDQVSFDIERNEFQRYDFASGRYTPGRGLIQVREKYDLFAPKAAVTYRATDLINVYASVAHANQVPADSEVQNAVEFGRTLKASGHLNYEAGFKGRGRNWSFDLTGYHTDVSNEIISFVQNLQTLYTNAGKTSKNGFEFFGNYAFTSGFEVGASYTYTDLKFNRLTEPLTIIDPATNQRTTINANRSGNQVPRFPEHMYFVYTTYRHLSGWHGRIETRGQSDYFTDNANTERHGGYHFLTNLTVGYDRKHWGLTFNVQNLFDKRYAVDVNKDASGSRVSFTPGMPRTFMGYVSYKF

SEQ ID NO: 2712 - protein, 332 aa, Rhodobacter sphaeroides
MKQILLATTALVMTAGVAAAEISFSGYAEMGVVGGGDGLLAPLPAGRDTNETQFHNDFNLKVTATSETDTGLAFGVSVEISKDEGDSNGNFTADNEAAFISGAFGTLTMGEIDGAMDWAMTENVGNPGSIGDDETTHAGYFGAFGDGKYDNQIARYDYSFGDFGVAVSAELDDDEDGASTNYAVGAKWNGDFGGFGMGAGIAYQSFETAGTGLGSQGAAGVAGDVELLGVSLTGDFNNGFVAGIAYTDISSDFQDGNHLGLSAGFTTGAFQIGANYGVFDMDAQDKVKGYGIAAAYDLGGGLKLHGGYGDSDFGGGLDDDNETYSVGVSMSF

SEQ ID NO: 2713 - protein, 347 aa, Rhodobacter sphaeroides
MTPRFIRTAAAAAALAACSVAAHAQSTLTLYGALDAGVQYLTHADGRHAAMQLQNYGILPSQVGLKGNEDLGGGWRALFKLEQGLNLNDGTATAAGYAFFRGAYIGVAGPAGTVTLGRQFSVLFDKTLFYDPLWYASYSGQGVIVPMTANFIDHSIKYQSPTFAGFDVEALAATAGVAGNARAGRVLELGGQYTSNGLSVSAVLHQAHGDASAADDAAARRRDLGALAARYAFASLPLTVYAGVERLSGDLDAARTIVWGGARYLTSSGVGLNAGVYHTDSHTPAIGHPTLFIASTTYALSKRTVAYVNLGYARNSGESSQTVYEYDPTPLAGASQFGAMVGMYHLF

SEQ ID NO: 2714 - protein, 801 aa, Rhodobacter sphaeroides
MNDNRSFLSARTVLLAASAGVALPVAAAAQVGPQAVAALVDQPADQAPPASEAVENAYDDYADGAIVVTAPRLSGQLDTDIKAEAELDEAAIASYGVSNVSELLEALAPQTRSGRGRGSGRPIILINGRRIGGFGEVRNLPPEAIAKVEVFPEEVALQYGYSADERVVNLVLKPDFRQVSIEAEGGIPTQGGRFQSEVEPSFLAITERGRININAGWESKSMLRESERDLVYDDPAQAAEAPARSLLGASDEYRIDATVQRSLNKVTDASINLRLDQTDTLSLLGPGPGGVGDPLTRDSRARNLTSTASVNGMLGDWRWSVTGNYADADQRTFTDRIDGSVDRFDSSQQTFGGNANLSGTVTEGWAGPIRLSMTGSYSGLRFDSRSQRADGVTTTDLSRDLPGVFGSLTVPLLDPDYAVGKIGTLSLTLSGQVQNPSDFAALKSWGANLNWGVTDSLSLIASFNSDEAAPGIQQLGAAPLVTPAVTYYDFATGQTVQITTTTGGNPLLLAEQRRDLKLGLNWSPPMIDGLNLSVNYNRNKSHDTANSFPLLTPEIEAAFPDRVTRDANGVLVALDQRPVNFDRAENSQIRWGLNFGKSFGQEEQRAGPRREGGAPGAGAPRGGPRAGGGGRGGLGRMFGGGPQGGRWQVSLYHTIKLTDTVLIRPGVPELDLLDGSATGSGGGSNRHLVELDGGVFYKGMGVRLSAKYDSGSTVTGGSAGDLDFGDLATFDLRFFVNLDQQPRLTGALPFLKGSRLRLAIDNVFDAQRKITDANGVVPLNYQPGYIDPLGRYIELEWRKTF

SEQ ID NO: 2715 - protein, 765 aa, Rhodobacter sphaeroides
MRQRPLAIAIGLLLTLNTARAEERRFQFDLKAQKLSAALKAVASEVNVKLRYADGLLRDQSAPALHGRYSLREALDQLLGGAGLSYTVSPPGIVTIKMPANTTLAPLTVTAKPTPGSLTTPSILQTQAKLDRVPGGTTLIDGERLKEGVRFSASDALAYAPGVYVGDANAGVGGGTRISIRGSDVNSIISPIRGIMLLRNGLPFTSANGLSDTESINIYPADHIEVYRGANALEYGASTLGGAINFVNHTGYTSSGVKAGITAGSYGYLNPRISAGHAFDSGWDAYGSFSYIDFDGNRQNNDQDHYYGYGTLGYRWNEHHESRLHIDLQDHEYLIPSPLTKQQLEENPRQHTGSFDNPHSGFPVYRVDLQHSVRMNDGDRLDFGAYYFKKDFSFLFTEFGFFRDLWEDAGLSWRHQINGQLLGMKNRIVWGGLAQWMRIKDRNFGVTDGERGPLLSEERDKWQNFQVYLEDQLDLTDTFTLVLGIQAFYREVEYEDLMPDPGDPKTAGQEFSKVNPKLGFIWRATPAVQIYGNVSRSAEPPPLNNLSSVSSEPQLKTQTGTTVEIGTRGRTKWLRWDLAFYQAWLDNEFLITPTPPRFTDFSAANADDTLHTGVELGLESTLPLGLLADYDQIRIRGSYSWNHFRFDDDPVLGDNQLPGIPEHNARVELLYQHPSGFYIGPNVQVASKNFVDFTNTLAANSYALLGARIGWDNGKNLKVFVDGRNLTDEHYAASVFVTGDAGGQDRASFNPGPTRMIFGGVEIAF

SEQ ID NO: 2716 - protein, 644 aa, Rhodobacter sphaeroides
MSILSPRTIRLLAGSAALSGSCVAAHAQDLAFSLDPIVVQARDDFAEAADRATSMYVADAELERARTGDLKDVFAGIASVSVGGALPLTQKIFVNGVDMLNLGVSIDGAAQNNRAFHHVSANAIDPGLLKQVRVDATISPADAGPHALAGSVVFETVDAADILGEVQRFGGTLRLSYGDNGKTAQGALTLAGREGGFEWLAYAKRATGDDYEDGDGATRLGTAANLKSALGKLAYESDGGHRFELSALRLRDDELRQFRANFGGLGGVVDQLRVYDTTRESWSLSYENTQGEGMWDPSLRLGYSESDVVIPLPYDSNGLSGTWSATLQNDFHLNATDRISAGLDWQRRFGEYSSPTFGEFLDETSHNLGLFVQARLEPTDRWRLSFGGRLDRQEFEGVDGSDLGHSGPSGNLSASYALTERLTLRGGLSSIFGGIDIEDNYIFRPSWSYDSLRPSRARNASLGFDWDVGAFKVGGELFLTEINRARSATEMFDFESRGFNLGATYGWDGGFARVTLSHSEVKVDGAKAAGYEALDFGAPLGTVAAVELQQDTAVAGLRLGGGLDLALDHDMPATAERDLAGYSVVNLFAEYVPPEAQNLTLRLQVDNLFDKTYADRATYGAEYSDVTSLKEPGRTITLSAVTRF

SEQ ID NO: 2717 - protein, 278 aa, Rhodobacter sphaeroides
MPPSSDSKAYTDVLPSATLNFLTDDQRILRVAVAKVTARPPLDELRTDRRLDDPTVTVGQLTGSGGNPQLDPFKATQVAVSYEWSFHTEALAALAVYRKEVDSSIGYRTDREVINGLDYLVSAPFNGGGDINGVELTLQTPFYFIAHMENFGVYSNYSLVNSNLKKFSPEDNPLPLSGLARKTGTFEARVGHKYHSPYTVVYGWNAARLTRLQSEGTVDLSLTWQYSKQLGFRFQASNLTNEPLRAYTDNTPNRLANQDDGGYQVFGRRYQLEATYKF

SEQ ID NO: 2718 - protein, 791 aa, Rhodobacter sphaeroides
MRGQSLLPWRTGRMARLLTTALLCGAALPVLAQGVPHRFDIPAKPVTRAVNDIGRVAGLSIVMPDEGAVAVRGNPVQGAMSVEAAMETLLAGTGLSWRFANAGTIHVFQRIPAGAADGSAGVMLERIRVAGDGNGATSFVAGASGTASKSGTPVLEVPQSVSVIGPRQLEAQGARSVTEALRYVPGVNIETYGPDPKGFEWIMLRGFNGQSSSAYLDGLRQIASNYSHFRTDPHQLETIEVLRGPSSALYGQSDAGGVVGKTSKRPVTEPLREAELSYGSFATTQAAVDFGGALTEDKTLSYRLVGVARDGNTQFSYGDGTRMKDDRLMLAPSITWAPTDATSLTVTAQALRDRSGGTAIFFTPTDILVGDPNFSRSEQDQKTLGYEFSHRMDNGWTVRQNLRYGRVDFDLDMIAMIGADATGLTRQARRFSESLDSLAVDTNLLGEFQTGRLSHKLLIGLDHSRSDTDARRWNGTAPSLDPYAPVYGVDVPTPTTVAYDYTEEYRQTGLYVQDEIRLDRFLFTLGGRQDWLSTRTDDHLTGTAREVDLDNFSGRVGVSYLTDSGLVPYLSYSESFLPNAGLGSDGRTFDPTRGQQWELGAKYQPSGTDALLTVALFDITKSNVLTPELGPGGISTGYNIATGEIRSRGIEVEGKASLGSGWDIAANYSYSDVEITEDNAGNEGNRPALVPKSQASLWLNYSFGAGALDGLSLGGGLRHVGTSFGDNGNTIKVDGRTVIDLGASYALSETARLALNVTNLTDKEYFTTCASAYSCYEGDRRMVTAKIAIGF

SEQ ID NO: 2719 - protein, 743 aa, Shewanella loihica
MKNHIILVFILISTLGIGQNIRGKITSKNGDAIPFANIYIKNTKLGTTSTEDGSYQLNYSLNGSYTLVVSSIGFKTKTFPLVLNGNNLTRNVVLEDDNTLDEIVVSGTLRPVSKTASPVPVEVYSKTFFKKNPTPSVFESLQNVNGIRPQLNCNVCNTGDIHINGLEGPYTFVLIDGMPIVSGLSTVYGLTGIPQALIERVEVVKGPASTLYGSEAVGGIINIITKKPTNAPKLSTDVFASSWGEVNTDIGLRYQISEKAEGLLGVNYFNFQNRVDNNNDNFTDLTLQNRISIFNKINFKRKSNKVFTIAGRYVYEDRWGGELDWERKFRGSNIVYGESIYTNRWETFGTYQLPTTENINFQFSANGHYQDSFYGTDAYDATQLIGFAQLVYDTKINATQDLLVGLAYRYTYYDDNTFATLDETGTFNQPSKIHLPGIFIQDEISISDRKKLLLGVRWDYNSVHGNIVSPRINYKWSSRDKSNIFRISAGNGFRVANVFTEDHAALTGARKVEFDGNLDPETSWNANINFVKKINTANSFITLDASAFYTYFNNRILPDYETDPNKIIYANLEGFSVSKGVSLNADILFTNGLAINAGATLMDVSVTENNIKRRQLLTESFSGVWSVSYRFAKDFTIDYTGNLYGPMRLPLLGPKDDRAEFSPWFSIQNIQLTKKFTNSWEIYGGVKNLLNFTPAANSISRPFDPFDEQVDPNDPDALTFDPSYVYASNQGIRAFLGVRFTLF

SEQ ID NO: 2720 - protein, 979 aa, Shewanella loihica
MKLNRITSSLINKQHKSNPALISAAALILMTSSTLAAQESENTSATADKNIEVIEVKGILNSMKAAAMLKRTDGRIVDAVVAEDIGKLPDNNIAEALQRITGVSINSDFGVGDSVSIRGLPQNRVELNGRSTIGDSRDGISLQDFPSSFLKTVEVVKSPTADMIEGALGGTVSLRTVRPLELDKLTAAMSLDAEYADKTENVAPIFSGSVGNNWDFDEMGTFGAIAMFSYQDREIRQDETSSRVKPQDIVINAQEGNTPSGNAIVRDEHSIEQYVEKRERTAVNLSLQWAPHSGNGMVYLDLSGTKRSGEQAGNSILGVAGSLSTDANTTQDANGVNNYTLTNEFGIPKTYSDFRDTDSFSNALGAEWSLTDSIKISGEVAVASSESIRPDSEFTLRPIEKSTFEASGGVDLVNHLYDGAFSQDGNRLPSIIHSDPTAFTNPQNLALRTFKSEDRKTNNDETAVRFDIEMFEPLSSANWISKVKAGVRATKRDYEYEQYKVEIKDIYKNAINDSDGSLATLWADDYNALFPGSFTTMSHDNSFNQLGHSGQNDLLTFLTYNGLSNPSNTYAQLQQLLAGTNLASTGSLHDNQEFQESAYKNVVEDTAAIYISAYLDFDSVTAIVGARYVTTDLESSVYQNGVKVTGENDYTDFLPSLNVTYNYSDETLFRFAAAKVMRRADFSELSPAFDVNNDRTGATQGAIDLEPYRATQYDLSVEHYFDEGNVLSFALFYKDVKSFLSNESTCVASSTTAALQNVTQWNQVCQLDTAGVSQDNMVYSDATNYPVDADGFNHVAGLRDAGLTGIDTVKNINGENGSVQGFEVGYQQFFTSLPGAFSGLGINANYTYADSEQPNGNPLLDISKNTYNLQVFWEHEGFSTRLAYNYRDGFLSTENEKRVENINSNGSISQDGTVYGNNYRDDRGQLDFSASWDINENFTLVGNATNLTGEPSIYLSELGGAWKYTEADRRYSLGIRAKF

SEQ ID NO: 2721 - protein, 1086 aa, Shewanella loihica
MMNNLYFQLDGDKSAFVRLVSKISRIMKLTLFLVCLSISMSFAMTTNAQSTSLSFKATDQSIKEVLELIESQTDFHFFYNSKLVDINQVISVDIKDKDVFTTLDHIFENSNIRYKIVGKDVILSVKGSKSDQDEKTVTGTVVDETGEPIIGANIVEKGKANGTMSDLNGHFSIVVSSDAVLQISYIGFSLHEEAVKNKNVLQVIMKEDTQKLDEVVVVGYGSVDKKELTSAVTAVSSKDFLQGAFTSPLSMIDGKVSGVNVSNAAAADPNSSPNIQMRGASSIEAGNSPLVIIDGMPGADLRSVANQDIESITILKDGSAAAIYGSRAANGVILVQTKKGKAGKVSISYDGYIDHDMVANQPEVLSVDEFLAHERDVDFGHQVDWYDKLLNKSNLGQSHYLAVSGGGENLTFRASANYKKKDGLDIASSRKEYGVRMGFTAKTLEGLLEIQGNLSTRVINEEYVDYGVFQQAVKLNPTHPLMDEKDPSKYSTLYGFDTYNPVGWLKDKEDGGDRQFSLADFKVKLNILPTLNTELSLARQSQEYFKRIYVNSNHKESIDNMRSGRGTLQEENYTDYTLEWIGNYFTTIDKHTIKLMAGYSYQEFNHRSFSSENANFPSDAMSYNNLEAGDWNMAAGRLGVSSLKEKEKTIGFPARLIYNYDDTYYLTASVRYEGNSKFGANHKWGWFPAASAAWRMSSLPAIKNIEAINDLKLRFSYGVTGRSGFPKYSALARYEQGGYWLDDNGQWTQAWGPTNNPNPDLHWEKQISYNLGVDFSLLKNKLSGSLDAYVKQGKEVISNYDAPLPPFMFDQIFTNVASTSSKGLELTLNWDVVNMKDFSYSTNLVASFTKSKLDKFSNGTYQKGYMDRYLLPAPGNPGYAQRLQDGVEIGSFYGLRYAGVDDNGNMLVWKDAKIGGEKILANGEASDTDKDYIGHGTPRYSLSWGNTFRYKGFDLSLYFQGRFDYQILNMYQMYYGLVAEPGMNLLEDAYGKNGHIKSGKVMCDYFLEDGDYFRLDNITLGWTPKLDTKWISNLRVYATVKNAFTITKYSVMDPTSVDINGLEPGISGLNVYPIARSFTFGIQISY

SEQ ID NO: 2722 - protein, 872 aa, Shewanella loihica
MRPSTFKKSVLATNIAILLGSAVSVSAVAANDAVAAPENIEKIEVRGMRASMKASVNDKRFSDAVVDAVTAEDIGKFPDGDVGESLGRIPGVAVNRQFGQGQQVSIRGASSQLTSTLLNGHSVASTGWFDQQNIDRSFNYSLLPPELVGGIQVNKSSQADIAEGGIGGTVTVKTRKPLDLDANSVFLSAKGDYGSVSEEIDPQTSGLYSWKTEDEKFGFLVAGSLDKTEYQRNGIESLLGWGEIVPTTFQQDRERTALNAAFQYRPTDALEFGLNIMSLQLDANNANTSIFLFPTQRGENTCLKKNAAGVCTLVEHTDKDGFAWAQTWARKASMSSDTIDLDFTYQADDYKLEGRIGKTKAEGGTDLTSNYGQSIGKPEDFAGIYDATGDVIKINIANNSFDASDFNGQLETAGWALKKQPNTDEEAFATFDITIPVELGVITSIKSGISYADHDVTQTTEAALSSNIMAKDASAYYSGTMSSGAGFTLPKPIFNNMINDAYAAIDGFTLDKSGYGTLQEKNLALYTMATFASEGVRGNFGLRYISTDVESDYYALSDSGVYADVLSTDKASYNDVLPSVNIAFDLASDLILRASAAQVISRPNYADLFATSKLPGFNDGTPGNEKKVTGNVNLQPFKASQADLSLEWYFSGEGLFAATYFIKDVSSFISTREKLNQEIGIEDPNLVIAGGSSCGVGIYDCWTVSENFNATGGSIDGIELQLQDSFDNGLGYSVNYTFADASSPAENYADRVGVFSDSSKHTVNLVGYYEMDNFSTRIAYNWRSEYMMRELPGFYGNREHQAYGTLDLSANYNVTDYLSVTFEVVNLLEEDSIQKGVSPVNAPSVISEFKDNYPVWSFDGEARYKLGLALRF

SEQ ID NO: 2723 - protein, 401 aa, Shewanella loihica
MKNAIYAVLACLLFTLNIHSQEISDTKFGKGLINFTAKDSSFSVKFAPRIQFRSFTSWDYDGENYEDLEQAFLIRRARLKFDGWAVTPKLKYKIELGLSNNDIGGANEYTGNSPRYILDAVLKWNFYENFELWAGQTKLPGNVERVISSGNLQFIDRSILNSRFNLDRDIGLQLHHKINLGENFVIKEKFALSQGEGRNIVVGNIGGLKYTGRLEFLPFGEFTKGGDYSQADLQREETPKLMLGAVYDFNDDAVRTRSNQGSFMAFDDGSLYMTDISTFFVDAVFKYQGFSFMTEYANREASEPLAMQPGETDFAEYVVAEGNAFNIQAGYLFDNNYEIAARYSSNDFNEVTNLLGLEEYTLGGSKYIVGHKLKVQADLNYSRQDGMSNYIAFRFGFDFHF

SEQ ID NO: 2724 - protein, 699 aa, Shewanella loihica
MPAHFRLMPLSLGLCTLLASGFACAASTTLPMTSISAEAEADPDDPRVKEVSTATRTSTPARYVPQAIDTIKTANVLDYGVNDLGSALSGIPNVSSGSDTRFDSLRIRGFDASNDFYLDGIRDDSQYVRDLHNIERIEVLKGPAAVLYGRGSQGGIINRVSKLPEFGRRSSVEVQGGSQDLRSLYADLSADPTENISLRLNLGNEDRNSFRKGVSGNRQLFAPSMSWQLTPDLNWLVQYEYSRYNRTPDRGIPGVNGRPADVSRDTTYGDHRDYIDDKSQSLRSKLSYELSENWQLRHTLGVFKLDSDFDNTYQTGYNATTGKVQRQRWQQDLKTRNVYNNTELEGRFDTFGLEHRLLTGLELGSQRRDPILYNAATSGPGSQAVPAVDLYNPNPYQSHTGRMQVSSNNHTEVESRALYVQDQLRLNDQWQLLAGLRYDNFDVQTSNRKNGLSESRESHSVSPRLGVVWTPLEHHSFYASWSKSFSPVGGGLIGITPNAAGNGNDLSPELTRQKEVGVKSDWLGERLSTTLAVYELELYNRRTSDPQDRSITLLTGLQRSRGIELTGTGKIVGNWYLRGGIGLQDAVVVKDNNGFEDKRVNNVAKRNGSLFITWKPELGWYAETGLTLVGDRFADSSNTVALPGYGRWDALAGYRHKDWDVRAALNNIADREYYSSATSAFQIQPGDPRSLVVTGNYRF

SEQ ID NO: 2725 - protein, 730 aa, Shewanella loihica
MFTKSRIPLFALAPVSLAVCSSLAFAADNKATAEENPMEVMLVTADFRGLSVEKIPSSVTVIDAQKIEDEGARHFEDILGSVANFNWSGGTSRPRYFQIRGVGEQEDYKGAPNSSVGYLIDDIDLSGLGMVSSMYDLQQVEVLRGPQGTRYGANALAGLIYLKSNDPTEQFEHGARLSLGNDNLKTFAGFSSGPMMESGELLYRVAIEQHRQDGFRDNLYLDRSDTNKRDELSFRTKVRWYANDHTQVDFTLMHADFDNGYDAWTLDNNGFDTLTDMPGTDAQRTTGVGLKLLYDGFDKAELTSLTSFAGTDHHHGYDGDWANPEYWAARQCTDDYDVNGNGDYADLLPCEYDYTWDKRGDRSTVSQEFRLASNEAGKIWGGSTAWLVGLYGMQLKEDNDLASFYNGWPDETLRSSYEATNLAIFGQLDSDLGQEINLSVGLRLERRDADYSDDAGDAFDPSETMWGGHIAIGKQLNEQHNLYGRIARGYKAGGFNMSLPAEFADKKEFDTEVLYNYEIGLKSSFLEGNFDTNLALFFMDRQDQQVSASQQDPAKPQRFVLFTENAGSSTNYGAELDLNWYATDNLHFYGSLGYLKAEYGDYSYQDKYGGLVDLSGRELAHAPNWTWSLGTTWRADSGFFVNLNANGKSKFYYSDSNDSVSKDYGVLNARAGFEGDIWSVYVWGRNLLDEEYGVRGFYFGNEPDNGWADKQYIRFGDPRAFGLTLDVRFL

SEQ ID NO: 2726 - protein, 418 aa, Shewanella loihica
MFQASWFTRGMQTASLAALMTPMLAQADFVEDSQLALGLRNFYIDRDFKGDNPKNSRVGSWTQGFDLRFNSGYTEGTLQFALDASMQYAYRLDGGGGRGPDSIIPYSTRRQEQATDYGRGGYTAKVRYSKTELKYGEHRPTLPVAYTDDSRQLVTTYHGTLIESKEVDKLTLTGGRFTEISGRESSNSEKMYLFNGPDVQRRSDGLNFGGASYAFTPALTGTYFYGQLEDIYRQHYLGATYLADLGSGYALKTDLRYFNNKEDGDALYGRIDNRSYGAMTTLRKGAHSFGLGYQRMLGDSTFPTLNGYAPQPYLVNWSAVAFVKPNEKSWQARYDYDFAGLGLPGLRLMTRYMRGSDIDRGALSDNSESERNIYLSYVVQEGPLKNLGVELRNINVKFRHGNDFDENRLITTYTWKFW

SEQ ID NO: 2727 - protein, 234 aa, Shewanella loihica
MMIKKISGRHAASGLVGVSVCVFFCSTASAWQQEYIVSDAQSHTTERYTWDADHQPRYDDILAERIRSSQNVPGLALNMPDNYPAESASTLSVGLNMPVTRNTTTGPVAAWHYDGSTQMMYNEFGDNGSPTSLTDPLWHASVSTLGWRMDTRVGDLRPWAQVSYNQQFGDNQWKSQSGMSRLPTSMQYNNWMDVTVGADVLLYPHLAAYASLSQAESTMTGEDYLYTLGVSARF

SEQ ID NO: 2728 - protein, 678 aa, Shewanella loihica
MIKTRNTKIAVIISSLLACQYAVASDTNDVFSLGEIVVSEETGVRDIAINNTMTAEQIELIGAKTVADALDYIPGVHVAQSSKGEKFLTIQGFEQDKVLILLDGVPYYETNYGQLDLNQIPANIIAKIDVVKGASSVLYGPNGMGGVVNIITKKGQEGVSGDLQASFGQMGQNYQSGTLSLGKNGFSLFASVDHRGRDAMRMSNDFEPVLSDVRDKYGDLPKQMIVEDGGKRENSAYESTNIWVRGGYANENTELFASVFSLDSDRELPYNTRNNKVFSDFSSFADISEYKDTGMDLSGLHRVNDWLTVRALGYYHMHNDSYDSYSNPEKDVKLATSSFSDYTAGGALFTDMVLADWNSLSLSVNFKNDVHKKKNVAYIDTDRSHAYERSQLDTISLAAEDTMTFGALNVVAGIAWHKQTVVEDRDYDAASGEDGSDTLDPMLGMSYTLDNAGLIYGSIAQKTRFATFTEMYDDTGARHDIKPERNTSYTLGWKNDFSHQLLNSIDIGLFYHDVSDKIVSTYMPDPTDPDWDLEVYQNVGSSEFYGIEISTQSQLSENISLSLDYTYTHARNTTDDRDSDYFRDIPKDTVTAIVNWYQPWLDIDSNLRVRYRTDILIDDRSDEWESETLTIDMGINKSITPQLSAYVNLNNLLDESHYEGYGQPNEGRSYEVGVKYRF

SEQ ID NO: 2729 - protein, 873 aa, Shewanella loihica
MNSLTLTAKAVRTSLIAAAATSVAFSGFAFAEEQSDGAKVERIEVTGSRIQRTDMETASPVTVIDASAIKAAGATSIDEVLQKMTATGGAMTNPGINNGSQGNASINLRGLGSQRTLVLVNNRRMVNSGTGAASTVDLNTIPVSMIKRIEVLKDGASSVYGSDAVAGVVNIILKDDFEGLEANVQTGVSGQGDASETSFDLTMGGSFDRGNVVMGLQYMDRGEASMADRDATQCDYAERVGADGNLELYCGGSSYTPGGHIWGPDGRDSLQGSLDGTWHEFTDDDKYNYNASSYLYTPMQRLNLTALGNFELTDSINLFSEAMYSKRWSEQQMAPQPIWTDTFTYTEAMGDSLLEHGYEYGDELDYGRRMADVGNREFSQVVDTVRVVVGLDGLLDNGWAWDTSVNYGRNDSVDRLANLINMGSVNTGIEEGTFNPLDQASWSQENMNEYLYTELNSGGSEMFIVSANLSGEALELPAGYLGFATGLERRTEKAWFIPDSLTSQGMANDPKVEPTGGEYDVTEAYLELAIPLLSGVFLAEQVDLSAAVRYFDYSTFGSDSTWKLGLTWRMTDDFMLRSVASTAFRAPSVDELYSGKSPSFDQVEHPVGQDQAEVTRGGNPNLTPEEAETFTAGFVYSPSWFDGFSVTADYYDISITNSIALVDSQYIVDQCMDAQGNPINTETSLCQSADIKMGGGNRIIFNNQLQNIGAENTSGIDINLAYAFDAVGLAWTTSLDSTILLENESIILGESIDYAGLITSGSGGFAKYKTNFDLGVEGDSWGAHYQARYISGMDSYACQSEPSSCYAPSTDSIIYHDVSATYFLPQGWTLSAGVNNLLDEEAPYYTGNNDANTDPYTYDTLGRYFYLQASVKL

SEQ ID NO: 2730 - protein, 385 aa, Shewanella loihica
MNKKLLALLIPSILMAGSAQAVEIYNDQTNSIKMMGWLGFAAINDTHDTAVVDNFSRVGFRFDRQEKNGWRSFAHTEWGINMVTSDDSLSYSGGQLGAERNSDFLFNRLGYVGLANDKWGSLTFGKQWGVYYDVAYTTDVLNVYTGYSVGAYTFGDGGLTGAGRADSAFVYRNSFGNLSIGLQYAAKQNGDVALYDKDGMPINDGSHVEFDTSYGASLTYHFTNKFKVLAAINRGDFTGELAGESVDDTNEIIGIGAQYGSFYQYAPNRDADGFYVGFNAHKSKQNELVAGELYDSTGGEFLVAYQYDNGFVPTFLLSYQDLDTDASTRIQGDWTRQFAVVGLHYRYSNDTVMFAEAKIDFSEMDDKSFENLQDNSYAVGIRYFF

SEQ ID NO: 2731 - protein, 1069 aa, Shewanella loihica
MKRNYCLSLVLLALFGVSAPFAANAAVESVLSSQSTQQAKKITGKVLDAAGEPIIGASVLVKGSGTGAVTDIDGNFSVEAPVGSTLEVSFIGYKTVTLKVTNATTYTVSLQDDSQALDEVVVTAMGIKKERKALGYSMEDVKSDELMKMKTANPISSLSGKVAGVNVTQSSGAAGAGAQIILRGGTSGAEGKDNQPLFVVDGVIFDNSSSVVGNSAFDGSMRSASTTSNRLMDINPEDIESMSVLKGPAAAALYGSRAANGVILITTKKGKEGVVEVNINSKFTASWVKSLPQTQRQYARGYMEDQYDSKKNYTGTVFNDFAYTSWGEKSNAATYDNIGDFFQGGNIFDESASVAGGTKNSKFYLSGSYYDQVGVVPETGYKKYAFRFNGEQKVGIFTFNASAAYSDAHTDRTLTGAGLYNSSGNGALYGVYNWSPFDRMTHYQNEDGTRYRLFGDRLDPWDERDNPYWIVNRNHMYDDIDRFNGMLSIKADIAKWWFVSYKIGIDRYTQTASNRLAANGVLKQVWQKGMMSDNTQQFRYMSHDFMSNMSHKFGDFDLNLLLGATMDETKTDRSSMMAWNFSVPDFFSYANASKDNKQFTHAATKKRLVGAFGEFRASWKNMLYLTVSGRNDWTSTLPLENRSYFYPSVSGSFVFTEALQRLGWLDDSVLNFGKLRASWAKVGKDTGVYELETALWPTGTYLDGTVGVGNTWTRGNDKLKPEMTKSTEIGVELSFFKNRLHIDYAYYTNDSYNQILAPRGPQSTGYIFWSINAGNVYNKGMELSISGTPIQTKDWTWDIGLNMAGNRGTLDGLPEGMGVMYVTDVQYAGMQAASFSGGDFMGIAGTKWKRNDAGEVILDKNGMPTYDKTLVAVGNRESSFTGGLNNTLTWKNFTFNMLWEFRVGGDVVNGTQYAMDNSGVSQFSADVRNRSLTVTGVNANGDPVTNTWEADKTYTFNGVQMSGYNIIKDYYQNYYSKESANYITDVNSLRLRSVSLSYEFPKTWLSKIGFVKRASVSVAATNLLLITNYDGDPEVAAAGAGVGGSSSVGFDYCGVPATSTMSFGLNLTF

SEQ ID NO: 2732 - protein, 1062 aa, Shewanella loihica
MQPLSSIRCQRTVIFVTAPIWRAIEMTIHSARHRRPFFCSTSPVRYGRISMLALALSGAVGMLATGTAAAQSTTAGIYGSAPASAGATVTAQSDNGFTRTAPVDASGRYAIGNLPVGTYTVTLQREGQAAETRKNIALRVGAGTDVSFGSSHASSGTATLGTITVTGNNISPVDVSATASRTVITAEQLQRLPLARSGEAIALLSPGAVQGSGYFGNAISFGGAGVTENAYYLNGYLSSNPLTNIGGVTLPYGAIDQQETYTGGYSARYGRSAGGVLSQVGKRGTNEWHFGGQMLWRPKSLSSDYKDVFYPDTPLPSSDYSYSKPKLPGTLYRSRKGDKAWNTVFSAYVGGPLIEDKLFVFLAAEQERKDGVSTASRGASVIGRDTYRVDKPKVYAKVDWNINDSNILEFTGVKNNDRESGAYSDFSYPGVIARSASGAFADTVKVDDRYYIGKYTSYITDALTFSATYGKSQQSDYRNNPSLAPYLYNANREDPAITGGGEIHNNQTSTQSRDGENRTHGLRLDLEYVLGSHTLASGVDNMYFNANNEGALTTGPGYTWSYDNLDPNVPISDTLGVGPAGGNGYYVYRGVFKTATSMSVRQKAYFLEDKWQINDRLLLILGVRNDKFTNFNDAGKVYVESGDQWAPRLGISWDAFGDSSLKVYGNVGRYYLALPNSVAIRGASPSTKTSEYFTYTGIDAQGNPTGLTPIPVDPSVGVSCSGNVVSSDRECGQQPDVASVAAHNLKSMYQDEFMVGFDKTLGSDWVTGAKFTYRNLGTTIDDVCDSDKMRTKLTAIGVDPSTVDVPGCVIFNPGETNSFSLANLDGSGRTALSMSSADWGFDKKAKRKYLALDLFLQHPFDGTWEGRIDYTVSRNFGNTEGQVKSDIGQADVSKTQDWDAAALMWYSGGYLANDRRHQIKLYGSYQIAPEWLIAGNIRVLSGTPKSCLGYVSINGISENSAAGDPVGYGSSYHTCNGQPSRPGDAGRLPWTKIVDLGLTYRPEFADKKLAFTLQGFNIFNERKPLQVDSIWEDNHYKLSNTYGMGVNFTQPRYTVLSVSYDY

SEQ ID NO: 2733 - protein, 799 aa, Shewanella loihica
MKRFNAITLALASSFFITPVASAQQDSAQDVEEVIQVVGSRLSMRTATDGAAPVDIISGEDLAATGITETAKALQYAVPSFNFPSSSVTDGTDAVRPASLRGLSPDHTLVLINGKRRHKSALVHLSGTTGRGSSNVDLNAIPMAAIKRIEVLRDGAAALYGSDAIAGVINIVLKDNASGGNASIQGGQTYKGDGEQWKLSASSGFAIGSDGALTLSGELHHKNRTNRAGPDPRQQYPELPNGDPDPREETFDRQSFHVGDAEYENASLFANMDIAIGEGNFYAFGGISDRTSESGAFYRRALQSNTLTELYPDGFLPILAPDVNDHSIYAGYEWLVGEWTLDFSGGYGFSKFQYNVENSLNASLGPELTPTSFDAGTLENSESNVTLDAQRFIPFANNSEISLAMGISYRENSYEVIAGEEASYINGGYEDRPGGSQGFTGFSPDSEVDESRDNVGVYVEAENQLTTDFMWGAAVRYEDYSDFGNNTSWKLSGRYDLTDRVAVRGAINTGFRAPSVQQLYFSNISTLFVDRGNGLEPEQSGTFNNISPVTQALGIGALQPEESESVSLGMVWNGYDGLAITIDAFQIEIEDRIILSGDVAPGDSPAVEEALAGTAAENARFFLNAVDTTTKGLDIVASKTFGIGGYGDLKAQLAYGYNTTDIDSINLPQLLDGLDDVLFDSDEQIRMTRSTPDHSGSIGLTHTKGKWTSNVQFSYFGNYAIGYSSGTETYGPNWITDVTVNYQWNDALAVRVGAQNLFNEYPDERSEGNQFNGIFKYPLTNSPIGFNGGYFYSEVEYKF

SEQ ID NO: 2734 - protein, 965 aa, Shewanella loihica
MYKNSLLANSVRFALISGAAAAAFTAPAVYAADEETVERIEVTGSRIKRTDMEGANPVTTIDAASIEKMSVNNVGDLLQNLTSSAGAATNTQTNNGGDSSTRFSLRGIGSERTLVLINGRRVVAGGGGANSSVDLNTIPTAIVKRVEILKDGASATYGSDAIAGVVNIITKDDFEGFEVKLNYGGSDKGDAVTKGVDVTFGAASDRGNVVVALGYSDQGDAFMGDRDFSEFELRAYEDGHTEPGGSSAPPWVNANTADGRVTRGPEFGDWRPYSGATDSYNYNPVNYLQTPSKRRYASVFSNYTLGEFGFLGEVNSFAEASYVQTTGNRLIAPEPLAPLIFFGSAAPYSPNNYYNQKMGPKDANGNAYVIDDWRRRMLETGGRANERDYKTFRTAVGFNGVLENGWDWEVSYVWGQSDSVEKAAGYFNLDRVAEAVGPTGWLDANGNLIVDGNGDAVVDANGSQLVCLDADGGTIDGCVPLNIFGTPGTADEITPEMLQYISGDYNTTETGQNKQEVLSAIVSGDLFDLPAGSVGFAAGWEQRKESGSYTPDSLILQGITTAGSAVGTSGGYDVQEFFGELIVPILADAPMAHMLDFEAAMRYSDYSTFGTNTSGKLGIKWMPVETLMVRATLSEAFRAPTTSDLFGGASVGFPEAIDPCDRFAYDSDAAYAAVIASPQWANCTGTGVPVAGYNSGGVEQIPTNGGGSDNWGGTENLTPETADVLTVGVVFNPDFIENFSMSVDYWKIELENAISTVGTQTRLDGCFNSGEYCNTITRFGATSPAAGGIITVDNYTVNVGGIDTAGIDYDLRYTFESGFGDWGLGLDGTYLLEYDKMLADGSVIDHVGRFESNHDGMFAKLKTNFTVNWSISDFDTSLITRYISGVVETESGWWTDPFERDVDSNIVVDFQTNYAATEHLTITAGVDNLFDEQPPFVYSAFGANTDVSTYDVIGRTVYLRAGIKF

SEQ ID NO: 2735 - protein, 286 aa, Shewanella loihica
MKKSVIASAVSLVMTSLLSAEAPKQESTIKTSPIKKGERNAAFIGIDYQLGMLSTTAQNCSNGNCNGSQSGGYGSNTPNMPTASNPTGGLTHGALGTRGYKGLSNQQYPINGFGFIVGYKHFLKKSPQFGFRYYGFFDFASSYYRYNTFNNYGMQDARKGAQNFMFGYGAGTDVLFNPAIFNREKLHFGFFFGVAIGGTSWGPTNYYFKDLANQYRGSFHPSNFQVLVNGGIRLGTKHQGFEIGLKIQTIRNNYYTASADNVPEGTTYKFTFHRPYAFYWRYIVSF

SEQ ID NO: 2736 - protein, 393 aa, Shewanella loihica
MMKKTFFAAAAAGSLASALPVDSQAQSSVTLYGVIDAGITYVSKVASVTGHGSVLKYGDGVSQGSRFGIRGAEDLGGGLKALFVLENGFNSGDGTLGQGGAMFGRQAYVGLVKDGIGSLTLGRQYSLSTDILGAGYTMGSQTPAGNYAYHINDLDQLVQSRLNNAVKFSSANFAGLTFGGMYAFSNSTNFSGAPTTTAGTTATQGSSSAYSFGANYTNGPFGIGAAYTNIRYPNGATPPFGVSVANVNTGGLRDLETFGIGTRYAIGAGLAWANWTRTKLEPLAGRSSTLNNYEIGGRYLFTAALNVGLGYTFSDLSDRFEGKWHQINGAVDYALSKRTDIYLLAVYQKASGSNSVAGRSVQVQAEIGSAPSFIGNAGANSQLVTRVGLRHKF

SEQ ID NO: 2737 - protein, 1050 aa, Shewanella loihica
MKQMKNNSNLKNAWLCMMAMLLFAVFPVFSQNTTIKGKVVDEMGEPVIGVNVTVVGNKSLGAISDLDGNFTLSVPTNATLSVSFIGYKNQTIKLNGRTSLEIVMKEDAEQLDEVVVVGYGTQKKVNLTGAVSAITSEGLIATKNQNAQNMLTGKVPGVRVIQKTSEPGEFNNQFDIRGFGTPLIVVDGVPRGDMQRMDPNEIESISVLKDASAAIYGVRAANGVVLITTKRGEKNKTKIDYNMYYGFQKPSEILKPVDAVGRMTLFNDVQMRDLVNPSRKYPQEAIDEFLTGKRVSTDWYDAVMANSAPQQSHNVSISGGSDKMDYYVSFAYMDQGGFFKGDALDYNRYNVRSNLNAQLTKNLRVSVKLSGMIDDREGNSKDSWEIFKNLWRSAPDDPLYANNTAPYYQKPQSSDDNPLALIDTDLTGFKKRGNKLFQSSFEGEYTIPKVQGLKVRGMFSYDTKENDETTWNKEYNLYTYNAAADSYVAASRLGPTQLRRTHNSSWSTLWQAAISYDNTFSGHHVSGLMLYEEAHNVGDNLWAQRNFSIPLPYLFAGDSKEQVGMANANGLSESASKGLIGKFNYDYKGRYLAEFSFRYDGSSKFPSDNRWGFFPGASIGWRMSEESFIKDNLKFVSNLKLRASYGKMGDDGAADYQFLSGYDYPNTSGGSNNNYPTGYVFGGAYTNALGFRAVANPNITWYTVKTLNIGLDADLWDGLLGLTFEVFQRDRDGLLANRLVSLPGTFGSTMPQENLNSDRTKGIELELRHNNSIGDFRYNVSGQVSLTRGMRRYYETDPAGNSYDYWRNRNLNRYNDIWFGYGAAGRFTSYEQIANSIYSGNATLPGDYIYEDWNQDGVIDGSDMHPIATTTNPGSSWQDKRNYPLMNFGLTLGASWKGFDLNLLFQGSAMSYVAYGEQLSMPLAFDGNALDMFLDRWHPVDPDQHPFDPSCEWIPGYYSFGGAKAMPKDDSEFMIQKGDYLRLKSAEIGYTFPKQWLSSVGVKNLRVYFNAYNLFTITGVRGVDPEKPTDLYGYMYPLNKTFNFGANITF

SEQ ID NO: 2738 - protein, 334 aa, Shewanella loihica
MKRASLLTLTLIGAFSAIQAAWAVDYPLPPTGSRLVGQNQTYTVQEGDKNLQAIARRFDTAAMLILEANNTIAPVPKPGTTITIPSQLLLPDAPRQGIIVNLAELRLYYYPPGENIVQVYPIGIGLQGLETPVMETRVGQKIPNPTWTPTAGIRQRSLERGIKLPPVVPAGPNNPLGRYALRLAHGNGEYLIHGTSAPDSVGLRVSSGCIRMNAPDIKALFSSVRTGTPVKVINEPVKYSVEPNGMRYVEVHRPLSAEEQQNVQTMPYTLPAGFTQFKDNKAVDQKLVDKALYRRAGYPVSVSSGATPAASNAPSVESAQNGEPEQGNMLRVTQ

SEQ ID NO: 2739 - protein, 534 aa, Shewanella loihica
MRLAVASFACISALSWHLGYPFKFSLMLFHEKTFVLCLVFIFAFVRTEAEAQTNEAFQLEENQEILGGSGPEVSQISTATVTLSMSTSPNDGGLDTRNSLLGDAFGLRSWLGKYGVTLSINEIDELWGNATGGIRRKAAYNGVTSMTLTADLSKSIGLEDGLFNVSGLQIHGQPFTISTHLGVLNPTSGFEASLSTRLFELWYQQAFLDHRLDVKIGQIDLDSEFIISQYASLFLNASFGWPLAPSIILYSGGPSWPLAAPGIRLRYRPDEQLTLMFAATNDNPSGHAFRNAFDPSNQTVHPAGNNFNLNTGAFLIGEVQFAVNSQDIDDPSKAGGLSSFVGGLPGIYRLGGFYDTASFLDQRYDTQGVPLASPDSNGEPMPHKGNWMLYGIMDQMLWRPSHYSPTALGLFIRATGNGGDRNVVTVGVDAGLTLKAPFEGRDNDTFGVGWGMGQISTRARGFDWDMLDASGGSYPIRGAEHRLEITYQAQVAPWLIVQPDIQYVWNPGGGVPNPLTGAKIGDELIFGIHTSVAF

SEQ ID NO: 2740 - protein, 316 aa, Shewanella loihica
MMNVFCKTLLASALASTTLASAYAAEPLTVYGKLNVTAQSNDEQGDATTTIQSNASRFGVKGDFELSSSLQAFYTIEYEVDTGAETSNNFTARNQFVGLKGSFGSFSVGRNDTLLKTSQGGVDQFNDLYETGDIKVLFKGENRLSQTATYLTPSFGGFVFGATYVAEGDANQQGQDGFSLAAMYGDAKLKESAFYAAIAYDSDVKGYEIIRATVQGKIAGFTLGGMYQQQEETYKDELPVTTDSVNGYLFSAAYDIKAVTLKAQFQDMEDKGDSWSVGADYSLGKPTKLLAFYTNRSFEASSDDDKYIGVGLEHKF

SEQ ID NO: 2741 - protein, 279 aa, Shewanella loihica
MKNVKTLALAATAVAAMSGNAFAADRSDLHGSDYKWMQFNAMYSIGEKPDNPASGDQHNYLEMEFGGRSGIFDLYGYVDVFNLANENTKDGDKNPGSGTSKLFMKFAPRVSIDALTGKDLSFGPVQEVYFSTLFNWDGLNGEGVNSTFWGVGADVNVPWLGKTGMNLYGYYDMNAKEWNGYQFSANWFKPFYFFDNKSFLSFQGYIDYQFGADEDKTAFVPKTSNGGNIFFGLYWHSDRYALGYGLKGFKDVYLLEDGAGALALESTGWSHYLSATYKF

SEQ ID NO: 2742 - protein, 674 aa, Shewanella loihica
MMEFRCSRNSSWFFILSGVLMLCLIIGAKSQAAEVKDGDGVFTLGEIEITAKGEESKNTTIEKITDQEMKQFNRDTLGSALNLVPGITLSTVGARNEQMVYVRGLDQKHVPIFLDGVPIYVPYDGYPDLNRFTTFGLSEIVVSKGFTSVLYGPNTMGGAINLVSKRPEKALEGDAGIGMFSGEGYRGYANVGTRQKLWYAQGGISFLRSDFFYLSDDFDPTPAEDGDRRENSYRRDWTYNLKLGFTPADGHEYALSYYKQKGKKETPPYAGTASTETIRYWQWPYWDMEGIHFNSRTPLGDKSYAKARVYYDQYQNSLNSYDDATYSTMKKKSSFMSQYDDYTYGGSLELGTSLVPRNLLKVAGHYKMDVHKEHNLPDPFQRFEERIYSIGAEDTITITDKLHAILGLSYDRQETVQAEDWNYADHRDFPDSDADAWNPQAGLFYSFTDTRKINLSVSQKTRFPSIKDKYSYKLGRAIPNPDLDPEKGTNYELGYQDVLFQRIALKTALFYRDIEDYILGVTVPDPNNAGKTTLQNQNIGDVNQYGFEIDLSAPLTTTLDAGINYTYIYDDNRTNSDKITNVPEHKFFAYVKYTPVKFLSFLIDMETDSKRYSSSDGVRVAGDYTVVNAKATYEILKGLQIEGGVMNLMDEDYAFDEGYPQAGRTFFTNLTYRF

SEQ ID NO: 2743 - protein, 861 aa, Shewanella loihica
MKRPQILPSACAIAIAMAFAPSISYAADNGADKVERIEVTGSRIKRTDIEGPSPIQSIGKEDIANMGFDNLQQLLERMPANGAGAFSTRGNSQDSTANGGASISLRGLGPDATLVLINGRRVAASAFAEGITNSFVDINNIPVSAIERIDILKDGASAIYGSDAIAGVVNIVLKKDIEGIEVNLGYGDTPGTGYDETTASVVWGVKSEKGSASVILDYFKNDTLSATDLGRFGTADQSPYGGEDFRSSRGFPGYFYVDGVKTIDPSCPPDRATASGSCLFDYGPYNLVIPEAERIGAIGQFDYHFNDDLTAFLELAAQHNSSIAGGAPTPLDEDAALTVPGTHPNNPWGKDIEIGRFRTVDAGARRWDIESDTLRLVAGLRGTIKEWDWEASVQRGRSESTQTGDRTQGWVRTDYLQAEIDAGRYNPFGGTMNSQDVIDAITTSLVRQGLSSMTSYAANISGQAFTLADRDIMMAAGVEYREESVSDVPDEQFQRGLIFGTEAVSAAASRDQYAGYVEFSIPVTDNFELQLAGRYDHYSDFGSTTNPKVAFQWGITDELTSRGSWSTGFRAPSLAQIGLGPSRESSFFIDTYRCAADGVDCEALDYNTEFQGNSELDAEESETWNLGLIWAPSQKFDIGFDVYSITQDNKIDKQPLGDIYTANCNDQNSTVCERLAPQAGQTLGPISIIHSSFINLSSQDVQGVDLSTHYGLELDSFGDLKFGLEYSYLHNFEKDGLDYTGEYKFPQHRWLLTTNWTMDNFAANVNLSYIGEFEDTPDIDFDGVLDFETNKSRMVDAQLLVDMSGSYRFNEMFKLTLGVNNLFDEEPPFAIGDGDTDLYGYVISVHNPMGRYIYTKLTMNF

SEQ ID NO: 2744 - protein, 617 aa, Shewanella loihica
MGTQPSKIALLISSLISFTAFTATAEDLGASSATIDETITVTGSRFDRTVDQQLTVINTIEREEIARLNPKSVADVLETLPGVSVSRNGGAGQATSISVRGSNSNHVLVLVDGVKVGSATLGTVSFNTLSPENIERIEVLKGPRASVWGSDAIGGVIQIFTRELKGGEWFAGAEYGSNDYVRGSFGAGMNHGDGNTTLAVNHEQSDGYDVYNGAEVENDDDGYKRNALSLKGSQQINQNWQALWNGQYDKGNTQYDDIYASGSADESDYENYLWSLATQYSREQFTSKLAVSQSQDSNENFRGDDASVAIAEFETKRDQVNWSNQYLAADDLTITGGIDWSREQVRGDYAQDERDLFGAYALIQKQWSKLLAEVAVRYDDVENIDSETSYNASLAYQFNEQWRIAATTGTAFKAPTFNDLYWPDSGNSDLISETAESYELTLHFNNQDLRAYISVFQNKIDNLIAWAPTGEQDDFGWDIWKPANINEAKITGVELSANYQLLGLEHQLGYTYLNAENKQTDEQLIGRSENEFNYLLSYTWQQFDLLANYHYQGKRYAGYEQYLDAYHKLDLSLGFQIDDAWSLRLKANNLFDEEIISDQNYFSPGRELFFSVSYQAF

SEQ ID NO: 2745 - protein, 147 aa, Shewanella loihica
GSDDIQGIRLAYRPYATQLTQIKWLGNLDIYWEVSMNFWEVGEQNRHETNYAVAISPVISKQFATIANKYPLRWEFGIGVSLVEDTRFAGKDIGSHYQFEDRLGLVTDFGENMNHSVALRYMHYSNGGLNDHNPGVDFLNVSYAVYF

SEQ ID NO: 2746 - protein, 332 aa, Shewanella loihica
MTTGTINGSRFGLRGTEDLGGGLKALFVLENGFNANNGALGQDGKLFGRHAYVGLSRSGFGTLTLGRQYDTMVDFVAPLSATAGDFGDTGFAHPFDNDNLNHSVRINNAVKYTSDTIAGFKVGALYGFSNSTNFAGNRAYSVAASYTNGPLKLAGAYLQMNGTKGSTSASPGATDVAEAKSVSQGGWSVGADRMRTYGGGVSYGFGPATVGFVYTRSQYDNSGSFGSTGQVAFNNYDVNVRYAVTPAVSLGAAYVYTDASVSNPGSKHGTDPKWHQVDLQAVYKLSRRTDLYAEAMYQHASGRGYQAFINTSGGASSTANQIVGTIGMRTRF

SEQ ID NO: 2747 - protein, 314 aa, Shewanella loihica
MKLKNTLLASALLSAMAFSVNAATELTPEQAAAVKPFDRVVVTGRFNAIGEAVKAVSRRADKEGAASFYVVDTSDFGNSGNWRVVADLYKADAEKAEETSNRVINGVVELPKDQAVLIEPFDTVTVQGFYRSQPEVNDAITKAAKAKGAYSFYIVRQIDANQGGNQRITAFIYKKDAKKRIVQSPDVIPADSEAGRAALAAGGEAAKKVEIPGVATTASPSSEVGRFFETQSSKGGRYTVTLPDGTKVEELNKATAAMMVPFDSIKFSGNYGNMTEVSYQVAKRAAKKGAKYYHITRQWQERGNNLTVSADLYK

SEQ ID NO: 2748 - protein, 213 aa, Shewanella loihica
MMKKTIVSGLIAAALLSTGFAASAHQAGDIIVRAGGVVVAPNESSEDVAGFGEFNISSNTQLGLNFGYMLTDNIGIELLAATPFSHDVSLKGVGKIAETKHLPPTLVAQYYFGSADSKLRPYIGAGVNFTNFFDSEFTNDLDGALTDLSLSNSWGLAAQAGIDYQVNKNWLVNASVWYAKINTDVNFKLAGQAVSIETDIDPWVYMVSVGYTF

SEQ ID NO: 2749 - protein, 819 aa, Shewanella loihica
MSDKSISALRTKKKAKPGIDHIWPWARHSCIALAMAASMQVIAQQPINIPAQPLADALKQLGEKTGLQIIYDAAIIKGLNSQSAQGSNSQEVLRQLLGNTNIKYTISGNSVTLHAQNNAAALPSVQIISAPLGSTTEGSGSYTTGDTNSSTGLALSLRETPQSITVMSHDRLKDQGLTDVDKVMEQVVGIEPDRRSSIGGDSVGYVARGFFVSNYQVDGIPRPAAIYGFSEDKADLLAYDRLEIVRGPSGLMTGAGNPSAAINLIRKRPTDDFQANISAKTGSWDLYRLQTDVAGSLSDSGKVRGRFAVAKQENDTFVEREHIDRQIVYGVVDAMLFETTEVFAGVEYQDIKATGVSRGGVPLYFSDGSKTNLDTSTNSGTDWSAFNHDSTTVFVGLEHFFSEIWKLKLDAEHKEGTYDQKFGYAYARTINKDTGAGAMLYSTRWNGDTELNAFNANLQGAFEWFGRNHELAFNLFHAAYKSEAPAYPGWYDGGDYRATISNIFDFYNTGAWPEPDLSATGIINGGDVKTTSLSGVIRLKPSDSVSVILGSRLTDWEQTRWSKNTGAAAITSPVTKENGVITPYTGLVVDITDNWSAYASYTSIFEPQSVKDITGNTLDPLEGNNYELGLKAGYLNGRLNISAAVFQMKQENYPVIIGNQVTAPDGSRAYRAEKGVEADGFEVEIAGQLLPGWQIAGGFARAKAEDNNGKPLRSRIPENTFKVFSSYQLHGALSGFTVGGSLRWQDTTYLENTGPNGETFEQKEVFLVDTMAKYLVNDHVTLSLNINNLFDETYYGALDVGSARYGEPRNISLSISYDF

SEQ ID NO: 2750 - protein, 845 aa, Shewanella loihica
MSLSFEKEPLQDALTTIEKAFDVKFSYKAELAEGKIITLTLKDASLNTVFQRLQEIVPIVFEKVNERYYVIRNQSQAGKIRICGVLVDSKSQLPIVEASVVNISQYKGTVTNNNGRFELFLAFPSDTIEVRFLGYKTKRLIAKELQKNPCEKVSMEADQYDLGTVLISNYLTSGINKKTDGALSLSPSKLGILPGLTEPDVLQSIQLLPGIQSPNETASGLFIRGGTPDQNLILWDGIKMYHSGHFFGLISAFNPYVIEEVSVYKSGTETRYGDRISGVIDIQTDTKVPEKLSGGFGFNMTHADAYLKIPIAKNFGVTVSARRAFTDVWETFTYNNFSERVFQNTKITKSSEIIENVFSETENRFFFTDYTIKFIGKLSDKDEVMLSTLRTKNELDFTSEIELFEETSRDQLSIRNAGFSGFWKRQWSPNFSHTLDAYYSRFDFDYLGTFRGDIVEITEQDQKRNKIKDIGLAYNTTWKIDEKRSLQSGYQFSSNDVSFGFSGFRGTEDGVTTYDAGEENINNSHAAFTSFKYNNKNELIINAGLRMNYFSTTKRAFFEPRLYIEKKLNKRFSINFSGELKHQAVSQILEFNTANFGLENQVWAIANGDEFPILKSRQISAGVLFNKKGWRIDLDAYYKNISGLTSFNRSFGNTSVLETFTEGKSNIYGVDVLIEKKINDYQTWMSYSYTDNKFEFSLINNGLTFPGNYDIRHYFRWAHSYTINNFKFSLGWNYRTGTPYTPVTSQTQANGDLFVFIGDTNSTRIPDYHRLDFSGTYTFNFDKKNNWKGKIGFSLLNIYDRKNLLERYYEIRPFLNQDDNVQFRLETVDKFSLGLTPNLVFRVDF

SEQ ID NO: 2751 - protein, 704 aa, Shewanella loihica
MKKSVLASTVAALAVYGISGSAVAGQLEEMIVTGSRVAESQSEVPASVAVVGRAEIEQQMRVSPELQNMLAIKVPGMAPATGTSSNSAQTLRGRNALVMIDGVPQSTPLRNGSLGIRTLDGSVIERIEVVKGASSVYGNGAAGGMINYITRKPDESRTVGGEASVLTRFSAVDLADSFGQRLNGTVDGSVDKFSYVFSATYDKTGLERDAEGDIIGLIYGLSETTTQNYFTKLGYQLDDDQALQVTYNYYESQQDADLVDVSGSVNSGTKTYAIKDTSGEPKPGVPQGPRGNHNVMAKYTHDALFANTQFVADVYQQKIENVFFFSSALANPDEGYTGGQSMIKSVKSGARFSFNTAVNWDGVDATFIYGLDALNDTTSQPLVDGRVWVPEMDMRSKALYLQSKWVVAEDVVIKTGVRSEDIDISVDDYSTLKLCRTAETCSVPLDVTGGEINYNATTYNLGLRYNGFSGISPFVNYSQGADVSDIGRLLRTATVEDIALIRTDASLIDHYEVGFASDFDNLSIEVAAYRSTSELGTGSEYNAETGVYMPVRAPQKIWGYEGQFEYQVNEDLTAGATYTWVEGKDTENDVYLGGRQISAPKFTAYVDWAFNSNGQLHATVLRVGDRDRFEAVDGNYVGDQGPIESYSIVNLSATYSFGNWLAQLGVENLFNQDYYPARSQVYTYNGYNTKGLGTTVNAGVTYSF

SEQ ID NO: 2752 - protein, 355 aa, Shewanella loihica
MKKSLIASAVATGAALSSFATLADGPAFYGRVDLAATNSNTGYATQNQKDGTVFENNFSWLGVKGSEKLSQNVALIYQMEFGVNNFDNSGDTFNTRNTFVGLQTQAGTALIGRNDSVFKQSEGGFDLFGNTNADIDLLVAGQSRLGDSITYYSPKIAHILTLNATYVMEDNYEEGSWFNPGEDDEWSGNTYALSATLGDKALKAQNYYVAAAYNDGLDGIKAYRGVAQVKFGELVLGALYQNSEHVADKYSNLEGDTWFINAGYKLGNTTLKASYGQDDSGLGKYVGRMVGDSDVGMEQVENVDLQQYTLGADHRLSKNTLVYGHFTRFDGDMLLGGNKVSLEDDVITLGLRVDF

SEQ ID NO: 2753 - protein, 725 aa, Shewanella loihica
MALRLGYALGTVFVLCASNTYAAVIDNSTKTLEQQTAQTNVAALPAITVKAEQDDTYAGGQVATSSNVGFLGSKKFLDTPFNTISYTDKYIEDKQAKDITEVIAATDPSIYTNGASGGWSENYYIRGYASSTNDMSMNGLFGITPFYRTSPEMFGRVEVLKGPSALLNGMPPAGSVGGTVNLVTKYAADEPFARLTTTYMSDAQFGGHVDVGRRFGENKEFGVRINGMYRDGDAAVNDQSKESRLFSLGLDWQGENARVFVDAYDALDHVDGVTRGVNVSTAVGIPKPPKADTLLSPDWGSVETKDKGAMIRGEYDFSDQLMAYAAYGQSTTEYKYNGASAGTITSSTGTLSSTLGQLAFDVDKKSADAGFKGKFETGSVKHQWVANATYYNHTQDDYGYRIIPGFSDPVITNIYDPNPNWGPKPEFTPPFLFHSTLSTSSFGLADTLSFAQDKVQLTLGLRHQTVKATSSVNTLPENAKSATTPGVALLIKATDKISVYANYIEGLTKGDQAPATASNPGEIFPPQKTKQQELGLKVDLGTFAHTLSAFEITKPSSYLDPSKLVNNLPTFVSDGEQRNRGIEWSFFGSPIEHVRLMGGFTYLDPELTKTKSGGNDGHTAVAVPKNQAKLGAEWDTQVAQGTLTLSGNINAVSKQYINAENTLSVPGRTLLDVGARYSTKVEDHPVTFRANIYNLTNKAYWAQPQLTNLALGAPRTYMLSVSYDF

SEQ ID NO: 2754 - protein, 586 aa, Shewanella loihica
MMNRFVSVNNVILVLEMILSSASASQALPEQNLSLRESGGQFLPRQGTVSLEKGETSPLPQLPKIDRDLRLRQSRDGFLNSGSRRQSSMSQVTSVSELQDISPTEWAYEALRGLVERYGCIVGYPDRTFRGNRALSRYEFAAGLNACMNTIERLIQENVAVLREDIEKLKRLAQEFEQELIALKARVDNLESRVAFLEDHQFSTTTVLSGEFVVGLTGIASGDKNGGTEEINKVNNFGYRGRLELNTTFDGNDLLYTRLATGTVPAYSDITGTFEGELGFSQPDDSDLAIELIIYEFDLAENVRMFIEPVGGAFDDFVPTVNFLDGDGASGAISSFGSRNPLYYMGEGPGIGFQGRLFEVFEWSGGYLATDGNDPALGAGMFNGPYGLIGQFAYEPSDNFKVAFTYVHGYNNLDSGTGTRRSNFQTFIEEEFEDFEASVNTVNNSYGGEFTWRVWDKFVIGGWGGFTTTRTLGAIDIGPDDDVIQRGQLDIWNWAVTLAFPDAFKEGDTGAIIIGMEPWVSDANINLPDNFRRTDEHSSFHIEAIYEYPLNDNIAITPGIIVITEPEFDDRNDALVIGTIRTTFTF

SEQ ID NO: 2755 - protein, 698 aa, Shewanella loihica
MMKKHCLLFCVASFWVCNALSQEVLLDSSIVSASGFSQDIKEAPATINVISKKDLESKPYRDVAEAIADIPGVDLFASKGKTGSYNITMRGITGYTLILIDGRRQGIGGEVGPNGFNEISNSFLPPISSIERIEVIKGPMSTLYGSEALGGVVNIITKKVSDKWETSVSLDGIFNAHKEWGNTYGTSIYSSGPLINDRLGLTLRFREFYRDQSNVEFSNGSGQRVQGDQAQSPTKANNFNLGTRLNYLVDDYNTLIFDIDFSRNHYDNKKEQLGTLTKPSDDTGALIGGYTDTMQVDKLVTYLSHEGVYENFLITSTLQYNRVSNDGREVVGQVNQPFLGHNRDIVAEDIIVDTKSVIPLGQSHILSVGSEYRLEKMQDKIANPTNFDQYLLALFAEDEYSIRDDLRFTFGARYNHHEIFGNNISPRAYLVYNPTSELTLKGGVSTGFRTPYANRLIAGAYNYSGQGKYPMYGNPNLKEETSLNYELAAVYNNDLFYISATGFLTNFKDKISSQKFSKNSMISSIGKCEAESCYQAINHGKVEYKGIELGAGITPIDHLNLDLAYTYLDSEVKDAQDKAVIGKPEEDSLKHNIMLKASYNIFNKFTPWVKGEWQVDRYMGDTNINREYYQDVFLASMGVRYDINKKWSINAAIYNLFDKSFTNAWESYKNKDDKDVWVNTYNRIEEGRRIYISINGSF

SEQ ID NO: 2756 - protein, 188 aa, Shewanella loihica
MKKQLLSALFISGIFSISTVQAHENTSLDKTTISAGYAQIKIAGQSGIMRGGNLSIRQEFNQQLGIMAIATYAQNEYDLNKPLKQLIKDVDARYYSVMAGPTLRLNDYISVYGVAGMAQIEFKGLDTRQVPESIIKKNAFSWGAGVTINPIDMLSVSVGYENSRYKMNKLSDNKLIIDGFIANIGYSF

SEQ ID NO: 2757 - protein, 840 aa, Shewanella loihica
MKNKNVKGKVKTGTYGLIASIMAASSAVAQEGDLPSSSDNKTTDLENIVVTGVRGNPRTVIESPTPIDVFSSEQLEQQGQTGLFESLRFLVPSLNLPQRSGGGTGTFIASAGLRGLNPDQTLVLVNGKRRHKTALINTSTGLFSGSAGVDLNMIPSSAIERIEVLRDGASAQYGSDAIAGVVNIILKDDSEGGKATVSTGENFDRGDGEFFSVALNNGFEFGDDGFINLSYDYKETKLSNRARTLALPEDGGKNLFLPLDDGSWDPREASVDRQVTKNFGNFPQQTSAFGLNAGTNIGEVALYTFATYANRSSDLTFTYRSAYDSRNIEEIFPRGFRPEEQIQEDDVEIITGIKGTHFDFDWDFSVSYGSNESSWYNTNGLNASLGAASPTSFFLGEMNADEMIAQLDATRAVSLDNSDLQVSFGMQFRKESFEIIKGELLSYADGNNGLAPGAQGFPGFEPEAENDVSRNNINAYIDLAWDATDKLFIAGALRYEDFNDSAGEEVLGKLNARYEINDSVALRSSVSTGFRAPSIQQLGFRGSRGQFTDLDNDGIAETIVLRQTLPPTDLAASALGAAPLTPETSVNFSAGISYTPAKNMSFTIDVYQIDVDDRIAQSSQFNRGDTRLASSGGTIGDEISALLDSAGFDASLGAVNYFTNAIDTRSKGVDLVATWTPEIDVGELTLSGAYNYNKVDVVSIDDNPEELSGLVLADGSQIEQFDRTRLGTYTDAVPDSKASLSANYRQDGWVLNLRATRFGEWTVVRSSEALDTTNEAKWIVNMEVGYQMESGVELFAGANNIFNTYPEERTENSLGTNFYDTYSPYGFTGGSWYARTSYAW

SEQ ID NO: 2758 - protein, 200 aa, Shewanella loihica
MKALKTLFIATALLGSAAGVQAADNFVGLTWGETSNNIQKSKSLNRNLNSPNLDKVIDNTGTWGIRAGQQFEQGRYYATYENISDTSSGNKLRQQNLLGSYDAFLPIGDNNTKLFGGATLGLVKLEQDGKGFKRDSDVGYAAGLQAGILQELSKNASIEGGYRYLRTNASTEMTPHGGNKLGSLDLHSSSQFYLGANYKF

SEQ ID NO: 2759 - protein, 700 aa, Shewanella loihica
MSFKIRMKPAAVAVFAALGGAHVAVHAADAVLAPVLVKGEAERADGPVQGYRATRSATFTKTDTPLKEVPASITVVPGEVIQDQAMRGMSDVLRYVPGVTAAQGEGNRDQMVIRGNNTTADFFVNGIRDDAQIFRDVYNLERVEVLKGPGGMTFGRGGAGGVVNRVTKRPLFGHVGEASLTVGSWDQLRGTVDVGEKINDAAAWRLNAMAEKANSFRDGVDLDRYGINPTITFTPGGNTALTLGFEHFRDERTADRGVPSQNGRPFDDSRSRFFGNADQSESRTGVDALTAVIEHDFGGVQLRNSFRAAQYDKFYQNVFSSNVAINPARQATLSAYNNSNDRLNVFNQTDLTTKFATGGLQHTLLAGIELGYQDSDNRRKTGQFAPGTNVVPASNPFGTAISFNPTATDANNNVESDTYAVYVQDQIALNEQWKVLAGLRYDKFEVDFNDKRAANTDLSTTDEEVSPRFGLIWTPTARQTYYASYSYSFLPAGEQLSLSPNTEDLNPEKAINYEVGARWDVLPELTLSTAVFRLDREDVRAADPLNPGFFVQTGEQRTEGFEIGLQGQVTPWWQVFAGYANLDAEITKTSASAPKGRKVGLVPDHMTSIWNRFDLGQGWGVGLGVINQSSSYTSFTNSVKLPSFTRVDGAVYYTFNDRKTRLALNVENITDKEYFPTAHSDNNISPGAPLNARLTLSTAF

SEQ ID NO: 2760 - protein, 339 aa, Helicobacter pylori NCTC 11637
EAMDVSFKTETIVEQDEAIQRQQVSDDTSRKVAILVKATSTLHKPVHHNILSDRLKVTVIGAGDEKTNINRGLWISGLYGVNKQGSWKNIPKYQGRTTGFTIGADAEFINNHDVIGIAYSNLESKIKYNKKLGKTAVYGHLLSIYGLKELIPGFSLHTIVSYGYNYIKNKSKNLDKIIGKYQNNNLSFQTLLNYKYCTKYNLHFIPSIGFKYDYSRASNYKEYNIDIENLMIQKKSNQSFESSIGGKIVSKPIIITNNTILTLSVHGNIERHFNNKNTKVNAKATFKKQTLQETIIIPKQPKFGYNIGNNILMSIKNINVLYEYNYYTHKKYHSHQGLI

SEQ ID NO: 2761 - protein, 146 aa, Ralstonia solanacearum UW551
NRHGIEKYGVDIDFDSGFHCGNPQGWFLNLDWEIALGQWRSTKGTNRQNLTEFGVTPLFRLEKRGGSWVPFIEAGIGPRLLSHTRTSDEHNFSTAFQFSDMIGVGVAFGSRQQFQVGYRFEHLSNASIKRPNPGTDLNELYLRYTF

SEQ ID NO: 2762 - protein, 1674 aa, Ralstonia solanacearum UW551
MRTLTQTILPGWRLLAGLSMLGHIGTCIRAGMRRSVLAMLALGACQMMLSSPVWAAACTVTFSTTANTQKAYVFTSTNTSNCDPFLIGIAYDSAGDANSSSGPVVNTATTQGGTVAIYNGSVPPSGDPNTNGFVYTPPTNFSGTDTATFYTSNDGVSWLPNGTLSITVTSTGPTVTGISPSSGSTSGGTSVTVTGTGFTGATAVKFGSTNASSFTVNSATSITATSPAGSAGTVDLTVTTSGGTSATSAADRFTYVAPPTANASSATVAHGSSSNAITLNITGGTPTSVAVSTAASHGTATASGTSITYTPTASYSGTDTFAYTATNAGGTSAPATVTITVSNATVSYAPSAPAGGTVGTAYSQSVASASGGTSPYTYALASGSLPPGLSLSTGGTLSGTPTASGSFSFAITATDSSTGTGPFSATSGTLSLTVSAPTITLSPSSLTSATVGAASSQSVSASGGTSPYTYAITAGALPAGMSLSSAGVLSGTPTASGSFSFTATATDSSGGTGPYTGSRAYTLTVNAPTLSITPAAGSLSATGGVAYSQSFVAASGTAPYTYALAVNSGTLPTGLSFNTATGVLSGTPTTTGTVNFTVTGTDSSTGTGPYTVSAIYTLTTSAPTVSLSPTTLSSATVGTATSQSVTASGGASPYSYAVVSGALPAGISLNASTGTLAGTPTAAGTFSFTVRGTDANAYSGTRSYSLTVAAPTIALSPTTLAGATVSTAYSQSVTAGGGTAPYTYAVTSGALPTGLSLSSAGTLSGTPTAGGSFSVTISATDSTTGTGPFTGSRAYTLSVGSPTLAIAPASTAGLTAVAGAGYSQTFTASGGNSPYTYALTVNSGTLPTGLAFNTGTGTLSGTPTTAGAVGFTVTATDSSSGSGPYAISGTYTLTVSAPTLTVAPATLPNPALGTAYSQTLTASNGTAPYTYAVTSGALPAGLSLSSAGVLSGTPTAGGSFSFTATATDANSFTASRAYSFTIGAATVVLNPATVPGATLNTAYSQTLTASGGIGPYTYAVASGTLPAGMSLNGTTGVLSGTPTALGSSTVTIRATDSSTGTGAPYSGTRSYTLTVGQTLGAAPPVTATTTSTTPVTLHPTANATGGPFSAVAIVTAPASGTAVVNGLDIVYTPTPTTSGNVTFTFALVNTAGTSAPIQATVTVNAVPIAVTQKTASTASGQAVNVDLTDGATGGPFTGAAIVSVVPANAGTATIAQQTSQATTGIKPLAAAAPVYLLSFTPASAFSGTATLTYTLSNAVATSTPAVVQVTVAPRRDPSTDPDVNGLINAQIQAARRFATTQIGNYHQRLEALHGTGRAPSGNGLTVALPSPRGDAQARCQDVFGIAARDACLRGDGSAGKPALARGKRNGETRNDAGNADAGPDLPGADADATADTSQPDLAFWTAGTLDFGFANTSAQRSGFRFTTGGVTAGADYRVSDRLSVGAGFGYGRDSTDIGNAGTKSTGDSYSLALYGSYRPLPTLFVDGVAGFGTLSFDSRRWVSDANDYAMGSRNGHQIFASVSAGYEHRDNVWLISPYGRLSVSESTLDQFSETGAGLNALTYFQQTVTTVSGTLGLRTEYAQKTRWGTFLPYARVEYQHDFNGQSNAGLAYADLASAGPAYYVMGSPYGRDRMQVGLGTKFRTGPLTFGLDYSVMVGMGGLQQGVRLTFAAPF

SEQ ID NO: 2763 - protein, 729 aa, Ralstonia solanacearum UW551
MIPFQPRALVLALAAALPSLAAAPALAQEAANPAAAAASSTSTAQATASKVRDLNETRVTAKRLDAARNALSPDTGSSVYRFDTDDIARLPLGDSTPLNQVLLQAPGVVQDSFGQLHVRGDHANLQYRINGVIIPEPISGFGQVLDTRFANQINVLTGALPAQYGYRTAGIVDIQTKGTATDEAGEPKAISGEIGTVLGSNATHEVNLQLQGTKDRFSYYLSGVFAENNLGIENPTGNRNATHDHTTQNKSFGMLSYLLDNDSRVSFMFGTANSRFQIPTRPGLEPQFTLDGVTPPASEALNANQREKTDFQILTYQQKVSPKLDYQVSVFRRASRIDYSPDPVGDLVYNGVASDVSRRNEAYGLQGDASYKLNDRHTLRAGLFVQRERFGVDNASTVFPADSTGAQTSGTPLTVIDNSSGSGTTLGAYLQDEWKPTDRLTINYGARYDHVNTIVSEQQLSPRLGLTFDLTSRTRLHAGYARYFTPPPTEKFDTTTVQKFAGTTNALSPDANTAVKSERSNYFDLGISHQLTPHLTLGLDAYYRDVRHLQDEGQFGNALLFSAFNYERGRIYGLEASVNYREGDFGAYLNLGVSRAQGKGIETGQFHFDDAELAYINSHWVKLDHDQRLTASAGVSYKYWGTTWLADALFGSGLRNGFANTDHLPAYWQLNLGAARDFNLPMVGKLKTRLTVLNVLDRSYELRDGTGIGVGAPQFAPRRTFLLLVSKPF

SEQ ID NO: 2764 - protein, 250 aa, Ralstonia solanacearum UW551
MLRKFLLSTTAFAALSGAALAADLPSRAAPPVYVPPVPIFTWTGVYVGGDIGYAWGNTSYNSQIFSAPARFAFGSYSPDGVTGGAHVGYNFQAGPSFIGTGNFVIGIEGDVQGSNYSKSVVGFANDIYTSKLDITGSIRGRLGIAFDRALIYATGGAAFGGITNQLQLRNGAFFSNDRTAVGWTVGGGIEYAVTNNWSVRAQYLYSDYGHTNSFFPNAQVHKHDTQNKVTVGFSYKFDTFAPLAPVVAKY

SEQ ID NO: 2765 - protein, 332 aa, Ralstonia solanacearum UW551
MRCTSRLTLASLAVAAALPVAAQSSATGSNVTISGYLDAGVFRDFDKTSKLGTIQRSNLAIAGFEDLGGGLKATFRLSTRFDLDTGLTEDYPKKPFWHDESTVGLQGSWGHLRLGRALSAMWSQEWQFDPWGNFNRIASPAWHMAHYLTPTDRASNNGSPEYGRMSNGVFYDSPKFGGFSLHLSASPERTEAPGRQGRARSVSVNYDQGAVAAMLAHERNGSGDTDLYMGGKYRIGTAAVMLAYDRSKSGTPGTGPDKSRMVSLGATYGIGATTLKASYARQRLDRDTNNMLSLGAEYALSKRTMLYTSLGHQRYENQSSRTAFGVGMAHSF

SEQ ID NO: 2766 - protein, 432 aa, Ralstonia solanacearum UW551
MSLTRTRLAVGVAFVALVAASQASASAFYLQEQSVRGTGRAYSGEVADKGVGSLWWNPASIAGIARSEAHFGLNQILVNSEVTNTGSSITRPVPPAGLTTAVGGADAAFDPINNGIVPNFGAAWKINDKLSLGLSVAAPYNFTTEYTANSWTRYDALKSQLRTVNVEGVVAYRVNDMLDLGLGVTAMYADAELTNALPNISPLQADGLQSLKGDGFAYGYSVGAQLHPSKSLTIGASYRSKLDHKLDGTVKVSGLLAPIPAASNFTVDGQAKITLPWIANLGARWAVNDQWTLNGSVSRVGWSEFDAIRVSFAGGGSTSPQDYKDVTTYAAGVDYQASPRLTLRAGVQYDPTPTPEIGRTARVPDGDRMMYATGATWAATETLQLDAAISYIAFDKSQINRTDVTATSSTVRLRGDVEGSAVVLAAGARFSF

SEQ ID NO: 2767 - protein, 1152 aa, Ralstonia solanacearum UW551
MQRRMTAVGFLAACMAVSGFAQEFRGTITGRVTDAQSASIPNAKIVATLVNTGGKSQTVTGSDGLYTIPFLAPGIYKLEAEASGFKRYVRDGVEVNAGDRVGIDIGLSLGQLTETITVTAEASMLDTTSATAGQVINSAQVENLPMNGRTPLVLAQLAMGVVPNSDPKFNRPFDNAGPSGFSMGGAPSQQNELLVDGAPDTTWDLRVSYNPPVDAVQEVRVHAFEADAAYGHTGGGTANVIMRSGSNAIHGSLYEFNQVSALQATNFFTNKAGQIKPVGRYNQWGGTAGGPLWVPKVFNGKNKVFWFFAMEEINDSFPEPQTLMVPTATQRTGDLSSLLKVGANYQVYDPLTGVLNGSRITRTPFTGNIIPTNRLSAIAKNYLNYYPLPNQAGAPDGTNNYLSPAVRKDTYNSEMGRLDFNLGSNNKMFWNFRHNDRIEDRNDLFSNAAAGRDLLRINWGSTLDDVHTFNGTTVGNIRLNFSRFREATVSFGDGVNATALGFPAYVAAAAPKLVLPLVRFSSTTAGTDYQQITSDTDSNRPFNIFQVFGDIVKIKGNHSLKIGGDAREARDSNQGYGSSQGVYTFSTNWTRGPLDNSTAAPVGQDLAAFLLGMPTSGSFDINGLRTNTAKYMALFVQDDWRVRSNLTLNLGLRFEHEFSNVERYNRALNGFDSTTASPIAAAAQAAYTLKPDVIPASQFRVLGGPTFASSANRAIYSPQSEMFSPRVGFAWTPFGTKTVLRGGGGVFMFPINNPSYNVDGFSQSTSMIVTTDSYLTPKATLGNPFPDGFQQPTGSSLGIATNLGKSFNYYNPDIHNPYSIRWELGIQREMPGGTVLELAYIGNHAVHLLLNRNMDAVPAKYLSTSPVRDQATIDYLSALVPNPFAGLIPTSASLNGSTISRQSLLTPFPQFTGITLQASNAASSYFHSLDVRVEKRYSHGLSILSNFTYSKLIARDNYKNATDLAPEKRVAGDDRPLRFVLSGSYQLPFGKGKHFDTHSGIGNRIVGGWVINSIYTNQIGAPLTFGNNLIYLGGPLNSNAHPGNLDAPIFDVTRFNTNSAQQLASNIATFGSRYGNLRQDGADNVDLSLLKDTAITERVKLQFRFEAFNALNRPNFDTPKSTIDNPTSSAFGKITTQPNLPRSIQMGLRLAW

SEQ ID NO: 2768 - protein, 735 aa, Ralstonia solanacearum UW551
MDGPTSGSARCPPLPHPLPHRKRRAGTPPACTARPLARAAPCRSRPPAYAAPTPATAARLARSRDSPITDNKTGAAAARPRSPHAQPDNNDSLMKIRHLLATSAATALLSPLAHAAGDTAVSQPAPAADSADLPTINVTDARRLPESFDQRYATTQVLTRTDLDRLSPSDPSITQALATLPGVTVSQNGGPGSSASVSIRGSSASQVAVFIDGIRIGSSTTGIAPWADLPTEAFERVEVISGPAAASFGANAMGGVVQLFTRRAANQPNQTTVSFGGGSNKTFDTQLRTSGTVPSTGPLAALGGLTYSLGLHSYNTAGIDATRPFAYGHEAGRNPYHAQDLDARLGYARDNWSISTFALYHRSDLSYDNSGYGNRQLDHQLTTGIAFHLDITPDTQFDQSFGYSNDRGFIYASDPTIPTDQINSQRISTSTSLTHQERGFHLFGLPLSGETKLTYDFTREQAFLPVDIPNGVPTRNDSAFSLHQSATLGSVTMFLAGRHEIIAGQSVNTGNAALSWAITPVYTARVSYGNAFRLPTFNDLYYPGYGNPNLSPERNTSVEAAVDANTSYGTFTAAIYDTRVTNLIAYNPATFSPMNIGRAHIRGIDLSYKGTIGRSTPVSVAVGILNPQDETNDSWLNRRPRQTVSLNIDHTWDELHLHALSTGASLLYGGTTFDDPANSTYLPSYLTVGLRASYRINSHVTVSATVSNLFDRQYMTAYGYNTLGRTAFGKVTYTF

SEQ ID NO: 2769 - protein, 734 aa, Ralstonia solanacearum UW551
MRNFYALRWRVRYALRGCAATVVATLTLPASAQDFEEAGGAVRVMPEISVSASREGGALDTLSRNVTVISRKEILEQQATAGSLGDLLGKMVPGMAPSSQTLTNSAQKLRGRDVLVLIDGVPTQTNRNVSRDLFNISASNIESIEVVHGGSSTYGGGAAGGIIYINTLKGKAGAPVFETTFGASSSLTEFDDDALGGRIQQKLSGKAAGVDYLISALGEQTGGFFDAHGDRIPPEPSQGGLSDTGTIDLLGKVGYDFGDQRLQLMASYLRAEQDSDFISDPAVDAFPDGTVKARALKGLQLDDQTSRENLIVNLDYSKQNLFGSKVRSQVYYRNYQTRFFPFDARAFSGWGNNLAQSFLDSEVWGGRLTVDTPITPLDSLGARLLWGADVNREKTEQPVSIYDGAAFDASGGRRFVETDAKRTFVPLTTTGSVGVFGQAELTPTDWLILRGGVRHEWVDVSFDDFTTLGGNPIDGGSIDYSETTFNAGAVFMPSDAMELYANYSQSFELPDIGLQLRFAQPGFNVNDSNLSPRITDNYEVGVRGRWGGFHASVAAFYSESDKGRVTVQNFSLVQERTQEKIYGTEASLDYTFTPAAKLGGTFTWIKGEREDPNNPGSDIALNGTRIPPIKLTGFVEYSPYHWWGIRLQALYSGNRNDAFKDNPGAFATRKVHDYTVVDLYNRFAVGPGTLRLGIENLLNNQYYTVYGQLLRNGSNTSHVAARGAMLRASYTFKW

SEQ ID NO: 2770 - protein, 808 aa, Ralstonia solanacearum UW551
MCVAVAGSCVSTFAWGQGAAVPVDIPAQRLDRALTALAQQSGVQIQFSDALAGQRTAPAVQGRMAVSDALGRLLAGSGLRARSTGAGVFTVEAQATSVPPKPAAGEPAAPAVAELEATVVSTDRTRSDLVRPTRQVTQITHDELSDLQAGSGTLATALSKVVPGMADSSHTITDYGQTLRGRSTLVLLDGMPLNTNRDSARNLASLDPNNIERIEVLRGSSAIYGSGATGGIVSITTRPAGGEPRAETTFSMTSPLSHPGAAGLGGSVQQYVAGSKGPVDYEFNVGTQHVGGAYDASGHRIAPEPSQGDLFDSNIYSIGGKLGLRIDPDQRVVFSASHYDAKQNTDYASDPSVAKLPAGSAVARAIDGLQLADQNRIKNTLLNLQYENKDVFGSQVGAQFYYRDYFSRFAPFDARAVSTRGNNVDQVMQDTKVFGSRLTVTTPLDKDARTKLLWGADFNQERSDMPDDIFSPTAYDASGGLVYRKIGTVTYLPPLTTRSVGGFGQLQHKFNDRWSAEAGVRYEHASASFDSFVPLSQSRLAQKYTVPGGETGFGAWLFNAGVTYAPVRGQEVYASFSQGFQLPDVGLQLRNATAGFNINSSSLEPVKTNNYEIGWRGNLGSGARGTLALFYTTSELGDVQSFNNGLILTRTAERIAGVEAGVDYATDDEKWGAGGTLTYLEGRERPQGAANYQNMTGYRIPPLKLTGYLEYRPTARWSNRLQATFYAARDYRLNGRTSFGRIDATSYTTIDLISTYQITKKDKVRVGIENLLNRYYLPLYSQLMRNSNNTSRLPAAGTVLTVSYTHRW

SEQ ID NO: 2771 - protein, 472 aa, Ralstonia solanacearum UW551
MELERRIDQLDAPPQPAMTAPQVPAGAMPNMQNIQNVPTTNVGHLMERIERLEAAQTVQSAQIAKVAEDYVPPTKPTFKIGGRVHFDTWDFPSNTPGIGFFENPATGNDPENRWAFRRVRLETSGDAFETMLWRIQVDFADPNDPAIKDVYIGWDELPGNTTVLLGNQKRPLGLDALNSSRFNIFMERPLVVEAFNEDARRLGLCGYSYSDDLVYNWRYGIFNMENVSGTGAYLGDAFQGSGNARLASSPWYDDSSGGRGYYHWAIAGMVANPDGDVLATTPHSNQGRFRTRPEARSSSRWIDTGAIAGADWYEVFALESMLNVGAWNFCGEYQTTWLQRDNGMSDVNFHGGYLQAAYFLTGEHMAYDRKSSTLSRTKPFENFFLVPDCNGNFGTGWGAWQIAARISYLDLSDDNIQGGVETNATLGLNWLWTSHSKMQFNAIYGDISEHRPVGGYTGGNFWVMGCRFMVDF

SEQ ID NO: 2772 - protein, 269 aa, Ralstonia solanacearum UW551
MSEETDMKTRLFVAFASCAIAAPTFAQSSVTLYGVLDEGLNYTTNVGGHSQVAMASGFPHGSRWGVKGAEDLGGGAKTVFQLENGFDVDTGRAFQGGLLFGRQAYMGLSSNTVGTLTVGRQYDSVVDYLAQTSAGGSWGGYMFAHPYDNDNLINTFRANNTVKYTSPTLGGLKFGATYSFSNDAGFANNRLVSVGSQYAVGGLLLTAAYLQADHPSATAYGAINNSGDQNLLGSRLRIFGAGTTYTFGQAIVGLTYADTNVADPQSSGY

SEQ ID NO: 2773 - protein, 801 aa, Ralstonia solanacearum UW551
MNRHRRPVRQSRAPRPGALAAAALFASTAIAQSRMVIDIPAEPLDAALNTLARQAGTQLVFASALTAGKTAPHVQGHYSVEETLNRLLAQSGLTARRQGDNTFTIEPAGSGAEVTLPATVTTAAQAESANGPVHGYVARRSATGTKTDAPIEEIPQSISVVTRDRFEAQGAQSVNEALRYTASVSTYGAGTRSDWYTAVRGFVPATYLDGLQLPNTINLASWRVDPWQIECVELLRGPASVLYGQGDPGGTVNVVTKQPTAEPIREIEVQYGSHVRKQVAGDFGGALDADGKLSYRLTALARDGNLPLGPFNDQRLMIAPSLTWKPSADTTLTLLANYLRDKTNASDSFLPAQGTILPNPNGKIPATRFTGSPDFDAYEKTQYSLGYQFEHRLDDTWTVRQNARYMHLRLDDRMTYGVGLDPSDPTQRTLLRYAGIAQPSYGRLDIDTQAQARFATGMVRHTLLAGVDYQRQTTRDPENYALTSSLDLYNPVYQPTDRSIFSGPGASPQDIRQRQTQLGLYLQDQLKLGERWVFTLGGRHDWADTRTDDLLGGTTASQRDAAFTGRVGVVYLAPYGISPYLSYSTSFNPTVGTDRNGQAFKPTKGRQVEAGVKVQAGSKASVTASVFRIHQRNVLTPDLDDPAGTHSTQTGEVRSQGFELEATVQPMAGWNVIAGYIYQDVRNTRANDASLDKWPIAIPTPRQIASLWTDYRIRSGVLQGVGIGAGVRYVSPTAGAPDNALRVPGYALFDAAIFYSAGRHWRLALNGTNLANREVISGCYDATRCIYANGRTVLATAKYAW

SEQ ID NO: 2774 - protein, 660 aa, Ralstonia solanacearum UW551
MRARPARESLALVLASAFDMRFPSRRLTALLFASAVVAPGAALAQRVGDNAVAGAEDAFGASIGNERVGLYSASEVRGFSPITAGNIRLEGLYVDRPASFTDRLVASNVVRVGLAAQNYLFPAPTGVVDFRIRPSGDEPLLSVLAGYGPLGGGRLELDGQLPVSNTLSLFGGVAGFDDEYGSGADAVYASYALGARWRPTPGVQILPFWSRVDTWNREMAPIYVAAPGVLPQEVARRRYVGPSWADNRNVATNSGLIVHAPLPAKLGLSLGLFRSEQDTRENYAHVLTGITADGLATRRISRDPQQSIVSTSGEARISRILISGDFSHGLHASVRGRVRDSLYGGGGAYNFGTVRLEDPINTPPPAFVLGARTAEKVKQWTGGAAYDLRWRGRGSLMLGLQRTDYDKTVRRPGVAPALTHDSAWLYNAAASWTVTRRLALYGSVTRGLEESGVAPDSAANRTQALPAIMTDQWDAGVRWVMPGDLRLVAGAFDVRKPYFAPDEANVFREMGVVRHRGLEVSVTGAPIEGLNLVAGAVLMRPRVTGAPVAQGRLGPKPVGQTAATLTLSGTWATPVEGLALTFAANHHGRRTADQLNRVSTPAATIWDAGFRYRFDMGKTPALLRLQVTNLTDVFDWRVVSSATYDVNAPRAAALFLTMDF

SEQ ID NO: 2775 - protein, 769 aa, Ralstonia solanacearum UW551
MKMKKYIFFLVGLCCALLPAMADQPEQLELKASDANIIGHVLDKKTGEHLSYITIALKGTTIGTVTDATGHYFLKNLPEGNFVLEASSVGYKTISRNVSLRKGKTLEENFELEEDAVALDGVVVSANRSVTKRRLAPTLVNVVDMKMFENTNSPTLSQGLNFQPGVRVETNCQNCGFQQVRINGLDGPYTQILIDSRPIFSALSGVYGLEQIPANMIERVEVMRGGGSALFGSSAIAGTINIITKEPLRNSGQLAHTLTSIGGSSSFDNNTSLNASLVTDNHRAGLYVFGQNRHRDAYDHDGDGYSEMPKLKNQTVGFRSFLKTSTYSKLTFEYHHLQEFRRGGNLLNRPPHEADIAEQIQHSINGGGLKFDYFAPNEKHRLTVYTSAQHTDRDSYYGSKKDQNAYGKTTDLTFIGGSQYVYSFGKCLFMPADLTAGLEYNRDNLKDDMWGYNRYTKQTVNIGSAFLQNEWKNEKWSILLGGRLDKHNLINHVIFSPRANLRFNPSEDINLRLSYSSGFRAPQAFDEDLHIENVGGTVSMIERAKNLKEEKSQSFSASADMYHRFGAFQVNFLVEGFYTRLSDVFVLENIGERDGILIKERRNGSGAKVLGLSMEGKMAYLSLFQLQAGVTLQQSRYDEPEKWSETAPAEKKIFRTPNTYGYFTATYTPIKPLSLSLSGTYTGSMLVQHMAGYIDKDVAVNTRDFFDMGVKVAYDFKLYKSVDLQLSAGVQNVFNAYQNDFDQGVERDSGYIYGPAAPRSYFAGIKISY

SEQ ID NO: 2776 - protein, 364 aa, Ralstonia solanacearum UW551
MKLHPLALSLLLAAPALASAQSVTLYGVVDTGVEYVNRIGTTGNSVVRMPNLSGTVPSRWGLRGMEDLGGGTRALFALESGFATDSGTANQGGRLFGRQAWVGLSNSSWGQLSFGRQYTMLFWATLDTDLLGPNAYGSSSLDNYLPNARADNAIAYKGKFGGLTVGATYSFGRDTVNAGPSPSGTNCAGENPADSLACREWSAMLMYETGRWGLSAAYDSLRGGPGAFAGLTSSALKDDRLALGGYALFDNARIGLGWIGRRNGALATPRSDLFYAGAAYDVTPALTLAGEVFHLRYHNSANKAWLGAVRASYALSKRSSVYATVGYIDNGGSLALSVSSAATGASPASGGSQLGAMVGVKHVF

SEQ ID NO: 2777 - protein, 241 aa, Ralstonia solanacearum UW551
MQLKQLAATCALLSATAMVQAKPIWQDFSVTGLYGENYEVVDDKETTITLEYAAKVKYADVFFFMDRMRGENDHKSTYFELSPRLSLGEVSGKKLAYGPIKDVLISTTWESNSENGNNFDNFLYGFAVDLDIPYFQYANLNFYRANNEKTDDDYQMTFVYGIPFKIASEDFLVDGFLDWSTAEGDHASELNWTTQWKWNVGKHISPDTRLYLGIEHSVWNNKFGIKGADENNVSALVKYHF

SEQ ID NO: 2778 - protein, 1102 aa, Ralstonia solanacearum UW551
MFVWGSAPAVHAAPPADDDFDFEDASGEDGGDDDFDFSDESEGGEDGGDELEIAPESGEGEGDSMEIAADGGDAPAGEGGEDDWGDEDDWGDEGDELSEDSEFTFEDISDDEEALAEETKGDEVQAEGVTGTVTGTIANAKGEPMDSVTVSAEGTEFQTGSGIDGSYELKLPPGTYTLVFTKDLFKTVTIPDVVVVESEAVTQPVEIVPMAGVMETFVVEDDLNLEAEGALDEARKQKSTVNDGIDASEISKSGGGKVSSVAVRIVGATVVDGRYLFVRGLGHRYGNTLLDGARVPSPEPELRTVPLDVFPSGALSAINVQKTFSPDVPGDFAGGSTQFVTREAPSEATISLGVAAGVNTNTTFQEMATDAGYGLQDFFAAGNGPRGVPGSFPGTEPVGKGAINSALTQRWTDAEIEAQGEALDTRTKIIRSGNAPANMSFKLSGGNSWSFNDRGGKFGVLFAGAYGNKHQTNRELVRQYGIDGDEISLSQPRVDLDSFKTVYTTNYNGLLKLQLDANSDNRFALTTLYAREARDETRDMYGTAYSVAGLDPLNYTRQRYTMNGILFTQLTGKHKIQGATNVEIDYFGSYSQARRDDPSMREMVYRYNAGGDYYAIDNSLGPTGNQLFLGLTDNNENAGLNFAFPFRQWKGLDGRFEMGAWVDAKQRTFTAQRFDFAYAGGLEGSIPTGTDNPINPDTIGGGTSAALGGTQVFTLFDRLREQDSYTAWSRNVAGYASLDLPFVSWLKFTGGVRLESNVISVEPFNLYDPSEDLEESIGIGGARLVDLDWLPAAALIFSPAMPEGAGDLNIRVGGSRTVARPEFRELAPFQFRDYVGGFSKQGFTGLRSTKIWNADLRVEWFPRKSEVIALSGFFKQFKDPIEEVVGASDNPSASFANAEGAINGGFELELRKSLDFMAPKDNEAARGVLEDLSIGANFAYIYSRVELGAPCYLPGTPSTIEGAVPDESCRPQYQVSTSRSRPLQGQSPWIINAYLDYDNSDSGTSARLMYNAFGPYIAQVQGLGLPDTYQRPMHQIDVTASQRLFAYKRNAWGDLRHQLLLDLEVQNLINTRERRTLGLGDGPVVYDTRDGVGIKLGLTWKY

SEQ ID NO: 2779 - protein, 265 aa, Ralstonia solanacearum UW551
MKRSLTTAALAAGFILSSQAMASPMLWQNNSLTYLYGKNFAVDSAGGKEGDIQQTITFEHASGWTWGDMFLFVDNKWYNGISGSDGHTYYGEFSPRLSLGKISGADLSFGPVKDVLISATYERGEGRNRNYLLGPAVDLAIPGFDRFALNTYYRKPDGITGKPSGQWQITPTWAMTFPVGKSDILFDGYIDWVVNDKKNGNTELKKNFHFNPQIKYDLGKALDYTPGKLYVGIEYDYWSNKYGIEDTDAFNTDNNVTNFIVKAHF

SEQ ID NO: 2780 - protein, 217 aa, Ralstonia solanacearum UW551
MRGLAITAASCAAVALLAGVPAASAKEAGDLLVRVRGIYVVPDESSSLSLAGTGIPGEANVGNHFVPELDFTYFLNDNVGIELILGTTPHNVNATGTPLGAKVDLGDVWLLPPTLTAQYHFNPKGQVSPYIGLGVNYTIFYNVDEGAARDIDYDNSFGFALQAGVDFALNERWSLNLDVKKLWLSTDVSIDAGLPSRIKADVDLDPWIIGVGFGYRF

SEQ ID NO: 2781 - protein, 257 aa, Ralstonia solanacearum UW551
MPETTYKYEDNEVKKKKTIFNENGYIIEELHYDKNRKEPYSYKKRYNDKGLLVESHEHTYTYEYDKNGNLVQIKRPKNSAYGGLERTTYNKAGKIIRTQTFTQNQYDKAGVKITDDSNYLKDKNGELYQSLTDYSYIYNKDGKLQEIRDNVFSSGTIKYSYEYEDGLYVKTAELVTQKFVTYYDKAGNEVKYKWITYSLGPDKPRTQLHLVFKENKRDKYGNLIYQVANRIEELDPEKKGTDVGIYEKKIIEYEYYE

SEQ ID NO: 2782 - protein, 1659 aa, Ralstonia solanacearum UW551
MQQFSLIQAGLVKDRGLRLRLLSSALGCGLLALQPGASAQDAPSQSIHVETDGDVDIVVDAPLVTDQDGKPAILGRSFLGGVTINSHDVLTHGAMSDGIFAQSFANDGEVLIVSGDVETTGIGSRGIVARNEGAFPSSRTQVFSGNVTTAGADAIGIHATAMAGVITLESQSVTTSGDSAIGIQAHAESGDVQLLSNEVKTSGLNAVGIQAEASDFVIVDSLAVTTSGDGAHGIVAEAGMSAYVRSESVQTEGEQAHGIVASSTGQIAYVESETLATRGDGAIGILARSNGSVAVRSGSVSTQGEAIAGGDGGDLPPGDGGDLPPGDGGDLPPGDGGGDPFPPSEPVDTLPATPNGAAIGILAISDGADVFVESGFVSTAGSGATGIHASAQTDTIVISDEIQTSGESAIGLLARSRFGDVSVSSGAVSTQGDFSTGISLLSESGNVLVLSEALSTAGFDSAGIRLTADKNVIVDSQLVETSGDSSSGIQVLTQTGEVDIISGDIITQGEDSDGISVIGLGGGSDVRISSGSLSTVGDGADGIFVNTFGDVSIAADTIATAGVSAAGIYADAGGDLSVQVNDVTTDGALSAGISLQSSNGGVTVNAGRISTTGDSSAGIEAVAFNGDIAINVTEIDVSGDRYIPGDGGGELPVDPNPGGGPASTMINGNVIGIAASSFNSDISVTADKVTASGLNTNGINVFATGGRADVTAGTVDVDGVGGVIGLRARGDLGAHVIVDSVTAVSTLENTAPGETDPFGEAISVGAVTGQARVQANSVRTEGTKMTGVEVISVNASILAEIGDVVVIGEGGGGGIRTLSGADEGDGGRTDIRANSIVTDGDYITGVRAVSLKNFNDIRVGQIQTDGRHSVGVFSASQSGANIEVGEIVTTGDVSDGIQAINRTGLNGGEGPLMRDPDEYIIGDGEPDEGPGSGEDGVSFGTGEAAANEPLPGAIPDGDIVITAGSVSTSGDSSRGIAAHANGDVIIVSGAVTTTGERTRYFSTTDYQFGLSVSGLFEFEGPASHGIDARSDYGAVAIESQSVTTLGAGAHGIRAQTAEGDITVQAGDISVSGQDADGLHLVSQTGDVTATVEGHVRAELGAGVRIASAGAIELIIADGGQVDSADGAFAIVIEPGLVPDDPIIPEDPVSVLAAQSLGGTATPVTSGASLTVDEGGVLQGRIQLTDGDDTLQIAGRFLASGTSLFGDGEDVLVNTGSVFVTDGAAAFDGLERFENQGLFSLANGDAGDSLDLSDIAFMGGEGSVLAFDVLSDGAGGVLADDITFGLVQGTTEVEIAAEAGLTLDASVDLITFTEPVADDAFRISAGTADAGFMQWTLRQSANRLTLAANPDVEVFEIVQAGGVATDLWHEGVQVIRQQAALSRSTQGGSGDGLSGWIEAASTDRNGADMSLSTQYAGATLSQTLSRDLSANSVSAGLTWRTGAAHFGAALGYVDGRAQFDGTGNEMEMEAVSLSGYGGWSTQRYFANVIGKLDTGTLDLNVVSANERSNVDVTTWGLNGELGARFQSGNAHVEPTVSMSWVSASLDEAAFSTGTFDLEDGDSLKAEIGARVGHAFTAGAWTVRPSAAAYRVEELAGENTARYASGASQLALQDEPAGSYTRLELGASFETGAGLVLSLSGEAFDGDQSGGAIRLGGRMQF

SEQ ID NO: 2783 - protein, 375 aa, Ralstonia solanacearum UW551
MQQTTLRGGIALAVLALASGAAGAQSVTLYGLVDTGIEYVSHANSSGNGLVRIPSVTGTLPSRWGLRGAEDLGGGVKAVFTLESGFNTDTGTAGQGGRLFGRQAWVGLAGSYGTLTLGRQYSMSFLSLGDADLLGPSQYAIGSLDTYIPNARTDNTVAYKGTFGGLTAGATYSFGRDAAGGVPASGTCAGEQAGSASSCRTVSAMLKYDAATFGVAGAYEEQRGGAGATASFFNGSAPIPFTNAGDKDRRLIANGYARLGPAKLGIGWIGRALMSAAGDVRSNLYFINGSYPLTAALTLDAGLLRLINTDQGRSATMAVLRGVYALSRRTALYAQTGYLWNSANAQYTVSGGGGGTTPGRGVNQLGAMVGMRHAF

SEQ ID NO: 2784 - protein, 793 aa, Ralstonia solanacearum UW551
MNPFVSLTVASVTALFVASPAFSQEATQSATLDTMIVTGTHVTERTVVESQSPIDIISAAHLAATGSSELATALSRMLPSLNFPRPALADGTSGIRPAQMRGLAPDQTLVLINGKRRHLSAQINVNGTIGRGSSAVDLNTIPITAIERIEVLRDGASAQYGSDAIAGVINIVLKGATQDGSLAVEHGQYSAGDGATSKLSGDSGISFANGRGTLHLAMDISQQEQTNRAGPYQGSAPNTGNYPDIGRTAFIYGDPGVNAAAFSANGMFHVGEHVKGYANAMLSNRDITSFAFYRSRNHNGQSMLLAQRYPKGYVPEIEQNSKDRSLVAGLKGSTEHGLNWDMSYNYGSNHIGFHTNNSINYSLGVESPRDFYDGALEYTQHLLNTDFTKVLDWGLTYPVTLSFGTEYRYEQWNQSPGIPASYNGMTGGAQGFAGFSPLNTMHANRNNYALYAGLDGDLSEHLSAGVAGRFEHYSDFGNQTSGKLSARYALTDQAALRATIGNGFRAPSLAQQRYQVVTSTYSNGTFYESGTFPTTSPVAQALGAAPLRAESSLSYSLGLVLQPFERFYLTLDTYQIDIAHRILLSSNLNDAAVLAALQQQGNSNVTSVRYFANAANTRTRGVDLVGTYTIPFAVGQLDLTTSYSGIGTRIRSAVTQPAALSAIGSTQTIVGRDEIGRLEESFPKDKLILSGTWKLTQWDLMLAATRYGTVTVRNPTSVSRDQTYGARWVVDASASYKSDMHWMLTLGANNLLNAYPDKTVNAINSIYGQMPYSNYAPFGFNGTYVYARIGYSW

SEQ ID NO: 2785 - protein, 715 aa, Ralstonia solanacearum UW551
MAAYFISNRAALLGVVLFVFDSSLTALAVEDALHNTAIPDSDIERLSIHYRQAYRGNVPATELPQAISVLDEQLIKDSGLTRFQDLLDYSASVARQNNGGGLWDSFSLRGFPGNENMPSGYLINGFNGGRGFSGHRDLSNVAYVEILKGPGSALYGRSEPGGTVNIVTKKPQYQTSGYLKASKGSFDQYRLEGDVTSGITDTLAFRINGAWQEHDSFRDYVFSDKKIVTPSLRWQLSDESSLLYEVEYLKQEQLFDRGIVVLNNNFNTVPRSRYLGEPNDGATTVDATGHQLTYEYELSDDWSLTAGYNYRDSSLNGYSSDAELAKGRQSLYDDGRTLTRQHRYRDYASEDHSVRAELSGQFDTGGLRHNLLLGADAYHYRLKTGLYRYRGPKGAYAIDIFAPQYGAAQPDVSLLYENRETQNAWGAYLQDQLDLTGHWKLHLGLRFDRYRQEIAEQVKSSLSDQTDQRVSPKVGLVYQWSEALSFYGSYSEGFLPLSGTDYAGNPFEPEESQSVELGIKFNSTGFGVLPINGSLAWFDAQKSNILTSDPVNVGFSATLGEAKSTGLELDLAAELTENLEAKLSYAYLNTRTANDSLNLDWGVLIPAGSPLVNVPKHTGSLVLKQDLNDFSIDGHLGVTWRYVDSRLGDSADPSFQLPSYQLLGVFFATRLGESVSLALNVDNLLDEHYIASSYSALWPVPGEPRNVKVSVSYEF

SEQ ID NO: 2786 - protein, 777 aa, Ralstonia solanacearum UW551
MPLYPPRQGTPGTPAHFRFAAGYAGPARPPCRMAPIVAAAALLGAPPAGAEPPASAYAPTLATRADLTLDPVVVTATRSRTALSRTPASVSVISDTELEEQQADNLKEALRYEPGVTVRRSAFRPTSAASSGSTGGLGGNQGINIRGLDGNRILLMEDGIRLPAAFAYGPLNAGRGDYADMALLRGIEILRGPASSLYGSDGLTGAVNFTTKNPQDLLDVFGKASYFGLRSGYDSTDRSFGTTVSTALGGERFQGMLIADGRRGHAVDNQGRNGSVGAARTTPNPQDTYNTALLGKLVFKATASDTFKLTGESVRQRIDSDALSAVTPTLRSLRSADRLENQRVSLDYDYADADNRWFQRVHSLIYFRRAEIEQAQDETNAASQRSRDNHYRDRTFGLSSQLESSFLTGTLSHELVYGVDASVSRIDSDRSGTGPAASDNFANKVFPDTGYTLLGAFVQDEIRRGGLSVIPALRYDSYRLTPRNPGDPLYTGAQAGSSDGALSPKLALMYAFAPAATAYVQYARGFRTPTPDQVNNSFTSTAGARVYYRSIGNPGLKPETSDTVEVGLRGKLGTTQGPMHYSVAAFAGRYRNFIDQVTIGGSITSPANPLTYQYVNVSRAFIRGVEARGEWRLPVGVKLRAAAAYTRGTAEDANGASTPLNSINPLQAVFGVRYEPGERWFAQTDMTWQMAKSPSTIRPPGTGATADFATPSSLVVDVSGGYRLNRHATLYLAVRNVFDRKVWNWSDVAGLGLANSTVLDAYTAPGRTFAASVKIEF

SEQ ID NO: 2787 - protein, 638 aa, Ralstonia solanacearum UW551
MKSPLHSIALAIPLGLATGAYAQTVDLPETVAIGRPIVDEVKVDPYSSTSAVVTDEQLRDQNAVDLASALRRTPGVQISRYNPVGAFGGDQGGAIFIRGMGVSRPGSEIKTYIDGIPFYMGVWGHPLLDLLPINGMKSITVYKSPQPQINGNNFASVNLETKRATEDGVHGSARISAGSFGTIIEQADLVGRQGNVDYMLAQGHAQSNGHRANADGELNNVMGRLGLKLSEHWSVGAGFLYVDNRARDPRDNRQPAPAEAPQYNTQAGMVSASVSHVHGDWRGDFKVYSNSGQGNLLHQAGLDGDTLSSFRMSGLRWKEQFSPWEGGTVVAGLDHDRVSGDVKFNRVAPAPQTRFDAPTFKVTSPYVSVTQAIPLSPDWALVPSAGLRFYEHSAFNSRLAPHAGLSLVSDKLTVFANVSRGINYPGLEVPLLASLMPALGASWQQLSAEELDHAEVGVKLSPTEATQVDVSLFHDKVKNRYVFGFPPDVPPPPQFLNLGSYRMRGAEVSVRQAVGRDWTVFGGLTLLAPTIDNLPYTPKRALTIGINGQLGPLRIAFDGQYQSEVWALNRSRAAGVANTEKVSGFAVANARIAYPLPALGKKGEIFLAVENLFDRDYAYRPGYPMPGRWGQVGLSASF

SEQ ID NO: 2788 - protein, 920 aa, Ralstonia solanacearum UW551
MTVDGVAQAETLSSQGFKDLFEGYGNFNNTRNGIEIETLSDAKITKGADSLMSGSGALGGSVIYKTKDARDLLLNKNYAFKYKTGFTSENDERLNSITFAGKASIFDVLAVGTWRNGHEIKNYDYKSADDILGKLREKTDPYNKKDRSLLLKIGTNLGENNRIAVAYDRRRVENKGLDKSYSLHGCTKYVCDDNEIDTRHTHDESIRTSKSIAFENTNINPLWDTLKLSYTDQSITQRARSDEHCDGERCPGVQNPIGLHYNNDNKLVDKNNNPVTYKLENSSVTYYSYIDESTFNQYSYFKEEVPADLAKKWKLKKQYDGKYYIESRLCFKDHDDTNHAGMCRLRSDVKEEKETLVANNITYDLKKEHFINSRLTNSDNLLSCDGINCDKNTIQGFKADGTPKDLPIKIIQKEGKKFALIEKILDENGYNIGPEKASRFLVPNSPGYNRNIWKKRDLDTRTQQINLDLTKHFELGKSQHDLSYGLVWSKTTKSMINKEGLKVNSGKWWIDYPKDCESSTSDLCTKNSTASFLIPVETKDGSLYFKDEFRVNDRLGLDIGYRYDKVKYKTNYQPGITPKIPDDMLVNLFIKEPFVKNTRSLNPNDPNEINRRKNAEANINYISQPKKFNASSYALSTKFDPLDWLQVQAKYSKGFRAPTADELYFTFKHPEFTVLPGSKLKPEIAKTKELSLTLHDDEIGFISGGYFITNYNNFIDLSYLGTKSFGSQATKHELYQSVNLDNAKVTGFELKTKFTLGKWISWLKNVDFGYQLTKQKGKASDNRPLNAIQPMTQVMSLAYTHPDNLFGANLYLTHVSQKEASDTYNIYSKDATAGDKEYVQNKHIKWRSKAYTVTDFTFFVKPMKNLTLRAGVYNLFDKKYMTWDSARSIRMFGTSNLINQETGAGINRFYAPGKNYRMSV

SEQ ID NO: 2789 - protein, 390 aa, Ralstonia solanacearum UW551
MKKSLLAMAVLGAFAGAAHAQSSVTLYGVVDANVEYVNHEQNVTSAGIALPGSSGSRVAMQAGGLSSNRWGMRGVEDIGGGLKGLFVLESGFSMDDGRLQQGGRLFGRQAFVGLQGNWGKITLGRQYTTIFDMMANFSPSGYATQYEPVVGLLGPNFREDNVIKYTGLFGPVTVEGHWAFGERAGSQTANSAYGLGANYFAGPFGLGVAYDEVKVLTAAEALGGPGNEYARDKRAAIAASYTVGPVKLMGGYRYGKTDTASSGATLALLPHRDDLYWIGVNYQATTALSFTLSYYYDNIKEATIGTTTVNPRKPQQLNFIADYNFSKRTDVYFTAAYSRNASLNWDSIGYATTASGQLSIGYLPAASQTYFITPDASNQLGMAIGIRHKF

SEQ ID NO: 2790 - protein, 438 aa, Ralstonia solanacearum UW551
MRYPVRFTPLFIAIAATIAPTAHAAESEKQGFVEGASLNLNARNYYMNRNRLQQTDDNIEWGQGFLGKFESGYTKGTVGFGLDAHAMLGLKLDGGGGTDNSSILPVSDGSGKAPGAFSTAGGTLKMRAFDTELKAGDLFLANPVIAGGETRMLPQTFRGLSLTNHSFDGWMIEGGQASFTKPYNQSGHKRIGTSYGTLADGDKSQHLNWAGVAWSGVEGLTSSLYASELKDIWNQYYYDLDYTWALNDRVTLNPGLHFYHTQDTGDALLGNIDNNTYSLHFTVGVGSHSVTAAYQRVNGNTPFDYISQGDSVYLDNSQQYSDFNGPNERSWKLKYAYDFAGVGLPGLTSALSYSRGTLDLTKVDPHSKGYASWYSAEGRNAKHWERDIDLKYVVQSGQAKDLAVRLQWATNRGGNGYGALDSDTDEYRVIIDYPINVF

SEQ ID NO: 2791 - protein, 389 aa, Ralstonia solanacearum UW551
MLVWVAHCFCRTARDNRPGSRAAPQKQRRSAMKSTSNPLRFDSIFYAVSTSLLLATPVETIAYELQGDPTSPGFLQQPVAAQLSLDPLSASGLSLGTLNAFSQQMSERHQQPAPDLIASQWAQFFPTSARGRALPPAQLEAPSQQLMIGPDLFVRETAAGDVHRAGIFVGHNNLQSSFRGARPLLGDKQRKAVNLSGESLGVYWSMTHEQGWHLDAVAMGSRIDVMGRGENGQRLDDSGHAMTFSVEGGYPIRLGGNWVIEPQAQLINQQFFPGNQVQEETLQAFDSQPSWSGRVGAKLSGRYEVRGMPIEPYVRTNVWYDFSNADEVKLDQVDKISSSRYSTTVELGLGLVARVTPSVALFVSADYSSDVDDNDLNGLIGSLGVRMRW

SEQ ID NO: 2792 - protein, 1048 aa, Ralstonia solanacearum UW551
MRLCSGQLKADRKEMHDRHLSKRRCWFWGRCISQKGGTMIRRHLKNAFMTTGMVAGVIAWSTPVFAQETLQDTPQQSGASVDSNSASNPVANNASIPTMAPAPAASELAQPSGTITVTGSRLPPGITSTSPITSVNAKEITKQGYTRIEDMLNRMPQFYGTQSSAVANGSSGISTANLRGLGSNRTLVLINGRRLMPGDPSSQAADLNSIPSSLIKRVDVLTGGASAVYGSDAVAGVVNFIMDTDYEGFHADAQYNVLNGDNDSRTMRNILRNSPIAGTKTPTNTPFDGWGFNANLKFGAGTKDGRGHVVAYLGYRRQAAVTGADRDYSSCALSGNGTSGAICTGSPTSAEGNILLNDGNYHLNNGQLVSGMSQYNYAPTNNLQRPDQRYTAGFFAHYDVTDGFKPYAEFQFMDDRSSAQIAPSGTFGFGTVNCDNPFLTAQESSIMCSAANIDNTTHTDSQGNTYNNSSAQILKRNVEGGPRINTMRHTSYRGVIGTKGEIVKGLTYDVYGQYGSTVYQNRYSRDFSISRLNNALNVVNYNGTATCRSVIDGTDPSCVPYDIFSGNKPSQNALDYLQTPGVATGSTQETVVSGSLTFDGSQYGVQLPTASQGLSVNVGAEYRREKMNYDVDSAYATGDLAGQGGANPSSHGKYDVKELFIEAALPIMDHRRGVNELTLTGGFRYSDYSSTGSVQSYKGQMVYSPVKGVALRGGYNRAVRAPNIQELYGPTSIGNDGSTDPCAGTSPTMSASQCELMGVTKNQYGNILANPASQYYGNQGGNPNLKPETANTFTGGVALTPFRRFSFTADFFDIKIKNIVSQLGADNILQLCGTQGRYCDRIHRDKYGSLWRNQSGYVDDVLMNIGSLATRGVDFGVNYSYPLGNKYGSLTASLNGTWLLNYKTNPGGGATTYDCAGLYGAVCGMPMPKWRHQMRVSWDLPAGFGFSAMWRFVGGTKSDAGSTANPYSSAKSSFDKKIGNVSYLDLTAYYKVTDKVTLNAGVNNVVGTRPPLITSQNGGAGGIYNGNTYVTTYDVYGRYIFAGLSYDF

SEQ ID NO: 2793 - protein, 363 aa, Ralstonia solanacearum UW551
MKTTSLFSGACALVLGCPAFAQSSVTLYGSVDVGVDFVTNSRGGHLYQESAGKRTPDRFGFLIKEDIGGGNTVFARLESGFLTNTGAQINPASFFNRDAYVGITNSRFGSLSLGHIPDYVYEYVGALNNSVPGISSYYTVGNLDGLANTRALDNSVKYESIDYRGFQAGAMNAFGNQTNFSEGRQYSVGARYQNGRVKLGAAYSMSHNRTADLFGIFGVTSVLGQRLKQGTLFNADHYSTIAVGGSVVVGDFIPHATFTDVKLEDPQGSVTERNYQVGVNIDLSGGKRFYVMGISYNRSMFEGLTYNQYNLFITHYLSKSTQIYAGVGLQRASGTNAKAEQFGYQPSSSSAQTVGRIGINQMF

SEQ ID NO: 2794 - protein, 333 aa, Ralstonia solanacearum UW551
  misc_feature (324)..(333): Xaa can be any naturally occurring amino acid
MKLRPLALSLWLAVPAFASAQSVTLYGVVDTGVEYVNHIGTAGSSVVRMPNLSGTVPSRWGLRGTEDLGGGTKTLFALESGFATDTGASNQGGRLFGRQAWVGLSNDNWGQLSFGRQYTMLFWATLDTDLLGPNAYGSSSLDSYLPNARADNAIAYKGKFGGLTVGATYSFGRDTVNAGPSPSGTNCAGENPADSLACREWSAMLMYETGRWGVSATYDSLRGGPGAFAGLTSSSLKDDRLALGGYALVGSAKVGLGWIARRNEALTASRSNLFYAGVAYDLTPALTLTGEAFYLKYRNSADKAWLGAVRASYALSKRSSVYAXXXXXXXXXX

SEQ ID NO: 2795 - protein, 394 aa, Ralstonia solanacearum UW551
MNIKRAVFALNPVCACVALLGAGVSMQAVAQSSVTLYGVVDTAMAYSSNQGGHSNTYMSQGNLLASKFGLYGTEDLGGGTQALFRLESGFNSATGAQSAAGYIFNRQAFVGLSNKDYGMLTAGRQYTPYFQYVAALGPTNVLTGATGAHPGDVDALDTTLRFNNSLTYTLPKIGGLQASVQYGMGEQPGSISGGSSFSGAVRYDYQAFAWSAGYIHLKNISTSNSIGTFANNAPINSGYASADSAQMIATAARYTFDKLMVGLNYSNVQYKPGAGSLFTETAMFNTYGLIATYTLTPAVTVAAGYSYTAEKARNGVSSAARYHQFSMEQTYALSKRTAFYALEAYQKASGKTLRTVGGVSTIVDAVASVGDSQNATPSNTGHQFVGMVGIRHLF

SEQ ID NO: 2796 - protein, 347 aa, Ralstonia solanacearum UW551
MKHWMCAAGALALAGTAHAQSSVTLYGLIDTSVRYTTHENANGSGKLQMAEGLLTGSRWGLRADEDLGGGRKAFAQLESGFSPDTGSSLQGGRLFGRTALVGLKGDWGTLTLGRQYTVAHDVMSSYEAMALANVSIVGYQGGNYTGLRQDNLLKYTYTLGAWQTELAYTFGEVPGATRAGSTAAAALIYAQGPLMLAGVFQQSRDVTTGFFGLSIPASRQNVWSAGGTYLLGKSTLYFGFTRSALDMADYRNRAVYIGARVPLTPALAFITTLTADRVRHQGDGGNRFTGAAALDYSLSKRTDVYASVDYTSVRGAWATLASQPGFATPLFGYSSRLGVMAGLRHKF

SEQ ID NO: 2797 - protein, 482 aa, Ralstonia solanacearum UW551
MLFFSMLQYAWVAVRPLVLVRAAALRPLRRPALLAAMALFSAFTHAAQAQEAPASAPAADALPAGGELGDRFGFHGQSTWVWQAKPAFKSPYSGDNSLTAGRATSYSFSTTLDLGMRLWKGAEFHFNPEVVMGKAFSDLHGLGGPTNGELAKVTGTDPTLYRARVFMRQTWGLGGDTEKVDADFNQFADVVDKRRVVLTAGNLPVLDVFDAVEYAHDPRTQFLNWSFMTHPSFDYAADARGYSWGVALEYIDSELGWAVRAGRFLQPLESNGLPLDTRFLKHYGDMLELEKRYTLFGQEGKVRLLGWRNFARMGRFDDAIALGQATGAAPDLSQVRREHAKVGVGLSFEQKVGENLGLFTRLNWSDDKTETYAFTEVGRNVSFGGLLKGTSWGRPNDVLGAAFSLNMLGPDHRAYLAAGGSGAFLGDGALNYGHERILEVFYSFQPVKGITLSPDFQLIQNPGYNRDRGPAKFFGIRAHAEF

SEQ ID NO: 2798 - protein, 239 aa, Ralstonia solanacearum UW551
MAYKKALAAAAGMILATAAHAQAAGSNIVSLGWFRVMPNSSSDPLVVKSIGGIPVNQSQSGTGAKIQEADTVGLAFTHFFTDNVAVELVGGIPPRHKIEGTGALSGYGEIGSAKQWSPAVLAKWYFFNADTKFRPYVGLGLNYTWFSDEKITNSAFQTKLAGPGSKSNVSTDGSLNPVLNVGATYAITKDWFVGLSVSYLPLKTTATIDSTTATGVHVVSEAKIKINPVVTFLNVGYRF

SEQ ID NO: 2799 - protein, 809 aa, Ralstonia solanacearum UW551
MHRFTNNIIIIIKLKAYTLKFSLLFFLLLASLSVHAQRRGGMISGRIISTEKETVDFATVYLKGTSYGGTTNQEGLYHIKAPAGDYTLVVSAVGYTKVEKKVKLVNDERMKLNITIAPETQQLDEVTIVSTGVSRVKRSAFNAVAVDTKELQNTTKNLSDALTKAPGMKLRESGGVGSDMQLMLDGFSGKHVKVFIDGVPQEGVGSSFSLNNIPVSFADRIEVYKGVVPVGFGTDAIGGVINIVTNKKRRNWFLDASYSYGSFNTHRSYVNFGQTFKNGFSYEINAFQNYSDNDYHVDAPVKDFETGSFNESEKVRVKRFNDTYHNEAIVAKAGIVDKSWADRLMFGFTYSHMYKDIQTGVRQKTVFGEKHRFGHSLMPSMEYSKRNLIIKGLDMVLTANYNRNATTNVDTARYEYNWLGEKHPLNSPGEQSRQYSRADNDNWNGTLTLNYRIARVHMLTFNHVLSAFQRDNTSLLAVEEQTDAIAKQTRKNISGLSYRLMPSEKWNFSAFGKYYRQYVAGPMAEDDTGSNYVRTSRTVDSWGYGAAGTYFILPGLQAKLSYEKAYRLPTIEEMFGDEDLESGDIGIRPEKSDNINLNLSYSRSFGKHSVYVEGGVVYRNTKDYIQRNIQDLSGGKEGATYTNYGKVLTKGYNVSARYGFGRWLSVGGNFTQMNVRDNEKMQIGSTGNSVENLGYKARIPNVPYQFADFDVNFYWRDLWKKGNMLSVTYDNQYMHSFSYYSQAIGSKNKDFMVPDQFSHNLTLSYSLKNGRYNISFECRNFTNEDLYDNFSLQKAGRAFYGKVRVHFGD

SEQ ID NO: 2800 - protein, 1010 aa, Ralstonia solanacearum UW551
MNQHAHHRPRQTAVTLAVAALAAMTQMQTATAATVSSPFVGLYMWGAGDLSVTSTISGGPMGVLSFSFSGGAVGTLTNSGLISGGYGVQNASGMAALNNTIGGSISGTGNDGVFNASSIGTLTNDGAITGTHFGILNYYAATISTLTNSGAITGGGTSGGSWAGIDNAGSIGTLTNTSTGTISTAGGVFGVYNTYKIDTLSNSGLITASTRGIINSGTITTLINNSGGTISHSGSGFGHGIDNSGLIGSLSNSGFIGVTGGTGGTGSGNGINNSGTITTLTNDSGGTIVGKYTGLYNSGTIGTLTNHGAIIGGYSAGVANDGSIGTLTNTGTITGSNSYSGNEGFGVNNGGTISALTNTGTISGTVSGSGTAYGISNVGTIGSLANSGLITGSTYAVFNDAGGTLGPVTNAGVIAGNIGNLSSRDLSISGGTGTTFGTLTGYGGGGTLGAIDNPNASVAFVSGNLLLNDNINLGSGTINAVNNTGSAVVQVNQPVSITGNYNQGSGATLQIGVASGATTQGTLGTDAGYGRLVVTGNTTIAQGSSITLQSNGYAFAAGQRYVVVDTAGTATYNAGSLRYAINGYTSTVTGAAVANGSKSDLVLTVVSARSLSATTTPSPTTSSQTTTTTPNPASMATVPNAVASLNGLLGYTGIGSANLLNLYNATLGSLSEGSTAGANQIGKQLSATQTGWAPAAPTFDALNVVGAHVNTLRLAQAAGATGVATGDSPAQWGVWGQAFGGHAQQSERDQTDGYRANYGGLLIGADREINDRWRAGGVFSYSNTSIDNTGDTSGSFARVNGYGLIGYASYTGNPWYVNLSGAAVQQRYDTSRAVSMQGFSGTASGHFSGQQYVARTEAGYPLPVGSATLTPLASLTYSYLTQDSYTEDGGNGTALSVGATHVGSIKSGLGAKLEKGFATRYGQIVLEARAQWIHEYDHARQVTSASFAADATGQTAFTTVGMTPVSDLADISLGATLLRANNLSLSARYELQAGRGYVSQTGSVRLRQLF

SEQ ID NO: 2801 - protein, 418 aa, Ralstonia solanacearum UW551
MSPTALRAAAACGLLCGCLPVAGAAGFIDDGKLKLQLRNVYFNENFRDEQGMSARAAATAKSERTEWAQGFLLDYQSGFTQGTLGLGLDAMGLLGVRLDSGRGRSGTGLLPVHDDGRAAQEFASAGVTAKARLGSTVVKHGTLLPKTPVLVYNDARLLPQTYQGTQLTSTDIDGLTLTAGHLDRFKQRDSSNSTGLYLDGYGGAESGDFSFAGADYAFSKHLRLSYFHGQLEHFYRQDFAGLVHDLALAGGVLTTDLRYFTSRDSGAAYGGSIDNDMFSAQVSYAHSGHTFGAGYQVLDGEAGLPYISGATVYSFSNVGIGKFIEEEEKTWMASYAYNFAAAGVPGLTFMTRYLSGDNGRSGAQGLSEWERDAELAYVVQGGALKGLGVRLRNYVYRSDFSRGRDSNRLYLTYDIAIW

SEQ ID NO: 2802 - protein, 322 aa, Sulfitobacter sp. EE-36
MKKVLFATTALVATAGVAAADVTFGGYGRFGVIYSSAAGANGIAQTFGDDGTGDSSVDITSRFRLQIDATAESDAGVTFGARVRIEQENDEIFGPPAGDGSYNSTGINAPRFFARSGGLEVGVGNIFGALEFMPGMYPIDLGLTGLQYEYSPYRFGGDAYDSDGAGAASTNNAVEVMYSAGDLSVHVSASDGANERVAAYVAYAWNGWKFALGGQDSNSASDTELAASAGGNIGPAFVSLAWADNGTNGDQFTLAARFDVGAATNIEAYISDADTIFGTPTQNTGYGIDFNHDLGGGTSLRGGVAKLFAGHTVADLGVRFNF

SEQ ID NO: 2803 - protein, 712 aa, Sulfitobacter sp. EE-36
MKFTFFLMLGTSALALSAGVAMAQDAVDLGEIIIQSEEDPTGPVVGYAAGTTASTKSGRSLLETPSSVTVVTTDQIEDTAANNLSEALGYAAGVVTEAYGADPRFDSISVRGADLQNQIYLNGLQFSRSTRPNYGAPSLDLYGMERVELLRGPNSVLYGAGSPAGLVNLIQKRAQSDGDTTELGLHADGNGSYYVFGDANRVVDDRFAYRIVGKAGNRVLGIDEYDNPGAYLGFAAKYHATDATTVEFLLSYQDDDPDSPSGVPNGLVGTRSDEDLRDFYFGNEALEYGDRKVLNLGAQVTHTFDNGWRLVSNTGVTKFDWSYSNLSVGGVTGPDVARTQLLQDEDVTSYATDLRLEGSALTGDVLHNLAFGIDASRFEESALSVFYYGQDSIDVAAPDYSPITPVRDGASWYANKNVTVEQVGIYASDEIEYGNWRAGLALRHDRNQSEGQSNTLYTVPGSGGTPGTVDLTRDDSATTGQASLGYVWDNGVSAYLSYGTSFQSFAEPGDTGTALDPTTGEQWEVGAKYLPATLDAYLSASVYQLEEKNRPVYVQNGAGVRAYDQVGKSRIRGLELEGRANLADGWSVTGGYSFTDSEIIGGDNNGNELGLTPKHTFKLWASKEIQGGPLAGLTVGAGARFIGERYAFNANANQLDSVTLLDAAVSYDFDDGTELQVNVTNLTDEAYVSSVGYFSTYYGDGRTISATLSKKW

SEQ ID NO: 2804 - protein, 224 aa, Sulfitobacter sp. EE-36
MAALKNHNEEVDMKKLAAAALILGTLSTGSVWAHEAGEFFIRAGTATVRPTEGSDNVLGSLGSFNVSNNTQLGLTFTYMATDNIGVELLAATPFRHKVGTGPTGTIATVHQLPPTLMAQWYFGDAQSKVRPYVGAGINYTTFFNEDFNDTGKAAGLSDLSLKDSWGAAGQVGLDYLINRDWLLNMSVWYMDIDTDVKFKAGGVDQKVSTRLDPWVFMFSAGYRF

SEQ ID NO: 2805 - protein, 573 aa, Sulfitobacter sp. EE-36
MKRTLYIAGGFTLAFLMPFNLQAQNTQPKDTTMNRTVVVEQEYNPDILDASKVNVLPKVEEPTVSKKEVEYATTFFPATSIPADLMRPYVGTEVQPGSKPGYIRAGYGNYGNLDLLANYLFRLSDRDKLNVRFQMDGMDGKLTMPETDTKWNAYYYRTRANIDYIHQFNKVDFNIAANFGLSNFNLSPVQPGKQKFTSGDFHLGVKSTDENYPIQFEAETNLMMYNRQNNNTFFFNDKVRETQVHTKGLISGAISDEQSINIGLDMRNLIYNKDLKLADDLQVYENRTALALNPHYKLSSDSWNLRAGANVDISFGSGKSFRVSPDVIAQYIFSDSYVLYAQATGGKLVNDFRRLETICPYALPAGPILDTYEQLNAAIGFKASPYPGLWINLYGGYQDLKDDFFEVQEETFVNYDPSLAGDAQEGNSSSPVTAHQYLNLEFSNANNFYAGMKISYEYKDLIALFAAGTYRNWDAKEKYSLYMKPACEINFSADFRPITGLNINLGYDYIGRTKVEGIKAAAVSDLHAGASYNVFKGVSVYARINNILNKKYQYYLGYPTEGLNFLGGLSFSF

SEQ ID NO: 2806 - protein, 764 aa, Sulfitobacter sp. EE-36
MQTATRSVTLEGPAGRFRVRPLALLMAAIGAGTPLLSEAQEVAAGAAVAQTGTSGAGAKQEGPTAKADGGELNAVEVRVDRIKSDLVSPTRQVTVLEREEIEELKVGSTNLATMLSKLIPGMADSSRTVTDFGQTLRGRGTLILVDGIPLNTNRDSARNLATIDSSNIEKIEVMRGSSAIYGAGANGGIIAITTRPAGGAPSADTTVTLGTPLTRLSKEGLSANVQQHFSGSQGPIDYAFHLGAQRIGGSYDAHGHRIAPEPSQGDLFDSNVYNVSGKLGWRIDSQQRIELSVSQYQAKQNTDYASDPSVARLTPGTAAARAIKGLQLENQNELRNTVVNLGYQNLDLLGSTVSTQIYYRDYFTRFPPFDARAVATRGGNVDQVSQNSDVFGGRLTISTPLGADKKTKLLWGADYNQERSDMPLDVFDPRAYDQSGGLVFNKTGSLTYMPPLTTRSGGIFGQLQHKFNEQWSMEGGARYERASATFDDFVPLSQSRVSNPVAVQGGTVNYGAWLFNIGGAYAPVKNQEFYASFGQGFQLPDIGLQIRNARPGFNINSSSLEPVKTNNYEIGWRGAFGNTMASLALFYTTSQLGDVQSFNNGLILTRTKERIAGVEASADYLSDSETWGAGGTFTWINGREQPQGSSSFQNMTGYRIPPLKLTAYVQYRPISTWSNRLQVTYYGGRDYRLNDQNSFGRREVSSYTTVDLISRYQVSKKDTITVGIENLFNRYYYPLYSQLMRNSNNTSRLPAAGITLTAMYQHRW

SEQ ID NO: 2807 - protein, 697 aa, Sulfitobacter sp. EE-36
MQISRIALVAALAASHPAYAQEADTLDLGTLTLEAESDATLLQNGYVAESGRQATRVDTLIRDIPQAISTVGQDQIEDQEPRTLLDALGYTSGANVTNFGFDSRYDAVYLRGFSAYYDGLFRDGLRQVNGPSAWFQNHPYTFEGVSVLKGPSSSMYGVSGAGGLVNIISKRPKDEAYNELKLTFGTDSRKELAFDFTGPVGTDGRLSYRLTGVARDADTPLPGYSDDLALLAPSFTYQLTDRTKITVLTEYSESTRGGTASYYNPSQGEASDIYVGDPDYNDFVNEQWRVGYELEHEMDNGVTLRQNLRYSEVDADLEFSGIYAAGTGFGRYWGHYLENSENFSVDTYAEGHFSTGAFDHTVVAGFDYTQSSYDAYYGGVGYVSAADTDAVDQPYSNGQEMYQYGVYVHDQLSSGPWTMFLSGRYDWVDMTTFDANQNGTDTSHNGFSGRVGLSYAFNTDLSVYANVSSSFVPTTGLVYDDSTDPNSGRSARPTRGLQKEVGVKYQLPGTESLITASLFDIRQEDGVVFQTVDPATFNGLNQVQVPYDLRSRGLEIEGQFNFANGLRVTSAYTYLDMEIEAGSTGTVGNQLSATPHHTASIWGFYEPQSGAFKGFGFGAGLRYVGESYGNDANTYKNDAEVFADLSLSYDFGEVGYDGLSAQINVKNVFDNTDQTCSADYCYRYEGRTATASVSYRF

SEQ ID NO: 2808 - protein, 815 aa, Sulfitobacter sp. EE-36
MGNDEGDMTQTKTPHSLRGHTASRSIGMMTAAAIGATSPAALYAQSSDEPLLLPGIEVETSEPQAAKPKPQPAKKRAAAAPAPRATPAPAPAPVVAEAPVAAAPAAPVAGENGLSPYANPEAGYQAVQSGNSLLTQPLVDTPRTVTAVTQEVLRDKNATSVRELARTTPGITLGTGEGGNAFGDVLFIRGFRSSNDVFIDGVRDSGVAVRETFMAEQVEITKGPSGSIGGRSTTGGAVNLVTKKAQDTDFVKTTTTFGTADLARQEVDWNKVWNDRFKTRIGAVAQVSDVAGRDGSKDDRLGLSIAAEYEATDRLTLDFEAYQLQMKQMPDWGVPWDGTNGVPFTESAAGRPTLDRDTFYGNPDRDFHDATQSVATFGATFDITPGMTFTNRSRLSRTENDYIVSAPERPDTSDADPQNWTLTASPKSRYQVNEVASNTSELSFGFNTGSARHDMIAGFALSREEISQRGYVGLSSEVGGGTVEDNLAGCSVAIYNPDTSGCSTATPVRSADATLTDVTTRSLYLNDTITFNPQWQLNLGARLDDYSVSRTTTEAGADTLSRDDTMFNWNAGVVWKPRDNGSIYLSYATSTNPVGDELDAGGGSYNGIDSSNLLLEPEENTAIELGTKWQFGNLTATAALFQTTKDNARESTGGRGAPVVTTATGEYRVRGIELGFGGNITEKLSLFGGATLMDSEVLKSSNPDNIGEEFANIAHEQFNVLARYDYNDQWSFGGQATWRGSVQGGTFAATNGNELPSYWRFDLMADYHITDDASVNFRIDNVLDETYYDALYRSGTPFVYVAPGRSASISVSMKF

SEQ ID NO: 2809 - protein, 724 aa, Roseovarius nubinhibens ISM
MHFFMTLNGYSMRYTCLTPISYLSILSVLVSTALQAQSNTQNDNPTIERMIVTGSRIMESIDEVPASIVIITQQQIQDQLKVTSELQSLLSTLVPGLAPSTGTSSNSSQTLRGRAPLIMIDGVPQSTPLRNGSLGVRSLDASTIERIEVIKGATSVYGNGAAGGIINYITKKAASDKAMAGHVTISSRFSAVKLEDTLGSRVDAGMNGQLNKFSYVLNASYEENGVQRDAQGDILGLTYGLSDTNSQNYFTKFGYQFDDEKTLQLTYNYFKSKQDTDLINVVGNINSGDKTYAIESPDGSSIVGEPQGPENHNVMLKYSDDEIFSQTQLVVDAYTQRIENVFFFSTNLANPEQGFDGGQSIIESEKKGLRATFNSQFTLQDIDTTLIYGIDALNDVTSQPLVDGRVWVPEMDMENIAGFVQGKWIVNDDIIIKAGVRHENIDLKVADFSTLRLCRTADQCSVAFDVVGDTLNYKATTYNAAIRYNLSDAFRPFISYSQGADISDTGRLLRTATVTDIALIRTQASIIDNYELGFTSEIDALRVEFSAYRSTSELGTTNSYDAETGVYLPVRAPQEIYGYEALATYKVQSNLDLSATYSWVEGKNTELDVYLGGKDIGAPKGTFNVNWQPVDGARLALNYLYVGSRKRFGQVDGEYIGDQGPVDSYQLININGSYDLGNQWQVFMGIENLLNNDYYPARSQVYTYDGYNHKGLGMTVNFGATYQF

SEQ ID NO: 2810 - protein, 396 aa, Roseovarius nubinhibens ISM
MTRSTLTGDWGGLRHQLEEDGVKITGDYSGETAYNAHGGLHRSARYSQNVKLGVQFDLSKLYGLDNGGKVQLTINDRRGNSASEDLVGNRLPIQENYGGLYTRLTELSYERTLFTPALNVKLGYMAMGNDLGGLDSGILCNFMNAGFCGHPLNMSGGSGWTNYPNAHLGVRVKYDLSPAWQLRVAAFNVDPESNGNSSRAWHLGPKHTTGTVVPVELVYKLQGELPGEYKLGYYYDSSDVKRIGSDDEVSGRGGHYLLVDQAVWNDQASPGRSLHAFGQYSASSKAASPFTKWYGAGVVLYKPFEGRPKDTVALGYGRAVPNPRSRDVLEDAAFNAGQQFPDIDSAEQLIELSYGYQATPWLNLRPDVQYIIEPGAFSGKDIDNALVVGLQVKATF

SEQ ID NO: 2811 - protein, 122 aa, Roseovarius nubinhibens ISM
MGTSSRSGPDRRPARRRKPGSCWAVRCLYRTSGSNGGNTLGRLQFEVGSIDLHASSIGAYWTHIGEDGWYVDSIGMYSWLDGGLSSDRGIGADTSGNSVAFSVEAGYPFRFDNGWMLGPGSM

SEQ ID NO: 2812 - protein, 548 aa, Roseovarius nubinhibens ISM
MRFGQTFKNGFMYEVNAFQNFSDNDYYVDTYVREFEIKEDGSVRFPPLDKNKIYHLKRFNDQYHNEAVIGKIGLVGKKWADRLALSFNYSHFYKEIQTGVYQDVVFGEKFRKGHSLVPSLEYYKKNLLVKNLDLLLTANYNHNITNNVDTASRAYNWRGDFYEKGSRGEQSYQNSESKNKNWNGTLKMNYHIGQAHTFTFSHVISDFERTSRSTIGASSKFTDFSIPKITRKNVSGLSYRLMPSDRWNVSAFAKYYRQYNKGPVSQNTDGIGNYINLSNTASALGYGAAGTYFIWKDLQVKLSYEKAFRLPTTDELFGDEDLEAGKMNLKPEKSDNVNLSFSYNHQFGKHGLYAEAGLIYRDTKDYIKRGLDVLGGTSYGYYENHGHVRTKGYNLSLLYSFSRWFDIGGTFNSIDTRDYEKFLAGSSLQESMHYKVRMPNLPYRYANINANFYWNDLFVKGNVLSIGYDSYWQHDFPLYWENLGDKDSKNMVPEQFSHNLSLSYTMKNGRYNVSFECRNFTDAQLFDNFSLQKAGRAFYGKFRVFFGK

SEQ ID NO: 2813 - protein, 324 aa, Roseovarius nubinhibens ISM
DYEEIPLDALEDEDVSESVDTSDKQPQDNTELHEKVETVSLQPRAAQPRAQAAAQPQAQAVAQADAVSTNTNSALSDAMASTQSILLDTGASLTRHIAQKSRADAEKNSVWMSNIGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRTSIQTGLTLGNTLKINQFEIVPSAGIRYSRLSSADYKLGNDSVKVSSMSVKTLTAGLDFAYRFKVGNLTVKPLLSAAYFANYGKGGVNVGGNSFAYKADNQQQYSAGVALLY

SEQ ID NO: 2814 - protein, 222 aa, Roseovarius nubinhibens ISM
MKKHLLPLALLFSGISPAQALDVGDISSFMNSDSSTLSKTIKNSTDSGRLINIRLERLSSPLDDGQVISMDKPDELLLTPASLLLPAQASEVIRFFYKGPADEKERYYRIVWFDQALSDAQRDNANRSAVATASARIGTILVVAPRQANYHFQYANGSLTNTGNATLRILAYGPCLKAANGKECKENYYLMPGKSRRFTRVDTADNKGRVALWQGDKFIPVK

SEQ ID NO: 2815 - protein, 807 aa, Roseovarius nubinhibens ISM
MKSTKTRVRSLARIVATAWCMLAFMVPLTSYGADTGTVKGQVTDRADGEGVYGATVTIGGTTISTATDMDGNFTLRNVPVATQKLSVSIVGYAPASQVVTVAADATATANISLGHTTIMASEVVVGAAMYGQDRLSVPVTANVVTSEQIKEEPNPTLDAVVEGVPGVVVSRAGGTTSSSLQIRGSNVYQGGGIGTRVQALYDGFPINAPESGEIVWQSVNMNAADKVELLKGAAATLYGSGAMGGVVNVYGHLPEKEEILAGSSIGFYDAPPSDDQSAYRESYTPVFWNSYVGYGNKDDKWRYSVLYSHSDDNGYRENTDSYLNDLKIKARYDIDATQYLQLSAFYNATVGGYGRTWPYVAGAGGTVTSTSPELAYDINNPTAYGDDTTLRKNALVGLNYVKMFSDDVSLDTRLYYTHNGTRYEYNPTATAELVTAAAGPIPATYQQPGSFNETYSDRVGAGTKLDWKVSDAHRLLFGVDGNFTNVMSTQVTATTPVAGVLNDIQESNFASFLQDEWKITDRLTSLASVRYDWNGISDDMAGTTPIQNKSVDAVSPRVALNYKAMDDMSFRASWGRSFRAPSLYERFVRDGGFATLTPNPALDKETMTAWEAGVFKQFGERVALDIAGFINNYNDLIESTVITAPSTYQYQNISKARIWGIETNLNIKPVDEVNVNLAYTYMNAKNESYDPATASSSVTNNPDPDWLAYRPEHTASASTTWKATKDLALNVNGRYVSKYKNINMYNNVAGTNYPGDFVVLGVGAKYKVNDNFSTSLVCNNINNTQYEEVMYFRAPGRSYVLGVDFSY

SEQ ID NO: 2816 - protein, 287 aa, Sulfitobacter sp. NAS-14.1
MKKVLFATTALVATAGVAAADVTFGGYGRFGIKYDEDASSTDLTTRMRLQIDATAESDAGVVFGARARINADGNGVTNGAGADFNGVRYFARSGGFEVGVGNIFGALESMPGQYPIDLGLTGLGYDYTAFSGADAYTSTGDGAPNGVEVLYSAGDLSVHVSASDMNDRIAGYVAYTWSGWTFAVGGQDSDDATDNDWTATAGGSFGIADVTLAYADNGGTDRVVLAGRFDVGAATDIEVYVADQDGSDTGYGIDFNHDLGGGTSLRGGVAKRFDGNTQADMGVRFNF

SEQ ID NO: 2817 - protein, 665 aa, Sulfitobacter sp. NAS-14.1
MKFSYVLAGILMLNLALSASETVRLGPVTVSAKLQKSTLDEPTKVEIAGRGTILESGDIAKSLLNISGFSMERKGGGGSEVYYRSQTAARLPVLIDGSMLNGGCGMRMDTPITYIAAQNYNSVRIVKGPQDVRNAALISGGIFFDRDILRLDKFKYGGNLSFLAGSFKRFEANADVMAGNELGSVQIFGGHFESNDYKNGDGKKMHTNYNRKNASLIATLTPTDATAIQLSTDIGRGEAAYADRMRDGTQFDRTSFGAKFEQDIGRHVFRLSSYYHKIDHIMDNFSMRPVVPGTGRGKGYSISHPIRTMKGVKAEVELNFDDLTSYIGAGYAQDVFKWRGAGTGMAGVSKADMEAALSKSHTKEREVTYRSLYTQNEYVIEDDYGVFGGLRLDKGERKIFKTGKKRDENLLSGFLRYEKYLQNLTLYAGLGRAERLPDHWETNKDPDLNLNKERNTQLDFGAVLKDKNYEFNANFFVSKMKDYILLNYNAMGMASGAFNTDALMYGGELEGDVLLNDLVRLGAGVSYVYGRVTKDAGGLKNGDALPKISPLAFKFSAGLEQPTWFVSANFYANASQTRTQKGYGDVGGVDLGRSDSFWTLGLNAGYKYKNYQILVAAENLNDALYSYHNSKGGYSGGIAGYETIPNGTRLYEPGRSFWVKFKVHF

SEQ ID NO: 2818 - protein, 365 aa, Sulfitobacter sp. NAS-14.1
MAALLGSASTLHAGGIDRSGQSITALFESGRYAEFSLGSVSPNTSGTSTVFSGRAGQDSGNMTDSFFTFGAAYKADINDQLSYAIIYDQPFGADVDYPNGTNYFAQGSTAEFNSHALTGLLRYKMPNNFSVHGGIRVQTIEASATIPNRPAVGLVYNVEGDRDTGVGYVAGIAYEKPEIAMRVSLTYNSKIKYDVDTVERVSGRVVSTEPTHVETPQSVNLEFQTGIAADTLLFGGVRWVDWSSFEIAPAAFGSAPGNPKLLSYENDVYTYSLGIGRRLSDTWSVAAVVGYEKSNGGFSSNLGPTDGNKSLGLAATYTRDNMEVTTGIRYINIGDADTTLDGTNTAGVFEDNDAVAIGVKVGYNF

SEQ ID NO: 2819 - protein, 387 aa, Sulfitobacter sp. NAS-14.1
MKLARTKLASASGKLSLIALAILAGPFALADDLGWYAGANVGRSSATIDDARITSGLLGSGLTTTSITDDNRSSGYKIFGGYQFNRNFAVEGGYFDLGNFGFNANTVPTGTLSGNIKLKGLNLDLVGTLPISEKFSVLGRIGVNYADAADSFAGTGAVNVLNPSPSKRETNLKVGVGLQYAFTDALAMRAEIERYRINDAVGNKGDIDLVSLGLIYRFGAKTPTPVPVAYVAPPVVVAQAPPPVEVAPPAPVPVVVPPPAPKKVSFSADSLFDFDKASLKPTGQQDLDKLAAELKNTQFDVIKVTGHTDRIGSHAYNQKLSERRAEAVKGYLMTSIGIAGDKIVTKGVDGAEPVTKPGECQGKKVSKALIACLQPDRRVEVEVVGTR

SEQ ID NO: 2820 - protein, 793 aa, Sulfitobacter sp. NAS-14.1
MGMTMAMGLGSFAVAQDSQTPKLQLEEVVVTSRKRSESVQDVPIAVTAIVAELENPSVRNLRDLEGLAPNVQIRHSMGRTAGHAISIRGIGYSNDEKSFDPAVGVVIDGVSMTSSSGTLLDNFDIEKVEIMRGPQGTLFGKNTIAGVINVTRTDPTGELGGKLSATVGNFGRTDIKAVINTPIIEDVLAAKLYVASLKDDGYIKNVTLDKDVAAQDYLNYGVKLKWTPTDTLTARLTLEKMDDNSDNGAYRNLTGLGGNRSIALQDGYSGGWEPYNPGAIIALTGNPRYAQNSSNPEINGEGCLAANDPARDDDETSAAKENLGEMETDAITLQVDWELNDGSSLTYIYGYRDTEELAIWPYSGSACDFITVDNYNENDQESHEIRWAKTTDSYSVVLGLYQMENSYSQDWFTYDFWELIRPETALVSLYAATPEQVERLGSDFGQNIYQSQDTTGRAVFGQLDYWLTDKLELTVGARYTQDDKDFFARDYCLKADADRDLQNWDNCVNTAALTGEGSGRTFNGDISESKTTGRLGFGYQMEEDILIYGSVSTGFHSGGFYGKNQALSAFAVTYAPEEITSYEIGAKLELMDRRLRLNVAAFNSTVEDLQAVTTIPNPNDGTSISAPFNVGEVEYQGFELEAVGIVTDEIRLSAAVGFLDASYNNFDADISGRTGGVPIDNSYLEPKQAPEWTLGLAANYSTDFAGGLIAANAMYSWTDDFYTEESNDPVSLVESYGKINLDLGYERDNYRITAFVNNLTDESNWVSRSSGTLITYGQQSKGRTFGVELAVSF

SEQ ID NO: 2821 - protein, 721 aa, Sulfitobacter sp. NAS-14.1
MGTTAPPTATVITTETQLALQVTSGEANSPENADASENADTSEDTELEITVTAQRREENPQDVPISLTVLTEPEIEDADVTSFEKVAGNTPNFNWFSPTDSRSFSFYSVRGLSNFNFASRDSVGFFVDDVPLDYGGTLESDFPDLERVEILRGPQNTLYGRSAQAGVVNLITRKPTNDFEGNAALSFGSENNLNLRAGISGPLIEDALFFRLAGTFGRRDGFYNNLFLDGEEFDEKLGGNIRGKLLWTPSDRWEISFNAFYENNQDGTYPFVPLDDTPFEIEQDFNGFNTLKTNSQALKIIYRDDNVQATSISTRRFSEFNVQTDLDQSTIDGGFFENDNASTIFSQELRIQSPDDSESRWQWLIGGYFESRTFDENGRGVRLGNDAGLILPAPLNVPGARTESFGELVDTTFAGFGQVSYRPVDALRLTVGLRYENVSSVLNSLRQVLTFPGAPPIPLGNFDGTEQTSTALLPRFAIDYQLSPNATVYGTVARGFRPGGVNIFADDATSLVYEPERSWNFEVGVKSNWLDNRLGINLSLFTNSIEDYQVITVDPITFTPVGIFNGDANVKGLELEMRATPVEGLDLTASLGLLDAEFTDFTDVATGTDFTGNRLPYSPSFTFNVAAQYRSSFGLFVRGEVQGVGETFFEEANAQNIRQGAYVLVNARLGYEFGSSGIFLFANNLFDTRYVTQAFNLGVAGVASGSYGTPRTFGVQFRTRF

SEQ ID NO: 2822 - protein, 1024 aa, Sulfitobacter sp. NAS-14.1
MQISQTRRRLFGSCAALSIAIAASPVSAQDLEEPAEDVTSDVTDADVESGGRIIVTGSRILSDSAASTQPLQVLDAQNIAQSGVTNIQDLLLENPVFGAPTFARTNNAFGVTGTGVATVDLRNLGIARTLVLVNGRRVVGGLAGTNTVDLNVIPTQFIGRIDILTGGASSLYGSDAIAGVVNFVYRDDLEGLNLEGRYGVTEQGDAEDYRLNATFGGSIDDGRGRFMLHAGYSDQGQLLSRERSNTLVDDIDLFRLSGDPADFGTPSEPFFSSFPPQGRFDVNGTASNADDFTFNPSGVLQPCFSTNGTPSCTAFDGSPASGPNGFNRQFFRTLASPVQRYVFAGTADYEITSGVTAFLEGTYVKTQSARIIEPFPSSSSGTNGLFPATGRAPIETRVLVDSDGDGVLDSSEIRVNPLVPDEIVAAASDLDGDGLRDIGFVRRLLEVGERTNDTTRDFFRVVAGLQGEFADGQFRWDVSYNYGQTTENQRSAGALNVPNFQQAFAAVADIDDVDGDGDTTEVICASADARAQGCVPVNIFGQNAISPEALAYIDAPGSFQTEIEQRVFQANLSGELFEIWGGPVGFATGIEYREEASLADFDSLTNQGLNASNQIPDTQGEFDVIEGFVEVRVPILSDVPFFRTLELAGAVRLSDYSTVGSVTSWNGQVLWEPIDDIRFRGTYSRAVRAPNIGELFSAQSQTFPPGLTDPCVGIGPSGGGILGDTCRSFAGVNDNIALNGVFTLNQADIQGISGFNGGNPNLTEETADTLTLGLVINPRSIEPLRNLTLTVDYFDIEIENVIAAPTRPFTLDQCFNKGNQVFCDLITRRAAGDSTNSAGSLEFVNAIQSNGALRETEGVDVTVQYNTSLDGIGLENANLNLSGAYTHLIKLNFFPAVGEPANPLAGEVGSAKDRFTTTALFDFGAISWGLTGTYIGASTEDDQFCSAFGLDAGCFRQGAEFNLDTQVVFDIDELQIFAGVDNLLDNDAPNLLTGTTFNATSTDTASGVYDILGRRYYAGVRFRF

SEQ ID NO: 2823 - protein, 805 aa, Sulfitobacter sp. NAS-14.1
MEQKSILSFCIFLLFLLSWGVFAQSEETQRPSLNGEEPERAAISVIGKRKVDLKRIPGSAIVVEKEFLEQTKPVDSMEVLRRVPGASIRYQDTGLILNLGFRGVNNDLGRKVLILEDGIFTSLNPYSAPEQYYTPNIDRMERIEVIKGSGAILFGPSTIGGVVNFITKRPSKEPTLSVSAQGGSYGFFSSQVSYGGTFGNTGIDISFLRKQGNGFRDHQDFRLHEFSFKSITDLNEKHILTSKFLATAQDANMTYLGLTTAQFWNHSSSNFAEQDNRKLQRYSGDIGHEWKFTDHSKLVTKVYAAYAKRNWARQNYLRNTGSNFGAIPGNVIKTYDTEPFVNRPGDTVYMLDSVGHRNRFYRFVGAESRYQQDYQFFGIKNQLDAGLRYHYETADIKYLDGPPTPDYAIFGNGFDKPPTGTASSEYSLSKSGNIRDHEVNHTKSVAGFAQNSFKFYDRFSVIPGIRYESFVQNRTILRQQSLDPITGQPLPNSPSQEVDKGSKHTYHVVIPGLGLTYDLNKDVTWFAGAHKGFSPPRYQDALNNSGVVNRIDPEYSYNYETGFRGDITNYLSAQVSYFDLNYINQIIITSSTSGNDSASSAKNGGRTYSRGLETNVTFDPAKLFGASFKLPIDLIYTRADARMNQHSIDAAKIMPNQSLLDFIVAQKDKNGNYVPYVSRDTATLALGFIHQKGFYSRVEYQYFSAQYHDDSNTRTIYWADLITDPLGKKVLQYLNITSNSSGETGVIPAYGLIHFSMGYKDPIKRWSLFVTGKNLADVRYISGRLPEGIQVGPFRQINVGVAFEL

SEQ ID NO: 2824 - protein, 1100 aa, Sulfitobacter sp. NAS-14.1
MKMKARTKMKTLLLLGVLLFGFTVSAQSQKVSLDFKNERVEKVLASIKSQTGMSLVFSDQLVDVNRKVTMQLKDVTLKEALTRLLSGTDLTFEIRNNKIYFIEKKAVSRPGSKKKRVTGVVKDVMGEPLIGANVVEKGRSTNGVITDFNGKFTLEVDESASLVVSYIGYLAQDIPTKGKGDFHIVLKEDANTLDEVVVTGYGDFKKATYTGSASVLTTEKLEALPVVSVGQMIESNIPGISVVAGTSSQPGAKTTLRVRGIASMNASTEPLYVLDGVPIPSYDLSNFTSMSEAGGMGVIETLNPADIESITVLKDAASASLYGAKGANGVVLITTKKGKEGKLRVNMAAKYGITDFAYTYRPLMGGEERRELIHEGLVNFQLDKGVSEQEAQQYADANIDQYAKRLPQGYSDWESALFKKGYQQDYNLSASAGNQNSSFIGSLGYTKQTGVSLNSEMERFTGRVDASNKYKKVEFGMNASFSWTKNVHLPEGKFYGSAIYASKVNLTPSTPIYNEDGTYASGYRENNGYNPVLEAEVNDYYARTVRAMGTAKIAYNVWDNLKISSVFTVDYSLTKDFFFQSPEGRDGATYQGRGRMQMTDRMRYTSQNNLTYSKTFGKHSVSAVAAFEVMKYDYEDLYAAKKTYGQDINTSLGNAADPIDADQKLQEDALMSYVASVNYSYGDKYYASFSFRRDGSSRLSPDTRWGNFWSLSASWRLSQEKFMQSLKSVLSDLKLRASYGVNGNLPSSYYGYQSTYTTGAFYNGKPSPWESTLGNEELTWEKNYALNLGLDIGLFSRVNVSLDWYTRTTKDLLMSKQLNSISGFSSLLTNVGQMRNTGVELEVRSNNIKTKDFSWTTAFNLSHNKNKILKLADLPWFVDGRYVRKEGYPFNTIYLREYAGVDPETGSALYYDNQQDENGNYTKNKVTDPGQASPIPLKDITPTISGGFMNTFNYKFIDLSFNLSYSFGGYSYDNASYILQDDGYSVISNKSTEQRRRWQKPGDITDVPRFVYGNKKGGNYNSSRAIHSTDHIRLKSLILGLNAPKAWLQKLGIGNARIYFSGTNLLTWAAYGQYDPEMSGVVGFYTPPLKTYAFGLELKF

SEQ ID NO: 2825 - protein, 997 aa, Oceanicola batsensis HTCC2597
MITSSLKARKSLAAIAVGTALILTAPSALAIDTGTVKGHIISNEGTVLSNATITLKHKTKGLVFTVKTNDKGNYSLRNVPVGDYNITITKDGYNGAEEPNISLRIGQPVIIDSQLLSSSATAQEIERIDILGSSIRRVDLASSTSGVTFNQEELDRMPVDNGFENIALLAPGTSSAGGSNFKGASSFGGSSSAENAYYLNGLNITNIKTGLGALSLPWEAISQTQVKTGGVSPEFGGALGGIVNAVSKSGDNEFKFGGQIRIDPSSMRASQDTVYLANGNVSSDGATGQDSYQFTEARLWVSGAIIEDSLFFYGLYEPRKEDETYSTQTVTTDRVRESDRWFAKADWFVNENHSFGFMAMNNKRTWTKKNYAYDSQANTVGEKLGVNSPGEDGGQLYSINYNGYLTDNFSVNAVIGRVVEEVNTIPGSAAPSVWDATDGWVKLSNDTDSTLKNEEYTRDQARIDFSLDLEEHAISFGVDYTNVAVDYLEFPNGEGDAAAWWTVYTAGDGSVSGAPAGDTYIEKRVRNRFTDSDVSQLAFYVNDSWQATDNLVLNMGVRYTQSENTMNSGEAYVDFDSQIAPRLQAIYDLSGDGSSKVYATYGRFFQPVSANMNITQGSSATDVRDYYRTDQLDNDGYPALLADGSPSHGSAYRETDIRQDSTNLAAGGIASTTLEPMYSDEVTLGFQQEVFDTMTFGTRVIWRELGRGVEDSDIQSPLNKKLAQLGYNDVGGTWFLHNPGESLTIEQDFDGNPDNGVEAVTLSAEEMMLPKMERHYAAMEFTLDGSITDSFRINSSYTYSKNWGNTEGLVKTDNNQADPGWTTSYDYGDVMDHGYGLLPNDHTHVFKFNGSYDITENLIFGFVSSISSGRPQSYLGRHPTGVDSCAAGNVWEACYGNSGHESFYDENEQPAKRGSKGNLDWVTNVDLSLTYITEVMDGDLSFKATVYNVFDSDSATNINETRTSLNDDGNLVKNADYGSITDRQTERYVSFVARYEF

SEQ ID NO: 2826 - protein, 375 aa, Oceanicola batsensis HTCC2597
MSRIKFALAATAAAAATLAASAAHAQSNVTLYGLIDTTISTVNNTNAAGARTTGFQVPWFSGSRWGLTGKEDLGGGTSAIFKLESEFETPTGNMDTPGVLFNRDAWVGLSSESLGKLTFGRQNAIARDISGIYGDPYTSEKVGLDEGGYTNVNNFKQLIFYAGSATGTRMNNGVVWKKMWGGRFLTALGYQFGEVPGQFTQGTTESLALGYNGDNFHLAGFAQQAKVNGFMDRSYSVGGNVIFGMFRVNAGYFHYTGEQPAALGNRKDDAYTVSLKIAPQGAFDYEIGYQIMKAGNAAFSADGNTLNAYANVAGATAAGSGRKNTLYGSVFYHVSKRTEFYVAADYMKLKDQYIVGGTNGHNSQTEFAVGMRTRF

SEQ ID NO: 2827 - protein, 1012 aa, Oceanicola batsensis HTCC2597
MAQENLKISGQVTDNKGEAIIGASVKVLKTGTGTISDMDGKFTIQVPVGAELEIGYVGYNPKRVKVVNKNFVTVVLEENVVALGDVVVVGYGIQKKESLTGAIGNLKVDDIVKTKAPSLAQAIQGKVAGLRIRQENGEPGKFSSNINVRGFGTPLFVIDGVVRDGSSEFQRLNPEDIESISFLKDATASIYGMNSANGAVIVTTKKGATGKPRITLNANVGITSPTNVPEMANARQYMTMRNEAEINAGRPAYITKDELTKWQQGAPGYESVDLYDAVFNKHATQFQTTLSLEGGTDKVSYYGSFGYATDNSLLKNNALTYDKYTFRSNVSLKITKDLTASINLGGRYDTTNRPWFPFYDIFKSTRVNPPTTSIYANDNPDYYNNFSYVPNPAAMIDADYTGSAKERNKNLQTQFALEYNIPYVKGLKVKGTFIYDYNNYGYKATRKGFKTYTYGEYTGEYTAADANYPALLQDNRRESERVDMQFQTNYNRTFGNHTIGATYVFERREEKANWMNGERKFDFFTIGELDNARESEPEVSGSSEHQAYLSHIGRLTYDYKGKYLAELACRYDGSYRYAPGSRWAFFPSASVGWRISEESFIKDNFKFVDNLKLRFSAGRSGQDAGDPFQYFSGYTLNSGGYVFSQGNYTNGVASPVMINKNLTWIKVNMYNIGIDFSIFNRLIAVEFDIYQRDRSGLLADRYGSLPNTFGSKLPQENLNGDRTRGIEFTLTHTNKIGDFHYSVSGNFNLARTQRRYIESGPYKSSMERWRNQSSNRWGDFIWGYQTDGRFQNFDEINTYPIQNGDNGNSKELPGDYILKDVNGDGVVNDLDKTPLFWSGSPLIHYGFNVEASWKNFDFYALFQGSALYTVQFDEVYAKMLCFKGGNTPEYFYDRWHLSDPYDANSEWIPGEWPAIRLEQDMGSFYTRDSQIWRKNASYLRLKTIEIGYTFSPRLMHKLGIGSLRIYANGNNLFTVCDPFVKAFDPEKIEGDYSAGLNYPLNKSFNFGLTLNF

SEQ ID NO: 2828 - protein, 377 aa, Oceanicola batsensis HTCC2597
MLGCPLAAAAQSSVTLYGVADINVEYVNRVGAVPVAANGFNRGPGDKVFRMASGGLSGSRWGLRGMEDLGAGWQASFVLESGFGVDNGALQQGGRLFGRQAFVAVRQANVGQFSFGRQYTSIFEALANFSPTAYATQYEPVVLQAGANFREDNTVKYTGQFGPLTARAHWSFGVGLALPQTVGVATPIGGNGEVPGQFRRDTAYGASLAYAAGPFGATVGYDQWNPTIGTSNGTLRKAVVGASYTFGPAKLMGGYRWGQNKNAADVVIQRDDFYWIGANYQVTPAVGLTLEYNYDNVRSLFGDTQVANPWQVAFIANYAFSKRTDVYVSTAYARNAGLMLESLATVYANSLSLGNSYAAANGQRSMVGVALGVRHKF

SEQ ID NO: 2829 - protein, 387 aa, Oceanicola batsensis HTCC2597
MKKILFATAVLGAMGTAHAQSSVTLYGVADANIEYVSHLGSQPPTPANGFNAGQGGNTWRLTSGGLSSSRWGLRGVEDLGSGTKAVYVLESGFSIDNGVQSQGRLFGRQAYVGVDSRYGQFLFGRQYTSLFHIMANYSPTAYAVQYEPVVAFAGANLREDNTAKYIGTFGPVTAIAHWSFGTGVALPGTSQGAPSVGGNGEVPGQFRRDSAYGLGAEYAAGPFGVAVAYDQYNPSLSSAAGAFVGTGSFKKATIGASYTLGATAKIMGGYRWGQNKAQDGSTLILRDDFFWIGGNYQVTPALGLTLEYNYDNVKNLLGQTHLANPWQVSFIADYTLSKRTDLYLTTAFSKNAGLNFDTSAISFANGYFLASGQSTMLGVALGVRHKF

SEQ ID NO: 2830 - protein, 780 aa, Croceibacter atlanticus HTCC2559
MLTLRSTASIPWGRFFAMRQYVPSAVSSPRLIVPAIGVALSASSVYAADPAANSAITLDATSVNGKAEQASTDYKVEKAASQKYTAPLVDTPRSVTVIPQQVIKDTNALTLQDALRTVPGITFGAGEGGNPQGDRPFIRGFDAQGDTYLDGVRDTGAQTREIFAIESVEVAKGPNSAIGGRGAAGGTINLVSKRAHLGNSLDGAWTWGSDQTQRYTFDGNYQFSDTVAGRLNLMTHESNVAGRDKVNYDRWGIAPSLAFGLGTPTRVNLDYYHLESDDLPDSGIPYTIPTNGSAGRTSAHPSKPNDGGDSDNFYGLTGRDFRKTRVDIATFAVEHDLTDSLTIKNTLRHGNSMQDYILTQPDDSKGNVNNGSVWRRANTRVGNTATTTNQTDLFGEFYVGGMKNSFSTGIELSREESERSSYTVDTDTVPGGSANSNCTPGMIGATSGYNCTSLSNPNPDDPWNGAISRNYAGTTTNSKTRAIYVFDTLELTPEWLVNMGLRYDHFDTDYKTYNAAGTTTAKGKDVSEFVTGQLGLVWKPAENGSIYVSYATSATPPGAMLGEGTEGNPLGGTPDRNGNLLASDMEPEETTNYEIGTKWDLLDQRLSLTAALFRTEKENARVQVDTTTYENVGETRVQGIELSASGKLTDKWQVFAGYTYMQARQIDGGPLGKANDGNQLPNTPNNSASLWTTYSITPKLTVGGGAFYVDDVYGSVANTTMVDSYVRYDAMAAYKLTKNVDLQLNVQNLTNEVYYDKAFSTHFANQAAGRTALLTTSVHF

SEQ ID NO: 2831 - protein, 760 aa, Croceibacter atlanticus HTCC2559
MKKIFFLLYIFLNFGFAYSENIELKSREDVEIENLESQIKVLEDKIQTIKKLKSAKDNKNLKVALVLSGGGVKGYAHLGVLRVLERENIKIDYITGTSIGAFIGTLYSIGYTVDEIEKFLDDVNVSNFLETITDNTNLSLEKKESLKKYSVHLSFDNELNFSFPKGLRGTGEAYLLLKGLLGKYEHMDNFDNFPIPLRIIATNLNTGETKAFSKGDVAKILIASMSIPSIFEPMKIDGEIYVDGLVSRNLPVEEAYEMGADIVVASDIGAPVVEKDDYNILSVMNQASTIQASNITKISREKASILISPDVKNISALDSSKKEELMKLGKVAAEKQIDKIKLLAKADNKKKKEKFVTNSDAKIIINKIEYNDKFDKNTVIVLNDIFKGLLNNPISKKDIDKKIIDVYSSKYMDKVYYTVDNGVLYLDGEKAHSNRIGVGANYQTGYGTTFNIGTDLFFNGKFGNNINLNFKFGDYLGADLGTLTYYGVKNRFGILTNIGYNESPFFLYKNRRKFAKFMNREAYLNIGIFTQPTNNSMISYGVLSKFSSLKQDTGDSLSQKLEYSENQTKTYIRFKYDNLDSISNPTKGIKADFIYNFASSFGKSKSNLYGPAYSIKGYIPINPKLSFVYGLNSASLRGDRIRADQRIRLGGTYTNINNNEFEFYGFNYQEKQVKDLISLTLGFKHKIVYSLYFNTKFNIATFTENNSFGNNNSRLWKNYSKGMGISISYDSPIGPIEFSISSDLRHKRPIGSISIGYKLD

SEQ ID NO: 2832 - protein, 1805 aa, Croceibacter atlanticus HTCC2559
MNLQNSYSKKYVLTFFMSICLLTSSFLSTSARAANFKDLVSKTPTWEKYNSTQQQNIWKNLTPNEKIKKWQEADLVPSFTQAQDDLGIKYKETDLSSFVDNTRNKARHARAKILLYIERVKQQDFDTKKQEYINQGVVPTDIEAATNLGISYDPSKIDNNVENDQKVRRAAKDKKAVIELYISSINRDIKYKHYVDNDIIPEMKEVRTALNMNKDDAESFVASIRTEIMENAKGQYIADSHIPTEKELKNRFGISRDDNRDGYIKSIRLKVMDKEKPQYIADNSIPTEKELEKKFGADKDEATNYIASIATQMMLGKKSYYIDNNIIPNADELMNEFKIGKIKANSYIDQIRAGIDANQLLNNNDTTTKQSAGHSQKKSGSKHNWYMSNQGTHNTETSSGVSRTSSGISTGRKEKQPYFFDPISTFKTHFNHKKNKGNLTQSQHNINRIIQQEENIEAFNNLIKTNPIAALNLEVDSSYTQEAVTTILSDFNDDTIQRVLFSNDTGQLDFNTNIDVKNRPILKKLLENSSSEEKTKFTERIQDYATRNISNSQFKEKARLDLIKLAASKDKSSVENFLALQLELKNKMQPYIVKSTYILTPEIVKAINIELKNKGLIIDSLTKDDMIKLVKALNKQTLNSAIKVILSDSNILSNETNKILGLAVGNNANNLEQTQSGIPNPPPLPLNGGIPNPPPLPLNGSMPPPPPPLNSQDFSSNSNNFDLNKLQAEYPHIHSLYIQFTRNTTVQPKVPLQPTTASATSTDRSTPETAYAKLYAAYRTETGGKKADDLQDQLIKRQADLTNVIRQILTESYANQGADAKTLINLFSISTPEIAEKAKEAFNTLVQDPYIQDITVNGKKTTTSEEIIKNLFNEDTDDAVKRILLSSCKISEELKRPIKLEFNKSELIRELQSKQNPFEQLEFAYTNAQYFDQDIFGNRVEELINNPHILTIAQQATFLITEDTHLRKTINSDQAQAKLDDLRTAILSTIKFEELIKANLPQHEFIAIVKEKEPELLQEFLNATTIKLTGNNNLDQLRLALPSFTGMSNEQVRILTSKLNMPIILKALHECSQEKAKKHIHTGNMPPPPPPLPPDSQDLELAYLTRLGITKSNANTSTFKTTPKIYNFSSDIAVRYKEFALSGQKAAGHKAKYSDANLFKKAIAESVAFEHSKKLPKAHQNNKYFAKIQEAVDTMHSSFIGPRTEIGQEVHNIYTSKLLELAKDKEFIKYVKDDIILSKKLTEVFTSADSDFIDPRTEIEQKIHNIYTQQLTKYPEEAVKEAFTSADSDFIGPRTEIGQEVRNIYTSQLLELAKDKELFLFVTQLLAESTALEQKYGSDIQSENSNNEKKIGRLDLKTLRLFQQKNEATNDESSTKDDTQPEDNNKKSEQSDSKTVLSPRLLCSNDSKNDKSSDDKKSLLALRSSDENDKGYETDEEELEESNSTTDEELKKDIVLESEDEALDVSFKTEAITEQDEATQRQQVSDDTSRKVAILVKATSTLHKPVHYNILSDRLKVAAIGAGDEEASINRGVWISGLYGINTQETWKNIPKYQSRTTGITIGTDAEFINSHDVIGIAYSRLESLIKYNKKLGKTTVNGHLLSIYGLKELIKGFSLQAITSYGHNYIKNRSKSINNIIGKYQNNNLSFQTLLNYKYRTKYDLYFIPNIGFKYDYSRASNYKEYNVDIENLMIQKKSNQSFESSLGGKIVFKPIVTTNNIVLTPSLYGNIEHHFNNKNTKVNAKATFKGQTLQEKIIIPKQPKLGYNIGSNILMSRKNINVLLEYNYYTHKKYQSHQGLIKLKVNL

SEQ ID NO: 2833 - protein, 984 aa, Croceibacter atlanticus HTCC2559
MKTVQLIYQSNAPTIQRASKAALVGASSFLALALCGAANAADRPAEEPITTAAAVAAPTGEQASEPKSSGGTVVEEVVVTGLRGSLQRNLDIKRTSPGVVDAISAEDIGKFPDSNVAASLQRLPGVSIQRAGARGEPQGITVRGFGGDFNETLYDGRRISTATGGRSVDFSTVGADFVGGLSVLKTPDVTLSSSSIGATVNVAFPKPFDHPGRRMAFTASGSLQDDAGKVAPTVGALFSDTFADNRFGILVDAMYTRHDTQTNRVYVSGWPGGRYAPCQLTPTCTPTRLADKSIVGWFEQQYGASQIYTKDERVDGRIALQWSPSEDLTVTLDDNYSRQNIRADNFGYGIWFNQDGLRNVKLDKNGTTVDFTQAGSQTDFVAGTDRSILQTNQTGLNLKWDVSQNLNFEADASYAKSWLNPGGEISSDNADVGYGFAIGPALGISIGGDSKNTLPVLHGYGPNGDAARWADTSVLGSHVTVRQAQENTDVVKQLRFAGSWEQEGFRIKAGGSYLEDHYQFQQSNTFVNNYWQAYPGYGPPSGPNGGVLAPSSLFTDKVSTNHFIPGFSGALPPTLLKFDAHAYQQFLTALGNPQTQTIPGFNYSGGNVGTTFTGAFNLGLDNGSIRDITEKTWALFLRANFDVDVAGMPFHFNAGVREENTHVTSNGFGQVPTAITGSAGDPTLLTVTLSAPQAVSTKSNYSYLLPSIDLKLELTESIHLRLDASRTLTRPSLNLLTPVASVGTGQRVGALTASGGSPSLKPYLADNFDAAVEWYYRPNSYASVNFFIKDVSNFIIGGTQRQTINGVIDPTTGQPAIFSVTQQVNGPEATVRGVELAWQHVFGDSGFGFNANATLVDTNKPYDRTDISQSGFAITGLADSANLVAFYDKNGLEARVAVNYRKEYLRGFGQNQNTGAFGSEPTFENPNLQIDFSTSYALTKQINLFFEAQNLTNETQSTHGRFDNQLLDVFAYGRRYTAGARFRF

SEQ ID NO: 2834 - protein, 278 aa, Croceibacter atlanticus HTCC2559
MKTLHKKAMSVAAVALLSGLACSSVFAEEAAAAAEAPEVSPITANVTVTNNYIYRGLTQSDYKPAIQGGFDYAHESGLYIGNWNSSISWVSDQGLAKSAPIEMDFYGGFKKELIAEGFASDFGVLQYYYPTSQITGTNPNTTELYIAQNATFGPVTGFIKFSYALSNTFAAPSSTGSNYSDITANYDTGFWGITLNGHFGYQKIAGQYIQAGQASASYADWKLGLTKDFGGGLSASAAYVGTNVKQGSGNYSGVYAYATPTGRNMGGQTGLVSLTKTF

SEQ ID NO: 2835 - protein, 512 aa, Croceibacter atlanticus HTCC2559
MIRTVFGAAVVLSISGLMLSDGSARAQSTRSDVAATTRPVVVGGYANRVPARIVPPPASKQAVPASTASKQAAAAHVYVPPSSLAGYFPPSYEEWIRGSTMTGDWGGLRTHLEDRGVHIQGHFLEDASGNPVGGKYAGVRYAHEFGLGADINFARLIHHDIGVLHILLTERAGLSLAAGPLGGAVDSVQQIFGSGETVRITRLSLEKQFNRYVSMEAGWINTENDFGQSTMHWGMSIYCQFQTNAICGMPQGLAMNGGYGWYPTAHPGAWLKLYPAGNDHYLVSAGIYNVDNTISNTHNGFKLGLDDTTGVYLPFQLGWHHGNDYTGDMDGNIRIGGYWDTSEVPIVTSKAGAYQPASVELIDLPTTQIRGRFGGWFEGDQMIQRDSSGSGRGTVIFGSFIWGDPRTALSPYFATWGIIRKGTLPNRPNDTISFGGKIAVLNPKMAQYAGMLQQEGQKAIRPSNEPAIELNYGWRPTPWATLRPGLQYVWHPGGTNRYANAFIIDMETGLTF

SEQ ID NO: 2836 - protein, 729 aa, Croceibacter atlanticus HTCC2559
MKHLSRVVIAMALTVTGLATAQTTQEADTTKSEKLDAVLVKAVRVNAKSPITHSNLTKEEIAKRNLGQDIPMLLNFLPSVVTTTDAGAGIGYTGLRVRGVSSQSTNVTINGIPYTDAESLGTFWVNLGDFSSSVESLQLQRGVGTSTNGSGAFGASINVLTDAVAKESSGEISNSIGSFNSRKHTVKFSTGLMNDHFEIAGRLSNIQSDGYIDRATSDLKSYFLQGAYVDDNTLIKAVTFGGNNVTYQSWFGIDRTTLRENRTFNPAGQYEDENGDTQFYDNEVDDYRQDHYQLHWNQRYNRNWSTNIGLNYTYGRGFFEQFKEDDDFSTYGFDELIVDGQTVNTTDVIRRRWLDNDYYVFNASANYKNRNLDMIFGTSFSHYDGDHYGEVIWARFASQSNIRDRYYDGNGKKNDLSVFSKATYKLNDKVQLYGDLQVRNVDYSTSGITSDLVELLVDENYTFFNPKAGVTYKYNDNNDLYLSYARANREPNRNDFESDSSIRPEQLNDFELGWRHKEGNFSFNANGYLMLYNEQLVLSGELNDVGAPLRTNSGESYRLGLELEAVIPVNSKLTIQPNLALSSNKNKETIRSFDGELQNLGRTDIAFSPEVVAANAIVFQPIKNLQVSLLSKFVGEQFMSNTEAQESKLDSYFTNDINLIYTIKPRSVFKTIVLTALVNNIFDEKYESNGYYFTYDDDFSNPGTITTVEGNGFYPQAGINFLTGVTLTF

SEQ ID NO: 2837 - protein, 230 aa, Croceibacter atlanticus HTCC2559
MSEDMTNTQLLAALVIAASPTALVADQPFDWSGTYGGFNLDLADPILSGIQDCCADDPGDDPGNLDPSAVALGGHFGFNIVQNQWVYGVEGAFFYGGLVDSQLSQSEPIANESDIDINGIGSLRGRIGRIAGDAMVFGILGASYADATYTMRDPDAANSKGSADLSGWGYMIGAGIDLPLTENTSARVSYERHIFDTRVATDDLTTDSNEEDFVKLENVDVLHFGISMHF

SEQ ID NO: 2838 - protein, 661 aa, Croceibacter atlanticus HTCC2559
MFTLQRLCKSRINCPSLPRFTPSVLSCAVAIGLSLSTTLVNAAETTSVNPDMERIVVTATQTKHSELSAPASVSVINRAELDALVIDDLASAVRYLQGVNISEGTSYGRNEISLRGLDSDYTLILINGRRINSREALTSSYGNDFDLSSIPMSAIERIEVVRGPMSSLYGSEALGGVINVILRQPTDDWQTSVGVQYDTPTKGDGGDTTKYNFYTSGALIKDKLLANLIVDSSKRDAWRSDLKPKLDALEDRDEISAIANLQWLIDSNQDLQFDLSYADDERESDWNNYGAILTNYQQAERISSGLTHNGHWNWGDTRLRYYYENVEVTDNSALIAEIGNITQTNHNLDGQSTVLLGDHMLTGGAEYRWTKLENSRNVLGDGVLDDNQSALYLQDEFNLGELNITLGGRVDHHDVYGTEFSPRLYLVYNLSSEWVIKGGGGKAFKAPNMSQSQADYIISSCRGSCTLAGNPELEPETSVNYELSTQYQTTDIGGSITYFHNDVENKIITETWNRVPGAVLTYQNVNEAKITGWELQAWYDLTDDLSLSGNYSKTDAKDKQNGTPFTLTPEDSYNIKLQWQALDGLSTFVAYHYTGEQYLRANVKSDGYGSLDIGANYQINPMFRLKLGVTNLTDSERDNAATDLDYIQKSRSVYAGITASF

SEQ ID NO: 2839 - protein, 599 aa, Croceibacter atlanticus HTCC2559
MAQDGGDKDDGVTLDTIVVTPLRRASSLQRSTSSVSVIDAADIERSAAPDLQSLLQTYSGISVKTNGGQGSSADIYMRGMSSKQTVVLVNGVRTASATSGSTALANIPLTSIERIEIARGAHSSQYGADAIGGVINIITKQGGACGERAWCGSVSTGVSHPWGGYASGSLQGRSSDGIDYAVGAAFTGTQGYDFTTPEAFGHEPDDDGFLQGSFNFALSKDFDWGKIYADGLFSRGRNQYDATAPAFNEADSTAFTGKVGTRIDHTADWSSTVEFSTGIDNSRNFRKGIEGSDWFETRRYGVFASTEKSFDTGKVSHVVTGGVEAYREKINTTIDYDETGRDLAAVFGQYSLEYDALRFDGGIRYDHNGQFGNVTTYNLGASYEILPDLVLRSSYATGFRAPTFNELYYPGFANPDLQPEKSRSVEVGLNWQATASTSLDMALYQTRLSDAIMSTAPSYIPYNIASAKVTGLEATLSHSFNEQWGIKGMVDLKRPVDEDSGNDLPYRERFKAAAEVNFKPVEKLDLTARVLYGGSRYTNAKNTKKLGDYVTADFVALYSIDKQSQLKFSVENIFDKDYETSSGYVAPGRTITIGLTRNF

SEQ ID NO: 2840 - protein, 954 aa, Croceibacter atlanticus HTCC2559
MKQKYFLKAFTIAFMFMLPLGFMAQTVKGKVSDKSGSALPFMNVLVKGTSTGATTNDAGEFSLTVKSLPVTIVVSSLGYTTKEVKVTRNVFLNITIAEGGESLGEVVITGSRTPARSNTKSPLPIDIVSAKDLVATGQTSFDKALQYKIPSFSTVQTPVNDATSLLDPYEIRNMGPSRTLILINGKRKNLSALLYTQTSPGRGETGSDISGIPIDAIKDIQVLRDGASAQYGSDAIAGVINIILKDGTDGGSATLRTGITSAGDGEMFGVSVNNGSVIGEDKGFINYTVDFSKTKVSNRPGTVSAAGEAADFGADLGVVQEFLSRNPDANNINGAPETAAAKFLVNGEYKLSEQSKLYFNAAFINKKVNSFANYRTPYWRTVDAFPYLANFFPGDNPTNAGGYDGYVPTFEGDLNDYNATVGVKSVINDWNIDASFTTGGNSQTYKVNQSHNRNIVYSPSTWVDADGNGVIDNGEITEGAQLYGANSKQSFDPGGTGFYHNVGNLDVSKILTENLSVAFGTEFRYETFEVIEGELASYDGGGADSFAGNSPENSGQFTRYNFGGYASLNWNPIENLTLDGTIRSENYSDFGNAFVWKASGAYTINDKYTLRSSLSTGFRAPTLHQIYTQKAQYSFVPGQGIQVGGLVNNVSSQAGLLGIPKLKQETSTNFTLGLGGKVNRNLTFTLDYYSINVADRIVLSTEIGASAAGNTALDLILNENNLSDLSFFTNAIDTKTSGIDLVIGYNKLKVGEGMLGFNLSGNYVIENARDGAVKNPAIVAAAGQSVVNETQEALFFTSRPEMKLILGTTYDIGKFGFNLNNTYFGKTKFAQQGLQDLESIFLNSADIPAGAAQDGGSDLRTEFTPKVVTDLGINYNATEKLTLSLNVNNLFNVLPEWSFTNATATGQAILDGAAVSNSPSNLITFNQRYSQMTYDGYHFSQLGTMFNLSLNYQF

SEQ ID NO: 2841 - protein, 1050 aa, Croceibacter atlanticus HTCC2559
MIKRFTLIVSVLGVLAGFTNTFAQVTNSAFNGKVTDNKNEPLPGATVVIVHKPTGTQYGAVTQASGRFYLPNLRPGGPYTFQVNFVGFKPQKKENVFVKLGQNLAVDFQLKADAATLEQVVVVSDQLFNNDRTGATSNINRDKIEALPTISRSQQDYTRLTPQSDGNSFMGRNALFNNFSLDGSIFNNSFGLDAPTPGGQTSAQPVSLDAIDQLQVSIAPYDVRQSGFTGAGVNAITKSGTNEFKGSVYTFIRNEQMIGNKVADEEVTNPDLKFTQYGFRLGGPIIKDKLFFFINGESVRREDPGSNFIASRPGIAGVNVSRVEASVMDQISNRLRDQYGYETGPYENYVYNTTNDKFLAKLDWNINKQNRLTLRYNYLKSVREQGPNPFAINFTGGRSPSVNTLPFRNSGYAINNNINSIVAELSTSLGSKMSNNLVVGYTQFRDFRTPFSTPFPTIEIAENNLSYTTVGYEPFSVNNVLDQDVFQFTNNFTIYTGKNTWTFGANFEMFQFNNSFNLFYYGVFPVPASAGGYSFSSVADFLATTDPNDAAYRDYNAEVAQFQQKPFNLVEVDLGQLGVYGQLERQINNQVKLTFGFRVDFPMYFSSITSNPLVTALTFKDNEDNNEKLDVGELPNVNPLFAPRFGFNVDLNGDQSTQLRGGTGIFSGRVPFVWIGNQASNRGSNDPANIGVVNATAEGFRFPQVWKTNLAVDQKLPWGMVGTLELLYSKDVNGVTVRNANLAAPTRTLPDGRVGFDATNNKVNNQVAGAYVLDNTNKGYQLSLTAQLKKRFKGGLDIGLAYSYLDSRDMLISTEISQFIFEGNPIQGNPNQPNLSFSQFGLKHRIIGSLTYRKEYAKNFATSVALFYESGQGGRYSYTYSGDLNGDGVAANDLIYVPKSQSEINLVDIRDANGNVTKTAAQQWTELNAFVEQDPYMSKNRGKILERNGALSPWFHNIDFRILQDFYVKVGGKRNTLQLSLDVLNLGNLLNSRWGIREVFNITQPISFVGNDANGNPQYQYTNTFTESFRNDVSLISRWRAQIGIRYIFN

SEQ ID NO: 2842 - protein, 228 aa, Croceibacter atlanticus HTCC2559
MKKLLTAALPVIIAAAALAPAPALAGSTEGKLQVKVLGTGVLPDGKIVDVKYDPLGLTDGAQTRANDNVVPTIAIEYFFTPNISAETICCLTQHHVSGAGTLEGADHIVDHVLVLPATLTLKYHLPLEGGIKPYIGAGPSMFLYFGEKPGSSITPLGVDKVKMSNDLGFALQAGVDIPVNDKGLGVTLDAKKYFMDTTAHFYVSGTEVLTTKHSLDPWVVSAGLSYRF

SEQ ID NO: 2843 - protein, 380 aa, Croceibacter atlanticus HTCC2559
MYCKQIGVLITLAGLSGAAFAQSSVTLYGVMDDGITYTNNQSGHAAWQTFSGGLGGSKWGFLGREDLGGGTAAIFRLEDGFDVNSGKLGYNGRLWGRQSYMGLTGNYGTVTLGRQYDFMVTNLQALSSAQLFGGSLSSHVGDVDGVWGTYPVSNAVKYVTPTFRGLNAGAMYSFGGVPGAVGTSQQYGFGANYANGPLKVSAAFLEVNNPAVARFDGSAAAVAGRAFTDPVANSIYSGYATAHTMRTFGVGANYLWNATTLGAMYTNTRFNDAVATSSTSFSGSAALNSYEVFVAHNFTPAVMSGVTYDYTSTPTAHYNQVAGGAQYQFSKRTFTYLVVAWQRASGIDSTGHTAVADLTYLSPSNTANQVAVRVGIRHSF

SEQ ID NO: 2844 - protein, 586 aa, Croceibacter atlanticus HTCC2559
MKLLSNTKASLITKTVFFIGSVLLSTVSLAQQLELQVKGIQNTQLNNNVRIYVGMIDKEEADGSERHKQLVREAIDKALRAYGYYQSEVEFQIESQKPPKKDQLIAHVKIGKPVKIADVDFVLQGEATQDPEFIAVTKNIPEKGSILNHETYDNYKSHIQKIALSRGYFDGDFLVSRLEVRPSTQQAWWRLDYDSGERYRFGEVTFENAQIREDYLRNMINFNKGQPYLINDLSTLTNNYTSSNWFSSVLMQPVLDEEHKIVNVDVLLQPRKKNSMEVGIGWASDVGPRLQLGWTKPWINNRGHSFRTNLYVSAPKQTLEATYKMPLLKNPLNYYYEYSAGLENENKNDTESFASSLSAIRYWNHEAGWQHSLGLRVRYDSFIQANVKDKTLLVFPTASVRRTRLQGGLFPTWGDTQKLTIDLGRTWWLSDVDFLKMQGSSLWVRTYLQHHRIVTRLELGWLHTKNIERIPPALRFFAGGDRSIRGYGYKKIAPKNNAGKLVGGSRLLTGSFEYQYQVYPDWWLATFADTGLAANQFTTKELRYGAGMGVRWASPVGAIKFDIATPVRDKDNSKNIQFYIGLGAEL

SEQ ID NO: 2845 - protein, 1079 aa, Croceibacter atlanticus HTCC2559
MRTKFNGMLTLLLALMVQLALAQEKTVKGTVSDESGIPLPAASVVVKETNTGTSTDFDGNYSIKVNQGQTLVFSYVGYKNKEVTVGASSTINASLEPDNQLEEVIITAQGIKKEKKALGYAVTTVESEDLEQKADTDIGKILRGKASGVRITGSGGVSGSGSNIIIRGQSSITGGNQPLFIVDGVPFDGSSGGANQSASSGAFQSGNVSSRFADIDPNNIESVSILKGLSATALYGGEGRNGVILITTKTGKDANKKMEVTVNQSIFFNSIILPDYQDTWGNGFQNVYGAFFSNWGARFDSQATIDNAFRTSLLNNFGVEPSTLFPGRTDLDAQNVTYRPYDSQKEFFKTGTIASTSVNVAGSFSDKGSFNASYAHVDDQSFVPNNSLRRDNFSVGGTYKMSNKFTLSGKISLAKTDIRSPFTDASTGSDVTSSTAGTGGIASIWNVLYLPRSVDITLPNQHPITGESIWYRGGNDRTNPAWAANNTQDKNSTDRVFTNFVASYEAADWMTLSYRLGIDSQNTRSRRVINKGSNDGLHPNGYLQTTSERFTIWDQSLLISLDKELSEDFAVQATIGATTKRQVFERDGSESRDQIIYGLWNHLNFSNSSTIIEGTVFADNNQTYQTFSEQNNVAAYVSGTLSYKNYLYLNTSLRNEWNSTLEQENRSQFSPGVSLSFIPTSAFEGLRSTNGLNFLKLRAGYGTSPGFPGPYTTRGVISLVPNIFQTAGGNSTTTTSIPNFLPNPDLKPELSKEFEVGLEARFLDNRVGFDFTYYNRDTEDQIIQRPLAPETGYTSTFTNIGNVINEGFEIAFDVTPIRTEDFELKFSGSFTQNESSVKGLDDGEQIQYGGIFSTTQNAAINDQPLGVIVGGQILRDEDGNRLVGEDGYWLQDPNNGIIGDPNPDWFTTVNTGITWKNWSVNMQWEYQQGGDIYATTVGALIGRGLVEDTDFDRTQSIVLPGVRQATGQPNDIQLTATEAYFNNIGFGIDEALIYDATHLRLREASISYRLPKKWLDKTPFGNISFTLSGQNLFVKAFNTPDSVNYDPELNSLGVGNSQGFDYLTSWNSRRYGMSVKVTF

SEQ ID NO: 2846 - protein, 835 aa, Croceibacter atlanticus HTCC2559
MYSFFNTLTVTKIISRLILSIGLIFGIFTYGFSQQHYFNSEALENPAEHNEAFNKIISTGTSLAVSGNASNITRSMVNDAANQEVKHWLNRFGTTQVNVNFDKKFSLKESSLDWLLPWYDSASYVFFSQLGIRNKDSRNTLNIGAGVRTFQQSWMYGFNTSYDNDMTGHNHRIGVGAEAWTDYLQLSANGYFRLNGWHQSRDFADYNERPASGGDIHVKAYLPALPQLGGKLKYEQYRGERVALFGKDNLQSNPYAVTTGLIYTPIPFITLGVDQRMGKSRQHEIQWNLQMDYRLGESFRSQFSPAVVAGTRLLAESRYNLVERNPNIVLEYQKQNTIKLAFSPAVLSGLPGQVYSVSAQIQSQSALQRILWNDAQWVAAGGKLIPVSATDYNVVLPPYKPMAPASRTVGKTGESEAAVNTYTLSATAIDNHGNSSNPATLTVIVQQPQFVITSEVTDDGALADGRTPITVKFTVTNIDSTPVAEQEGVITTSNGALPSKVTKKTDAQGVISIALTSFTVGVSVVTLDIQGQQATVDVRFAVLPPDVTNSSFNVSPSDIVADGSMQSILTFVPRNKNNEFVSGITDLEFIQSGVPVTISPVTENADNYTASVVGNSVGDVDITPQVGGESLDLLQKRITLYPVPKITGINVNGEQFATDKGFPKTTFNKATFQLVMNDDVANNTQYDWTSSYAASAPVDNQGKVNIAYKTYGSTVTVTAKSKKFPSYTATYQFKPNLWVFSGTMSLQSSVEASRNCQRTDFTALIESARASNGSRSPDGTLWGEWGSLATYDSAEWPSGNYWTKKTSTDFVTMDMTTGDIPTSAATAYPLCAEPQ

SEQ ID NO: 2847 - protein, 350 aa, Croceibacter atlanticus HTCC2559
MKKSTLALVVMSVVASASVQAAEVYNKNGNKLDVYGKVKAMHYISDNDAKDGDQTYVRFGFKGETQINDQLTGYGRWEAEFSGNKAESDSTQKTRLAFAGLKLKDFGSLDYGRNLGALYDVEAWTDMFPEFGGDSSAQTDNFMTKRASGLATYRNTDFFGVIDGLDMTLQYQGKNEDRDVKKQNGDGFGTSLTYDFGGSDFAVSGAYTSSDRTDDQNLLARGDGKKAEAWATGLKYDANDIYLAAMYSETRNMTPISGGFANKAQNFEVVAQYQFDFGLRPSLGYVQSKGKDIEGIGDEDLVKYIDVGATYYFNKNMSAFVDYKINQLDDKNKLGVNNDDIVALGMTYQF

SEQ ID NO: 2848 - protein, 758 aa, Croceibacter atlanticus HTCC2559
MKKLSLFCVMGLYFANFAFSEELEFDSLEISGSKIKNDEKPFVTPGATSTRDNLNSSTQSIDSIVRSVPGAYTQVDQAQGGVSVNIRGMTGLGRVNTQIDGVTQTFFGSASDDSFHGQIGTSSFTAPIDKNFLVALDVNRGTFSGANGANALMGSANFRTIGVDDIVQEGRVFGFLGKYSYGSNAIGPNFMGAIAGKTMLENNANLGILFAYSGQNVSQNYKIGGGGYIGDQKPPFDTDDDGTPDDNLAAPINPNNLYNQPRSQLFKVEYKSDISEAILNYRAYKNNLAGRKITNDTYQIDYRLNPDSNLLDLKFLFAYNDGKQKYNQDKTWGYHNMSGIKTKNRAVTFDLSNTMNKEFSQDSNLYFTYGVNILNNHYSNDFPEDRVLLPYILTSFYPKGKQEIKTFYLDTSFTKGIFTLNSNVNWINAQLSGYKGVCSMVNPYCQPKNATNLEKDYNNFNYSLMLSADIHPLFNPFISYSKSHRIPNVQEYFFTHDASGEHNMNTFLRAESANTYQIGFNSFAHEILNNNDTLGFKVLYYDTKVKNYIYNRRYWLKADKAIFIMQLNDDEKAKFHGVELEFKYDTGFFYSILSYTYQKSKHKFSDTESLETGGAQSGQSQFAQLPEHYANLDMGVRLFEEKLTLGALAKYTGKAKRIAPVGSLEDDPSNPDAMAPLKTTDKLPKIPTIVDLYANYKILKNFTIKAEIQNLFDKNYMDALYTYNTGDSQNVGGLFNPIYIYNNSARGRTFIVSFEYKY

SEQ ID NO: 2849 - protein, 237 aa, Croceibacter atlanticus HTCC2559
MTRLLLASVAVIALGTSSYAADLAARPYTKAPATAVALYNWTGFYIGGFGGYGWGGKARADNTDFDDDGIDDTAAFPKMKGGFGGGTIGYNWQGFGSPFVFGLEAEIAGSGIDLSFVDPADGSGASYKLNMFGSVTGRVGYAVNDMLLIYAKGGYAWARTKLSVVDGADSFSSSATHSGYTIGAGLEYMMARNWSTKAEYLYADYGKATYGPAPDGDTGRIGLSNHTVKFGINYHFN

SEQ ID NO: 2850 - protein, 1054 aa, Croceibacter atlanticus HTCC2559
MTKNESKLLSLQGIAKASAFCLLLSAFSVNAAMAAPAPAGTVDEVMAVQQGKKVTGVVIDGTGEPVIGANVVVKGTTNGTITDFDGNYTIEGVSANDVLVISYIGYLSQEVPVGNQSMIKVTLKEDTQTLDEVVVVGYGTMKKSDVTGSISTAKGDDLVKNQSFSALDNLRGKVSGVNIFSNSSQPGAYSNRVVIRGIATINSSSNPLYVVDGVVMENFDLVNPNDIESMEVLKDASAAAIYGARGANGVIMVTTKRGKKDGEGVAISYQGSVSVSSIARKMDLLNAQEWTDTFMKGLENENKWLGTNWSLNRTDWFTDRNYFDANGNPIYDTDWQDEATRTAVSHNHQLNIQQAGKNSSMGAFLNYTDQQGIMLNTYNKRLNAKMAYDADPTKWLSTSVNVLVNHTWGRYTPEDGGGQEARRTMIEMLPWLPVYEPGTNKYTTSTSPSLSGFNLEGMSNPVFILNDQRRMKYNTQIFGNAALTFHLAEGLDLKTQFGLDSHNITYRGYSSVGLNNISMPNGWAEYENWNTLYWQEETYLTYNKVLGDHRINAMAGLSWQERTYRRNKSKTEGFSDDFYEDYNMIVGTTPKSPESDWTRWAMNSYFLRFAYTYKDRYSATVTGRIDGSSKFGDNNKYAFFPSAGLAWNVSQEDFLKDSNLISNLKLHTSYGLTGNSEIDPYKSLGKIKSETLLLNGTRAPYSYMETMPNPDLKWEKTGQFDVGFNLGLFHNRLNFDVSYYNKKTTDLLLDCPVPHSTGFSTIFKNIGSVRNQGLDIMVNGTPVQGEFTWNSTVNLNFNKNEILHLGDTDADVYLYDWVGGGSILRVGESMGSFYGLVRNGIFTEEDYKAGKCEKNQIGRPDRSESREIIGKGLPDWTGSWVNNFSYKNFDLTVDFQFVWGVETLQRFMHSTYDRFGMTNGLSNILYDGYNGTNAGTMEQAIFLAYDKPHGGGDTTTDSQWVANGSYLRLNMLQLGYTFDSSVAKKVGLSGLRLYLSGNNLFQIVSKDFLGYDPESTSEVSSSSGVSSGSQFGQNMTFFSYPRARTFTFGVNVTF

SEQ ID NO: 2851 - protein, 238 aa, Croceibacter atlanticus HTCC2559
MVLTLTFSGNLKVGLTGSGNLHDYDWLSDASGFSGYDFNNWTDHSQSETDLDRYINFDVALGHNFVINPQNTLNIHGGFKYTNVKWTASGGDYVYSSKGFRDTTSTLPDGKVISYEQRLPALFIGSEWTTNVDRWSFSALGRAGLTVSGKDLDDHWLRDLHFIDTFNRAPFFELQANASYSFNEQTSLYVTAGFEKHMKMRGDTQIFDHADSTMSFASDGAGASLQAATVSAGLKVKF

SEQ ID NO: 2852 - protein, 765 aa, Croceibacter atlanticus HTCC2559
MKRLLLLCFLVLSTHVAFGMQDEKMGKVKGRVVDAKSNNPIELASVVLIGTELGATTDEDGAFEINNVPEASYVLQVQFVGYNVQKQKIDVFENSVAEVVVKLSGVSVMSEKLVVTGTRSEKFKRDVPVIVNVVDSKMMEVTQSLNLAEGLNYQPAVRVENNCQNCGFNQVRMNGLEGPYSQILVNSRPIISALAGVYGLEHFPSIMIDRVEVARGGGSALYGGNAIAGTINIITKTPHENSFEMSTNTAYIDGEIPDNQVNMASSLVSDNRTLGMFLFGNYRDRNHYDANGDGYSELAELEDIAVGLRGFYLPSDLSRLEAEFHVSYEDRRGGNDFDLEPHQADVTEATQHTGLNGSVNYEQYLSSDYLSKVAVYASLRHTDRDSYYGSGEDPNAYGQSEDLVFVGGAHYSKTFDGLWGEKSEFIFGAETQYNELEDSQPAYERYIDQYIRQYGFFVQDDWKVSQMLSLLLGARVDKHSEIDNLIFNPRLSLMVNISPELQFRSTVATGFRAPQTFDEDLHIEGVGGNQQIIQNADDLKEERSLSWSSSFDYTVRGIGYEWGFTLEGFYTKLYDAFSLEDMGTSNGVQILERHNADGATVFGGTLEGRYLKPYWQFQAGLTVQSSKYDNPVEWSEEKPELATDEFLHTPSVYGYFQSSWDVLPTVTLGLSGIYTGTMKLAHYAGYIAEDRLEESDPFFELNAKLTYHFAFHENFSHEGFDVSLGVQNIFNSYQDDFDKGADRDAGYIYGPARPRTFFVATKLHF

SEQ ID NO: 2853 - protein, 731 aa, Croceibacter atlanticus HTCC2559
MKLKFQKRKFLTVVIVFSMYGGSVVYANGSVPSVSNKYDLGTLTNDGSQYSYVNALSKDGRVAGGFVTPDGNEYIATIWSWNNLKDTINIGASFARSKVKALSADGSIAGGYQYIRIHESISSANLEKKASNGKFLANDDSATFIPVIWSADSWENEVKLELGILESGVVNALSGDGKTIGGYGFSTHLVPIIWSGSHWKDIKQLDVPKEYYDAEVKALSTDGKVAGGYISSKNTTRGILEGKSRNDIQNFTHAFIWSGDGFGIKTDLGTLNNNESEGAEVRALSTDGKVAGGYFSMENGSVFYGAIWSGDQWTTKTQLGTLKSDNSGNSLVYALSADGKIATGFAESDSSIGRATVWLGDHWQTKIDLGTLKSDNSGYSIATALSADGTVAAGYSEVDSGKDHATVWKIIYPTQSHSESQPQSQPSVVKVDTVNTIGALSVLAAETFSVMDLQRQGLILLQQGCEIDDSQVCWSVRTGLVSTGSNRDSVVGFRFGYAMFETLSAGFSLDRSLSRSLQDSYFKNNHNLGAGFYAQWNAPFRGGEWYVRPAVAFNQYSVVVQRPLLTNTEAGSGRSRMKGRDASLEAGQRFNADQSVLLGWHLGVRHSSVLRTAYSEQNAAFPVSYSAINNRRTSAYVGADVAVPLTARLKWIAGLEIDRRLYGDDPVYGGHADYIGGFVHQMVMKRVIGTISSGVEYRLSPTMFLGATFDVSRRALGDRTWSGTLSLGGRF

SEQ ID NO: 2854 - protein, 1163 aa, Croceibacter atlanticus HTCC2559
MWHANSQVTDLIASGQTINTAGKASKTFIDLQQSLNRLEQEFRVSIAYQDEIVKAKKTLATMDSFESVEQALNMLLKGTGLKYEKAGERFYIISQKKRSQVPSLISQDAVLVNSLPASNTINTGNTFSGIENSKVEKRRIEIGGRVTDENGNGFPGVNILLKGTTTGSVSDSQGNYVINVENENAVLVFSFVGYVDQEIVVGSRSIINVQLEVDESNLEEVVVTALGIEKSAKSLGYATSTVHSDELSINRTPNVMNALQGKVAGVSISALGSGPGGTSKIRIRGQSSISGQNNPLIVVNGVPIDNTNFGSNPGNNASDSSIGVRGGGNTSDGGDGLSSINPDDVETMTILKGAAAAALYGSRAKDGVIMITTKSKNDSKGIGVTFNLNYTNEQPLDFTDYQYEYGQGEQNVRPTTPNPTSGQWSFGEKFQPGMTQVLFDGVTVPYEPIRGRVKAFFRNGQNVTNSITLATSSEKGGMSLSFSDLNSKGIVPNNTYNRKTINLGFAYNLSPKFSFRGNFNYSHEENENPPNIGQQDNTIPVALYNMANSMPLDVLRDNRYDENGNEAVYSRFRNRTNPYFTLSDQFQNIKRDRIFGNIALKYYLADWLFVQGRVGQDYWSRDQDYNNFPTGQASRAPAPAGFVNGVYTQEQRRFREINTDFLINANKKFGEFGVNVNVGGNHMQRRSDLNSVQVTDFVVRDLYTVQNGRAKDPLYDLNERAVNSLYGSAELSFQDKFFLTGTIRNDWFSTLSKENRSILYPSVSASWVFHENLNTTGWLNFGKVRAAYAEVGSDADVGAYSNVLFYGINNNLFGGQPVGGPNGTNLPNPNLRPMRIGEAEIGFELSMFQSRVSLDMALYRKLTTDQIVSAQISDASGFVNTSINSGKSENKGVEMLLTLVPVETNDFTWEASMNAAYNKTEVLSLLTDQPGERITVGTHVFNGELRQIVGMEMGQVAGFGYKRDDQGRKIFGANGIPLRTSDLVNYGSALPNWVGGFTNSFNYKGVMLSFLIDFKLGNIMLSGTNFNAVRHGLHKMTLEGREGGVVGEGVNEAGEINTAVAPVQSYWEVVRSQALVEPVVFDGGYWKLRQITLGYDFTKHLPANQPFKSVKLNFVANNVLMLKKWVDNIDPESFGYSSDNLVGMESTGLPSTRGLGFNLNVKF

SEQ ID NO: 2855 - protein, 761 aa, Croceibacter atlanticus HTCC2559
MMRGQGGYGAARRAQAGYRAIAIATLGMAAGLSAAPVAAQSSGDDAQLSEIVVTAERRETRLQATPIAVTALSGAAMAERGATTVSDLAGTIPNFTGQASPAGGDSSGQYFIRGVGQFDFIVTQEPSVGLYLDGVYVGRTAGAALDLVNIERVEVLRGPQGTLFGRNTTGGAIQVVTQKPAREFGGSAEVTFGSRKRLDIRASINAPLIEDRLFANVAVASFDQEGYGRRLTTGEKVGERDNIAGRAQLFYDGDDVDIRFAVDGSKRDVGPGQESLILVDLANPASAGVVAYNASLQAMGFAPIGTNFIPKDPLDTYSAYPAKDNYEIYGGNLTVDWSIGPDLSLKSISAYRNLKAQASRDFDSTPYPLIQQAIDDDQSQISQELQLAGKAFDQRLQYVAGLFYYRERARQSQFADLFVPIVRTGPGAYDFAPTAGGTALRVFNNQTTKSYAAFAQLDYRLTDSFSLTAGLRYSRDEKDLISSFGVGVFGNVRPPAKVTDSWSNLSPKVGVQYKPNDDVMLYASLSRGFRSGGFNGRSFVPAPPTSFGNETIWAYEAGLKSEWLDRRLRFNIAGFYYDYKDYQGSTLDNLAVVVGNIANVALSGFEIESAALLFPGFRLEANLGYLHQNIKKVDPNAAVSIAPFTKLVNSPKWSGSLGAQYEADLGGKGTLTVRGDASYRSTIWFFLPNSPGENQKSYWLYNGRIGYREPGDKWEIQFYGLNLANKRYKVFAENEVGFGTAVTFAQYGRPREFGLTVKARL

SEQ ID NO: 2856 - protein, 1068 aa, Croceibacter atlanticus HTCC2559
MILITIYWGGQMKKAGMGQKRNRSIFRFSTLAFAIHAVSMGGLVALPMQQAYAETAGVKSYNIPAGRLANVLNQFAEQSGTSIAMDAQQLQGLHSLGLKGNFAVEQGFEQLLKATEFNAVKVGQGYTLSKKPTPRVTTSNVQAVSLPPSSTIIEEDASVRLTPIVVYGKEDRDTEGYNKVYDANRSSVYAGKDYVERFKGTNPADVLQGMVGVYSGDARNSGALDPSVRGVQGVGRVPLTIDGTEQSIAVWRGYNGVNNRNYIDPNLIAGIEVIKGPSLERNTTTSVGGGVVVKTLEADDIVRPGKSFGAELKVEGSTNSIDPSLPDMGKVGQNYDNTKPWIDMNGSKYDPDIYKKNRTRSDNSHFSGDDLAGRLAIATKQDKFDLLAVYAVRERGNYFSGTHGAGYYKRATPDSSLDFIPYFAYAYQPGDEVPNTSSHMESWLLKGTYRPTDHQTLKLTYRDTKNIFGEIMPSRIVWGITPDLGVPQWPLSNIHSKAYSLEYKFKPENNRWIDFYANIWQTNTESQTYTRGGWPTTIDFRDNTIINTAISHSDNTRKGITVSNKTRLLDQLDLTLGGSFLKEKLTSDDIYGEFGPSYSLYQALPRAGRREEKTFDFNFNYRPLSWLSFDAGMRYRSYWAVDDFLNKSLQSEIDPSLNPLFTKKSRLKEYTFEYQTMPESYTSTQQRLINVLKQRYATKNPEWDGQLETVPASESTLYNMIWSQKNTLSWKADANGQLSLADNPLNQLNASGQKYVVTGGNFMSVVDQVPVESADKVKDSGWAPQLGASIHLTPNSRIYARYAEEYRLPSLFESTVGFSAMLPYQAIKPEHAFNYEVGYIYDMRDWFSTARNADIKLAYYYNKTKNVIERDQNLIFTNMDEQKLSGLELQSRFDNGGFFTDLSVAYNLKNEVCDTNSAINKMILGGTVQTDQGLEFREPYQRCVDDGFPNGYLVTMATPELSFHGLLGARFFDEKLELGARATFYKAYESPLRKNNDASVNKGYYLNVPLAWDDTWIFDAYARYQVDDYNTVEFVGSNLSNQFYIDPLTRSAMAAPGRTMKISWTTKF

SEQ ID NO: 2857 - protein, 1000 aa, Croceibacter atlanticus HTCC2559
MQKYKMPISRLRMMVCLIGMLLPMCMFAQQITVQGVVKDQTGETVIGASVMEKGTTNGTITGIDGDFSLNMSPNGTLVVSFVGYKTQEVQVKGQKQLQVVLSEDAEMLDEVVVIGYGTMKKSDLTGAVSSIGNKDIKDSPVSNLGQAIQGKISGVQIVDAGKPGDNVSIKIRGLGSINNCDPLVVIDGVPTDLGLSSLNMADVERLDVLKDASATAIYGSRGANGVVMITTKRGTEGKGKLAVSANYSFQNATNVPSLLNAAQYAELSNDMMVNSGRNPNPEWANPSELGAGTDWMDELLRTGVMQNYTVSYSGGNEKSHYYVSGGFLDQSGIVKSVNYRRFTFQSNSDAQVLKWLKFSNNITFSADTKKSGSYNIGDALKALPIYPVKNEDGSWSGPDGNSEWYGSTRNPIGPTELNKSQTDGYNFLANLTAELTFTKWLKFKSTFGYDAKFWFIDNFTPKYNWKPTPTEETSRYKSDNKSFTYLWDNYFLFDHTFAEKHRVGLMAGMSAQWNTNDYLNAQKNVFMFDNVHEMDNGEEMYAIGGNETEWALLSYMARVNYSYEDRYLLTATIRRDGSSRFGKKHRWGTFPSVSVAWRASQEKWFPKNDYINDLKVRAGYGVTGSQASVGNYSYLASYNTSVYPFGISSGNQTALVSSTLANPYIHWEEVAQTNIGFDASLFNSRVMFSFDAYLKETRDMLVKASIPITSGFEDTTTTYTNAGKVRNQGIEMSLHTINLTGELGWETNLTATYNKNKIKDLNSDVPYYINQINNSYVTMLAKDYPINVFYGYVTDGIFQNQSEVNTHAVQPGAEPGDIRFRDLNNDGVINDSDRTVIGNPNPSWLFSMNNSLSYKGFELSVFLQGIAGNKIYNANNIDNTGMAAAYNQTTDVLKRWQGEGTSNSMPRAVFGDPNQNTRVSDRFVENGSYLRLKNITLSYTFPKQWLQKAQIENARLSLSCENVATITGYSGFDPEVGINGIDQNRYPISRTFSLGLNFNF

SEQ ID NO: 2858 - protein, 1013 aa, Croceibacter atlanticus HTCC2559
MNQFAHARRGMLLAAVSGLAIAGPSFAQAQDAVASGQTTESASTVDEIIVTGIRASQQRAVSIKREAASVVDAISAEDIGKLPDNTISDSLQRIPGVQILRSAGEGSTVNIRGLPQVSTLLNGEVYLGAQSITTVQPNFNDIPSQLFSGADVIKSTTGDQLNAGISGTINLRTRRPMDLKEGLTLAAAAEGSYGDKTQKFDPNVNGLISFHNDRFGALLSAAYSDVRLSNSHNGIQETYGATLHNESTADATSSGGFSPTKRPHGTPVAGGIDVNGDGDANDAFIVPQGFTGWNKINQRERLGVNASAQWKINDALELTGDAFFTKQDEHDRTAGFQMQDVNWQAAEFTPGQSRDTGTIVNSYHFNTTQIYNYDLGNFDSYAQTDRYQSKSQNYNLELKYDNGGKFTGSVRGIYGKAHQDYDQSYLQFSLSNGAQWQPGGVGHYPASLGGDRPFNTGGYAVNTIAGAASLPAKVDYTGNKPVFTLPSQLLTELGDINSYALKTISSEGNYRREGDLKVIRADGKYEFNDSFKLSAGARYSERSVDDFEFDRAAPLYGSAASNGTGCLVKWKAFDVPLSDSSCSAGNAAGFYTAGLTRKANDPTLNGEVKLFNPGVAGVPSMYVLDPKAMDHALAFQNRFYPGNVEIMNPGASFNVGVKQTSAYLQADFKGEVFGLGFTGNAGVKVIQTKLDITQYVTGSPRPYGVANLLAGSVETNRKFTDVLPAMNVAFDVAENVKLRFAASETMTLLDLNQWGGGLNPTYAIDTTNPGSPVFRVTGGSQNGNPALDPWRAKNFEGSLEYYLGSASMLSVGAFYMKVDSFIQNGSIVRTDLPDNDGVVRNRTVSISTQVQGDGGTLKGLEAGAKLAFNDLSFMPAMLSNFGVDTNFTYAPSKSGKKDLAGASIPFQDNSKYQANLAAYYQDDRLQARIAWNYRSRRAVSQDFGGTTGLEMYQASTNYLDASVSYDVKPNLTVYVQGTNLTSEYEKYYLTWKDEHAYNNVFEARYVAGVRFKY

SEQ ID NO: 2859 - protein, 455 aa, Oceanicaulis alexandrii HTCC2633
MKRTILLTALTVLSSLSLLRAQNESGASTNPMSGLSLEDCIRIAKERNLNLRRQEIEQENRIISLDAARHSFLPSVNAGIGHNYSFGRSKDKTGVTVDRSSMNTNLSIGASVEVFSGTRRLHDLKQQKYNVEDGIARLQKAREDPSLQIAALYINLLFRQEMTRTAETQLALIREQRNRTAEMVRVGKWAEGKLLDINAQMAKDEQLLVQYRSEEELARLDLGQALELEHPESIAVKAPDTDVLVAERLGSLLAPEEIYRTALGLKPALHSSELQIASAREGLASARAAYFPTLSLSAGYSNGYFRDLGKEYAAINPSFSEQWKNNGSYSIGLSLNIPIFSAMQTQDRVRSSRLQIRSSELRLVEEKKALYKEIRQAYSNAVAADKAIAAAENSKAATLKAYEYARDSFEAGRLSAYEYAEAKTKYALSQVEELRAKYDFIYKAKVLDFYQGKDF

SEQ ID NO: 2860 - protein, 801 aa, Oceanicaulis alexandrii HTCC2633
MPRLTPLALAAALALPSLVFIVSPAHAQTSTAMPISLPAQSLGAALNELAWQAGLQLMVHPDLVEDKQAPAVSGSLTPRQALDRVLAGSGLKADIQGTEVIIRRMPAAESGVTTLVEMKVTAQGMDDGTTEGTGSYTTRSMGTVTGLVLSPRETPQSVSVITHQRIEDQRLVSVAEALRNAPGVSYKAIDRGRGGTTVRGFSLTNFQIDGVPTILDANMDIDNASIAIYDRIEVVRGATGLRSGAGDPGATINLVRKHANNKVFTGNLMLEAGSWNRYGATADLTAPLNTDGSVRARVVANYRDQGGFIDFEQTRTTVFYGIVDADLGNRTRLSLGFSDQRNERKGTYWGGLPVWYADGTRTEWDRSKTTAAKWHRWDDHLQSVFASLDHYFDGGWSIQVNAQYLRAKEVTNLLWFGGLPDRTTGLGMSAWPYYYRGKPRQYQINIQAGGPFELFGRTHELMVGAVHMHGKSGWDSADQIGDPAPVGDFNHWDGSYPEPVYGPTYVGRGQTETQSAAYAAARLNLSDPLKLIVGTRVTRFDRDITAMWGAPPYEMRESAVFTPYLGVLYDLSTHLTAYAGYTSIFSPQNLRDRNGGYLDPLEGQSYEAGLKSEFFDGNLYASASVFRIQQENFGVLDGGTLVPGTTEWAYRAEKGVKSEGYELEITGRILPRWDVSLSWTQFSAKNREGERVAFRYPSRMLKLFTKYDLSGALNGLSIGGNVEWQNDMPDWRANPATGLQENVGQSAFATVGLMARYQLNKSLSVQANIYNLFDKQYYEGSWGTFTYGEPRRILANLTYRF

SEQ ID NO: 2861 - protein, 583 aa, Oceanicaulis alexandrii HTCC2633
MRRSGAYYLLYLPIVGLGFAASAADLPQLTPPMMAFAPLVTPSFTWTGPYAGVFFGYGSLDESGTGRCIGPRCVRLPALSPGARAADLSAGSEVGYNLQASPGSGLVIGAAVDYQTTRLRGYGESILVREVDENSDFAAFYHLGQRLDTFGAVRGKAGYAFDRLFVYGTGGLAYGYVRIDVGTALTVGDRQFAAQGLTSGFRLGYAAGGGAEYAISPHLSVKAEGLYYDLGQRTVSIQAALPRSVYGGTIATHGFLARASLNYRFGDGIPGLGLPEHIRTLLNPVAYTPLPASDWVFEVGIRYFYSTGRSSLLLGDSENAGHKNSRVIYHDVGAHASENFVRVDDNSTGRFAKAFVGSGIITSGRFTDEDFPPRMPLYSHTISKIPGRDIGYAVADVGYNVLVGETYRLGAFAGYQYVSEFADSSGCAQKADNSTCGWPFIPRSVEVVTHDMHWHGMRIGLAGELRYDRLKLSAEAAYLPIADLSGFDHHWLRPDINPLPVYGLGNGYFLQGVVSYDLTPEISIGVGARYWKMVTDRGHTKFPYAEPSALPTPLKYESSRAGVFVQASYKFTDNSFDLGPFLR

SEQ ID NO: 2862 - protein, 727 aa, Oceanicaulis alexandrii HTCC2633
MSYKISVATCAALLMCSGFLSQVFAVQTTKLEGVEVNSVGDNISESGIDEGILSKRVAAGPLADKKVLDMPYQVNTISKEVLDNQGVQGFEDAVRYFPSASIQYRGGGDVGRPQTRGFQGSVVGNVLWDGFYSTSTTAIPMAMFESLQIQNGLAGSLYGGATPSGYFLYSRKRPVPLQNIIWTDYSSRSNLGVGLDTSNKFEKVGYRGVFYYSGGEKNAKDSKFSRRLASLGLDFYLTENLTLETNFSHYEHKNSGMPGAFSMPLTNGVAKFDVPSPVKDTKRGLEQTFGGNHLKTTTASIKLKYAPSESWYFEGGYQWQKAIRDMYGTSGTFLNQNGDYRVVKSGGSGASGRFDVDSWFLKGLTNFETGSLSHNFAVATNGYRWTIYSARNSGGRANLGTSNLYNPVIFNDPHVAKGSGRYKSSSSNMKNISVVDDIKFNDYFSTILSVSRSWFKSYKLDPSKEKNYDKSGFNYGVSLVYKPVENVSLYTTYADSISNEGTTYTFSNGARKGETLVVEPFRSKQYEIGAKARLGELDLSAAIFEIKRPIAYLVGSGANADFKVQGTQRNRGFELTTGGKLVDTLSMYGGFTLLDAKIKNAKDGVSEGKTVIGEPKFQANVLFDYAVPSTNKLAFTTNFHYTGKRYIDNANAHSVNGYFTTDVGARYTTKAWLGKETTIRFDINNLFDKKYWAGMFPSDVDGAIAGRGTSLFLGQSRTFMLSAQVKF

SEQ ID NO: 2863 - protein, 158 aa, Oceanicaulis alexandrii HTCC2633
MLSGKDLGRAIEQAINKKIASGSVKSKAEVARHFKVQPPSIYDWIKKGSISKDKLPELWRFFSDVVGPEHWGLNEYPIPTPTNSDTKSELLDINNLYQAASDEIRAIVAFLLSGNATEPDWVDHDVRAYIAAMEMKVGKYLKALESERKSQNITKTGT

SEQ ID NO: 2864 - protein, 401 aa, Oceanicaulis alexandrii HTCC2633
MKTKLITLALILSGIITSFSQETNAPKFGKGLFNLVGQDSTWTMKVAARMQFLSTSTWDEGADGGWVNPNQNFLVRRARLKFNGFAYTPKLKYKLELGLSNRDISGASAFTSNAPRYILDAVVMWNFHENFELWVGQTKLPGNIERVISSGNLQQVDRSLLNSRFNIDRDLGIQLRHHFNLSDKFLVREKFAISQGEGRNITSGNIGGHQYTARLELLPFGKFESKGEYSGSDLKREEKPKLMLAATYDINKNAVKNRSNQGSYMINDTGFFETDVNTFFLDAMFKYNGFSLMGEYAKRDADDPYAKNTDGSLTGAEVQVGDALNLQAGYLFPSNWEVSARYTDINLDEVITGRDPVEQYTLGLSKFIVGHKLKVQTDLSYLSVDGSNDELMYRLQLDVHF

SEQ ID NO: 2865 - protein, 689 aa, Oceanicaulis alexandrii HTCC2633
MTFRRQTLSGCVAVALLAPTAVLAEAENNSAGLEKAHELKQVDVSALPLGSSSSSTPYSVMDQQTLTQKNKDTLGETLKNQPGVHSDTFGGGASRPVIRGQGGPRIGILSDGSQVLDASSISPDHAITVDPMLARQIEVLRGPSTLLYGSGASGGIVNVLDNRIPTQRPLEEVEGFVAIRANSVADENATAAGITVSATDHLVFRVEGSRRDAEDYEVNGFEELTVPGTYAESDNASIGASWIGDQGFFGMAYSYRRDNYGLPGHSHEFEECEANGTSLSCPSGGHDHDHEGEIVPYVDLASRRVDARGEYRDPFSGIAAIRFRGNHTDYRHHEIEEGAIGSTFTNKGGDARLEVEHKPFGNWRGVVGLQYTNFDFSSLGHEAFVPKTETESIAIFAVEEYVLNEQWSFELGARQEHLTQTPDQRNGQALAKVTADNASFSGAANWAFVPGYELVLSVGHSGRAPSAQELYAQGVHLATNTYECGLLSDCGGGQRDLDDEVSLNANLNLRKTRGDWLFDLGVFENRINNYIYARTLDQQEDFRLIKYSQRDATFTGAEASVSYYGIDPVGITVFGDMVRATFDDGGYLPRIPAKRLGTRLNSYLGNFDGELEVYRSFVQDQLSGFEERTAAYDMVNATLSYRLRGNQRYTFYVRGNNLLGEEVFNHSSFLASTVPEPGRNITVGTRIEF

SEQ ID NO: 2866 - protein, 1074 aa, Oceanicaulis alexandrii HTCC2633
MTEFNSKIKQNSRILKIFLFSICALFACAINAHAQSLVQGTVTDETGESLPGVSVVVKGTTNGTVTDVNGKYSIQATSKDILSFTYVGMAEQDIKVAGQKTINVVMKDDVASLDEVIVVGYGTAKKQSLTGAVSAVKGDELLKAPATNVSSLLGGRLPGISSVQVSGEPGDDQAVLRVRGSIYNVTYIVDGMPRSINDIDPNDIESVSVLKDGASAAVYGLKGAGGVIIVTTKRGQEGKSRITYNGSIGASMNANFPQFMNGPQFAYYYNMADMMDKLANGSITDMKQYTPVFTKANVEAMLNGDPTDGWDNVNYIDKVFGTGINQKHNITVQGGSDKMRYFTSVGYLGQDGNIDNFTYRRYNLRTNIETQLAKNFQLSLGVAGNVGKRETPGYASGGTDSNSTLGEQGWLSVAHQTIMMHPYLPEKYDGLYTATTQNNTSLPNSPLAAIYESGYKHTNSFDLQTNLSLQYNLPWVKGLSVKVTGAYDYKTSHNKNLNTPYSTYINKMPTSTTDWTWTKADDPRGTANGINLGEGQFSSRQMVGQGSINYANSFGKHNVEAMVLAEIRDYKENSFSGYNKNMSFAELPELSFGQPADSPISGYSDANRSIGYVFRLKYDYDNKYLAEFTGRYDGSYKFAGNVSGKRWAFFPSASVAWRISKENFMSDLTFLDDMKIRASIGLLGNDDVSPYAFLSTYNLMDGNKNAYQTILNGKVMQALRASVIANPTLTWENTLTYNAGFDFTMWNGLLGMEFDAFYNYTYDILTAMGGDYPPSMGGYYYTYANYNKVDSKGVEITVSHRNKLNLAGKPFSYGASFNLTFARNRYLRYPDSPNTVEWRKRTGRSVDASVVWVAEGLFRSEEEIDNSAWYGTRPNVGDIKYKDLNGDGKIDEDDRTRVGRGNRPELTYGLNLNCAWNGFDLSAQFTGGALFDVSLTGTYYNGYDDNTVWTQAFKEGANSPLYLVQNAYTTENPNGTFPRLTLGNQGHGGDNGLASTFWLRNGRYLRLKSAQLGYTFPKKWMSPVGIQNLRIYVEGSNLFTISGLPDGIDPESPGVNNGYYPQQRTIMGGITLTF

SEQ ID NO: 2867 - protein, 389 aa, Oceanicaulis alexandrii HTCC2633
MLITFHNMDFILFRINLIRYVVLLFIITLNLDCISVAFSSQIIYGTQNAARVTGKNLKRIYFLQLGAFSQKNNAQQLARKIQARTQYPVIISHSGNAFSVRVGPINTQELHQLSIKLSQNSNITPIKHNSSPKQTPTTQTKSQILVKETSRPLPTHSVTKETIDGKRSWYVTAKVGAQETTPDDQFTVNNDSGFPSPFDQDIYTNSSDSSLLLGIGGGYRFTNIILPAISVGVYYSHFFNMDINGQVIQYSLPEFTNYNYQWKVKSDLVLASAKANVISWKNLMPFVQGGVGVSSNRASQYYESALPDVTPRISPNFANHTTTVFAYQLGAGLDWEIRPQWLLSLGYEYSDLGKVRSGYGTDSWNRETLSSKNLTSNAGTLGFTYLFHG

SEQ ID NO: 2868 - protein, 322 aa, Oceanicaulis alexandrii HTCC2633
MTNGVIFMRLKLLGIALTAPVAFNSLASTEFSFLTPEKVSADISLGTLSGKTKERVYEPAEGGRKVSQLDWKYNNAAIIKGAINWDLMPWLSVGAAGWSTIDSRGANMVDKDWQDASHAGTWTDESRHPNTHLNYANEFDLNIKGWFLNEPDYRLGLMAGYQESRYSFNATGGTYIYSENGGFRNETGSFLDGERGIGYKQQFKMPYVGLTGSYRYDNFEFSGAFKYSGWVRASDNDEHYAREITFRSKVKDQNYYSIAANAGYYVTPNAKLYVEGTWNRITNKKGDTTLYDRSNNTSEHSKNTAGIENYNFMTTVGLKYTF

SEQ ID NO: 2869 - protein, 286 aa, Oceanicaulis alexandrii HTCC2633
MNSVTKIAAAVACTLLAGTAAGASLDYRYEYRAATDYTKTNGDTAHVDARHQHRVKLGESFKLSDKWKHSTGLELKFHGDDSYYDEDSGSVKSANSQSFYDGNWYIYGMEIDNTATYKIDNNWYLQMGMPIAWDWDEPNANDGDWKMKKVTFKPQFRVGYKADMGLTTAIRYRHEYADFRNHTQFGDKDSETGERLESAQKSKVTLTGSYKIESLPKLGLSYEANYVKSLDNVLLYNSDDWEWDAGLKVNYKFGSWKPFAEIWSSDISSSSKDREAKYRVGIAYSF

SEQ ID NO: 2870 - protein, 824 aa, Oceanicaulis alexandrii HTCC2633
MQQFRFSLLAVACASSFLSGSLFAADMAENKHSEPSGSQAKELKNKDVEHITVYGRQNQVVMNSGLATKSDMSLMETPAAVVIVDEELIKAQGADSLQDLVRNISGVTQAGNNYGIGDNLVIRGLGANYTFDGMYGGAGLGNTFNPTRSLTNVESIEVLKGPATGLYGMGSAGGVINLIEKKPEFESQNEIGVELGQWDTYALSIDSTGGLTDNLAYRVVAKTARSDGYRDIGTDRDEVYTSLKYVIDDSQDLMLSASYIKDAIAVDSIGHPIRIYNAASVDGKSADQVGWEDLINDPNGKGIVLTDTQRQELASSLAAGDGLTPYAFGKAGIISPIAKDNEGEELRFKLTHNIYFNDNLFLNQQLQYRDYTSGFARQTGAYNYVYWDRRGSINADPRAPLVENGVLHPFAARRQEYRKVEADETSWQYFADLRYDFELGGIENELLVNANFEDRSIRFKQHSIYDADKVIKNKAGDVIYQGIHPYIYDIRNPNWGTGNFEDYDPLLTSNYNKTVNAWGVGLQHVGYFGYGFTTRVGVAFNEIKQSYEHLGVDARYRASAAEPTPEQDTTDNGITYNLGVTYMPTDNLSFFVNHSKGRTAYSILGSVTGGESDRPDSESVSDDLGVRYKAFDDQMLTSLVFFKSSRTNLRYTNPDYEDGVSGPSVSQYFNDGSEDTSGVELDMNAHLNDQWSVNLNGVYQDARDKKDPTRSSFDTRQKGVPYVTASAWVTYGAEWFSLASPLNISLGAKYVDERSTKSSSFGIPDGYVPSYTVMDTAVSYQADSWKLQLNVNNLLNESYYNKAMFLGGMPGEERNAKLTFSYQL

SEQ ID NO: 2871 - protein, 834 aa, Oceanicaulis alexandrii HTCC2633
MAATAVEDINLTAKQQMRTVRNNFRTVFLYPHSIYYISIISIFAYMTTSKHIILIILTLSLLLCNVCIYAATVNYSVRGKVIDKQSRQPVAYANVVVTGIPGKGASTDSLGIFHIEQVPPGIYRFEATLIGYKSAVTSEYLVSASTPFIEIEMEEDENMLAAIVVTPSPFRKTVESPVSMRIIGLQEIEKSPGGNRDISRIVRAYPGVSFSPIGYRNDLIVRGGSPSENRFYMDGIEIPNINHFATQGASGGPVSIVNADLIREISFYTGAFPADRSGAMSSVLDFRLRDGNPDKQTYKATLGASEVSFSGNGHLSDKTTYLFSIRQSYLQLLFKALGLPFLPNFIDGQFKLKTKLSAHDELTVLGLVGIDKMKLNTDEKGEDAEYILSYLPTIHQETFTIGASYRHYAGKHVQTLTLSHNYLNNRNVKYLNNDDSSEDNLTLRLRSVEQKTTFRFENRTRLGQWTLKEGAEVNYSNYTNRTKQRILSSSSIYHTDLNIFSWGGFFSTDYISTNKRFSASAGIRTDGNNYNQEMKELWKQLSPRFSLSYDLTKQWALSGSAGLYYQLPPYTALGFKDNDGIYINKNLKYMQVIETSLGLDWHLEDRLMISAEGFFKRYGRMPLSVRDNIPLACKGDDYGTVGNEVLIPTERGRAYGIETMLRWQVPGQFNFVSSLTLFRSEFRDIPSAWDNRFILNVSGTYNLPRRWSIGGKLSYIGGAPYTPYDEDKSSLVEAWNAQGRPYYDYSKYNTERLPNFAQFDVRIDKSFYFHRCMVGFYIDIQNITGSKLKQQDVIMSTGVIENPSAPIGEQRYKMKYLKQESGTVLPSIGLTVEF

SEQ ID NO: 2872 - protein, 783 aa, Oceanicaulis alexandrii HTCC2633
MKAQFKLLLLATSIASVFNPLSLNAQEKSTDTKQEITETEESQGIEVIMVSATKRSESVQDIPLSVTAFSQQQLDIKGASSLTGIQESTPNLNFSVQSAGQNVARVTLRGVGTETLVGGGDPGVALHIDGIYVGRNSAAAADVFDVDRLEVLRGPQGTLYGRNATGGSVNIITKKPTDELEGSADLTYGNYNEARVRGVINVPLSDNLYSRITMLSESHDGYIKNLYEGGRDVDDKDSQSGRAQLLYLADSGDEYLLRGYYSKTGGAGPGSQYLGTDINTENGYPSAYLIGVSSAGVGGAVLADAFGLATTATGDSVLPLPTDLHEVRKDAPEFTDTLIQGIDFDASINLSDTLLLKSITSYQTNDNQILVDADSSELPLETRNRNNMAKQYSQEFNLISQTLGPFQWILGAYYYHEELTERFEVITPSGLVPIDTQLGEGAVAGGGGITQLRIASHEVDSTALFAQLSYELNDEWSVTGGLRYTRDEKTQSREIGGQVDITNNVQFLSGDIGPLGPDSGTTSFTEPTYRISTDYELSPDNLLFASYAHGYKSGGYDLNGGEVTDEGEQVPYEPEFVNAIEIGSKNKFFNNKMILNLTAFRYDYEDLQVFRLLATGPVTDNAAQSTIQGVELELKIEPTDNVKFDGSVGYLDATYDEYSIDIPPTDFSGNRLNYAPEWTGHMGAEYVKTIGEGDLITRVDWSYRSDTYFDRANTDLDMQEAYSLFNARVRYDTEKYYIDLWAKNLTNEDYVTGQVINPPFTCGCRTVNVGAPRTYGVTVGARF

SEQ ID NO: 2873 - protein, 673 aa, Oceanicaulis alexandrii HTCC2633
MLKSLWKTMLVSPAVLGMALAANSANAENAPSSLFSESATQGLEIAQAQDELLEKLENYSQEGLSNNANEQVTSVSELRDVSPTDWAYEALRSLVERYGCIVGYPDRTFRGNRATSRWEFAAGLNACLNTMERLIQENVAVLREDIEKLKRLMQEFEAELAALGARVDNLEGRVAFLEDHQFSTTTKLVGEVIMAVTAAGGSRSSEDNQAVFQDRIRLSFNTSFSGEDLLVTRLSASTGTGTDRFTLNEPNLRVLNPNTGQPIGIAFAENTLINPTATQTFNIGPRRNEENNDVTIDWVGYYAPIEPLEDWRINTYVAPWGGRWHHFVPTLNPFFEDFDGGKGSLSTFAQRNPIYRIGGGGGAGMSFQLGFLESLLGPTSVSFGYLAGTTNDPSLNGGGDGFEGNCDGNSRLVNGINPATCQEYSESAGGNGLFNGNYGALAQINGNLFDIFNIAFTYVHAYHKPDSPIFGQGIPTGPGEVGTSFANFSRSELNNAFALGSVGEPGTPTDVYNTNGTNSNDPLQVNPFDIGGKVTNSYGGQLTWRVAEWLNFSAFGSFTNVRFMGRGKSAEIWTGGGGFAFPDLFKEGNLLGIFAGVQPYHGGRQRPYLGQRQGFFNLPSRNPITAEVFYRYQLTDNISLTPGVIWISNPDQFVNIQGADDEVIGTLRGTFSF

SEQ ID NO: 2874 - protein, 778 aa, Oceanicaulis alexandrii HTCC2633
MTFHAYLQYVCLLVVCLCTLPSPMEARVQADRQSTGTRDTLLVIDQESGLPIEGAYILTRERLLVSSPRGMIVFGHGTCFMDTVLVQCLGYGSRRVPLNEVFKESSIHTVCLSPDIQKLGEVVVTGERAGASPNVVSRRLSSPEIRNALGTSLATLLERVSGVSSISTGTTVSKPVIQGMYGNRILIIHNGARQTGQQWGADHTPEVDMNGSSSVSVIKGSDAVRYGSDALGGIIVMEQSPLPFRKRSLQGGISALYGSNGRRYVATGQLEGAFPGDFAWRLQGTWSNSGDRSTAHYLLNNTGTREYHASASLGYDRGRLRVEGFYSRFYSRTGVMLSAQMGSEDLLAERIRLGRPLHTDPFSRGIRAPCQEVTHQITFGRMRLGMKKGGSIHWQSTWQKDDRQENRVRRLDSNIPAVSLHLNSFQHLLRWKRDYRSWQVEAGGQVMFIENHSRAGTGFVPVIPNYTETQAGIYGIGKYHLARGGVEAGLRLDMQETRASGYDWTGSPYGGTRKFNNVSYSLGGHYQLSRRWRLTSNFGLAWRAPHVYELYSNGNELGSGMFVRGDSAMHSERSYKWISSLRYGDGMFSVCLDGYLQWVDGYIYDGPEKETVTVISGAYPVFQYRQTPAFFRGMDFDLRFTPGGSWDYHAVVSFIRANERTKGNYLPYIPSFRFSHELAWIHETKSHLRLRLNIRHRFTAKQRRFDPDTDLIPYTPPAYHLLGFDAALELPVKRGHQVRFMLSADNLLNREYKEYTNRSRYYAHDMGRDVRCGVNWIF

SEQ ID NO: 2875 - protein, 697 aa, Oceanicaulis alexandrii HTCC2633
MTRFTHRIALLSTAALLGYTTSVTAAETAAEEGPERDYLPAEIVVTGAVGEYAVEDGSTGTKTPTPLIDVPQTVTFITDDQLEDQSIRQLGEALRYVPGVSLETGEGHRDEIFIRGQETTADFYLDGLRDDAQYYRPLYNVARVEVLKGANALIFGRGGGGGVVNRVSKTADLGEAFGEFDASADTFGAFALLGDVNAPLSDSAALRVNATYEEFDSHRDFYEGRFIGISPTLTARLGPDTTLTATYSYDDDSRVVDRGIPSLAGVPLMGFEDTFFGDPDFNRTDAEVHILRSRIEHAFSDQLSVNASVQYADYDKIYQNIVPGGTDGTTVSLSGYQDAQTRENLIGQANLVWQVETAGVENTFLFGVEAMDQQSTNQRSNVQFAGTNTTPLADVITVPAFSLGPLGRDRDSSLSTFSAYVQDQLSFGIVEIVAGLRYERFDLETVELLTGVPGSRVDEEVSPRAAIILKPQENLSFYASYAESFLPQSGDQFFLLTPTTEAFEPEKFTNYEIGAKWSVKPGLLATASIFRLDRDNTRATDPNNTGLTILTGASRTEGFELNVIGDITPNWHTNIGYTYLDGEITSQSTFGAAGQRLQQLPKHQISAWNRFDVTEAFGLGFGVIYQDEQFASFSNNVTLPDYWRFDAAAYYTVNDRISLQVNIENLFDETYFPSAHGDNNIQPAEPFSARFGVRVKI

SEQ ID NO: 2876 - protein, 603 aa, Oceanicaulis alexandrii HTCC2633
MSKFLSWYRLLLSTSMLGIAMVHCIPAQAVTETSSADVTAEELEITPSGDAPSAVELPSTDGELELAQAVEPSTLATPPTSITDLSGNQSDPYFPADPSLHASEASLGQVTSVSQLSDVQPDDWAFQAIQSLVERYGCVAGYPNGTFRPSRAMSRREAAALVNACLDNLSNRFATKEDLDALKALQDEFAAELATLRGRVDGLEARVATVEAQQFSTTTKLNGEAIFAFSGVAGDNATTGADISGRVSLNQRTRLNFITSFTGKDRLYTRLQTSNRPVNFSDGAIPGIIDNTGTLQTRIAFDTGNTNNNVILDRLDYKFPIGDKLNVTVFANAAFHHYYATTVNPYFEGFGGGKGALSFFGERNPIYRIGTVAIPSVAGVGTSYMFNKENDFRLDLGYLAGRANQATATTLANGENEGGLFGGTYSALAQLSIKPSEGSQIGLTYIRNEAPDGLMRFGTGTVFSNNPFGGANNITGDSFGFEGTLKVTDWLAVGGWFGYTIAREDNTNNKADIINAAINFAFPDLGIEGATGGLIFGVPPTVIDNDVAARENPDQTYHLEALYSFPVNDFITITPGVIYLIDPEGNSANSDILVGVIRTTFKF

SEQ ID NO: 2877 - protein, 690 aa, Oceanicaulis alexandrii HTCC2633
MALLIGGAIGGATFPLSAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 2878 - protein, 506 aa, Oceanicaulis alexandrii HTCC2633
MKKSIILCACLLGAVSSYGQTVADGLLYSQQGSYGTARYRSMSGAFGALGGDLTAIGSNPAGSVIFANHYASVSLGYTGNQTDSNFIGSNAGDNDNDFTLNQAGAVLVYKNQNENAAVTKFSFGLNYDDTRNYDNNLYIAGSNDISISEYFLSFANGVELDNFQLRPDETISGLYRFLGEDQGFGSQQGFLGYQSFVIDAVDNNDEFNTAYVSNTGTGTFDQQLSQNTSGYQSKLSFNGALEIKNKLSLGLNINTHYIDYQRSTSFTEQNNNGALVDAVRFNNFLDVQASGISLQVGAIAKLTDAIRVGAAYESPTWYDVEESITQSVSARRADGSGGTITEIIDPNVVNIFAPYDLRTPGSISGSFAYIFGKKGLISVDYSSKNYSSLQFKPANDPLFSNNNQQIDQDLTNAGTLRIGGEYRVSNWSLRAGYRNEQSPYKNKDIMNDLTGYSLGLGYTWGQTTLDISYDRAERDYSQQLFESGLTSSAAINNVQNNIIATIGFNF

SEQ ID NO: 2879 - protein, 214 aa, Oceanicaulis alexandrii HTCC2633
MKKLLFVAAIAAGLSAGVANAEDFQPKAKGDLIVHLRLTDVAPDKDASILTRAGAATGLKAHVSDDVMPTLGFTYFLTDKIAVEAILGTTEHNIRAQGPGTDVLTHKTWVLPPVITLQYHPLPAARVSPYVGAGINYMLFYGGKDKNGFKVKLDDGFGYALQAGVDVAVKGPWSLNADVKKVWFQTDAKINGGALKAKVNLDPIVASVGLSRKF

SEQ ID NO: 2880 - protein, 198 aa, Oceanicaulis alexandrii HTCC2633
MKNTLKTLTGLATVASISAMASFGAHAQSNQIEAKDSGFYVGGNYGYLRVEGEDDFDDDKDVWQGLVGYKFNEWVAIEGGYVDFGDYGNDIAGAETDGYTAAIKGILPLTERFSLYAKAGQLWSETEYNFAGVSRDNDDESLFVGAGLSYAVTSNFLVNAEYTVYDTELDADEAFDDIDDTDFETDLKQASIGVEYRF

SEQ ID NO: 2881 - protein, 219 aa, Oceanicaulis alexandrii HTCC2633
MTIKSILCFSVVTLLALPASAGDFLQGTYVGFAGGLVSNAKEDVSAPGLKSSLERKLGFNASLNAGKRLNEYLRVQADIGYLRSGFDKIDGEKVKKGSFSAVHASASVYFDYSLTESFTPFIGIGAGLASFDMGKVTIDNAHWGYPSETYEVQESVTPFLKLNAGAAYKLTDNLSVVGEYNFMQSADFEFSAKNAPAGSPDITTSFQSHIAQVGLRYNF

SEQ ID NO: 2882 - protein, 329 aa, Oceanicaulis alexandrii HTCC2633
MQKTHRLALAALALLGSTAAFAQSSVTLYGRVNTTVERQKVGDSTVTGLFNNASRFGFKGVEDLGGGLKAGFQLESGFNSDTGTTDSRGFFARQSEVNLSGGFGMVRLGRWTAESYFATADYVSLHNHDTGSSADAFYASVMRNQFTNSNSVAYRTPSFGGLTVEGAVSMHEQTSGGKNLYDLAANYNLGALALGAGYSKLGDSNQFALRALYTTGPFMVGAYYQRSDDWDAMSDTAAAVGKRDNFRLSGAYIMGASEFHLNVGRANSYKNLTDSAATQYTLGYNYNLSKRTKVYGYYTRVNNDRNASYATGVAGADFSSVAVGVRHNF

SEQ ID NO: 2883 - protein, 749 aa, Oceanicaulis alexandrii HTCC2633
MIARTNRILRIMRFLYIFLFLSITLNLQAQVTGVVKDTAGEPIPGANVFWINTTEGATTNEDGNFSIHKPARSHLLVVSFIGFENDTVHVDKGNQQLEIVLREGVELGEVNIVTRKMGTMKLRSSVMNEDMISSAELTRAACCNLGESFVTNPSVDVSYSDAATGAKQIKLLGLSGTYVQMMTENIPNFRGAAAPYGLGYVPGPWMQSIQVSKGSSSVKNGYESITGQINVEFKKPQLPEADWVSANLFASSTNRYEANADATVKLSKRWSTSLLAHYENETKSHDSNDDGFVDIPRVEQYNFWNRWAYMGDHYVFQAGIKALHETRNSGQTAHGQTPTHDLYEIGIQTNRYEAFTKNAYIFDKEKNTNLALILQGTLHNQDATYGRKLYDVDQSNFYASLLFETEFSKQHSLSTGLSFNYDGFDQHYRLTNQVEDGLTKKLVKESVPGAYVQYTFNLNDQLMLMGGIRGDYSSEYGFFVTPRAHVKYNPNEYLHFRLSAGKGYRTNHVLAENNYLLASSRKMKIAPHLDQEEAWNYGASVSAYIPVFGKTLNVNAEYYYTDFLKQVVVDMDSNPHEVAFYNLDGRSYSHVFQVEASYPFFKGFNLTAAYRLTDAKTTYDGKLMEKPLTGKYKGLLTASYQTPLGLWQFDATLQLNGGGRMPDPYELADGSLSWERRYGSFQQLSAQVTRYFRRWSIYVGGENLTNFKQKNPIIDASNPWGENFDATMVWGPMHGAKAYIGLRFNLARN

SEQ ID NO: 2884 - protein, 394 aa, Oceanicaulis alexandrii HTCC2633
MKKLLKSVLVFAALSSASSLQALPVGNPAEPSLMIDGILWEGFGGDPCDPCTTWVDAISMRMGYYGDFVFDRVLKTDVNKEFQMGAKPTTTTGNAVAPSTLTARENPAYGRHMQDAEMFTNAACMALNIWDRFDVFCTLGASSGYLKGNSASFNLVGLFGNNENQTKVSNGAFVPNMSLDQSVVELYTDTAFAWSVGARAALWECGCATLGASFQYAQSKPKVEELNVLCNAAEFTINKPKGYVGKELPLDLTAGTDAATGTKDASIDYHEWQASLALSYRLNMFTPYIGVKWSRASFDADTIRIAQPKSAETIFDVTTLNPTIAGAGDVKTSAEGQLGDTMQIVSLQLNKMKSRKSCGIAVGTTIVDADKYAVTVETRLIDERAAHVNAQFRF

SEQ ID NO: 2885 - protein, 228 aa, Oceanicaulis alexandrii HTCC2633
MASATVDNKETKTVKTIQKMGRIALAATCLLSGAALHAEEGPWMIRARALLIDPDNKSDAIPSLAVPSNAVEVDSRWVPELDISYFFNKNIAAELVLAYTKLDVKVNDSAIGAFNAGSFYALPPSLLLQWHFLPDGGIRPYVGAGINYTHISRVKLSVPGVLPLYLDSSSVGPALQAGVDFKLDGPWSLNFDIKKAWIESDVRTGAGVRVSKVKLDPMLIGIGVGYRF

SEQ ID NO: 2886 - protein, 287 aa, Oceanicaulis alexandrii HTCC2633
MTKILASLAAFTALTAAASAADLPRRVPPPVFTPVPVFTWTGFYVGVNAGYGFDANSRNTTNYALRGGTLANSPDTNAVVSVNNRSNNNGFSGGAQIGYNWQLTPGSGIVVGFEADAQYVDFARRANGTLNYGLTGTPGFAFSAPRAYVATSGNGLDYFGTARGRLGYAFDRTLVYGTGGYAYGSGQDDQTFAGRNFRSSFRNGYAVGGGVEYALPTDSFLNFFRSSAVTLKVEGLYVNLDRQKNTASGVFIPNLLPPRGVAYLNGAAAGTEFAVVRAGLNYKFGSY

SEQ ID NO: 2887 - protein, 684 aa, Oceanicaulis alexandrii HTCC2633
MNVTARRTEEHAKDLPFSVNVISGEEAEERRLYSLEDALRQTPGVDVITNMGIANTTLRMRGVGALQKISGDDTSVVINVDGMPMSASNATLDILDVERVEVLKGPQGTLFGRNAEAGAVNVVTRKPTRFFEGSLRGELGQDNQRLLEGMLSGPLSDTVSARLAIRGSGLDNYIESSQTGKPLNKPRDFSGRASLRWDIGPDSALNLSAGREVLKHRDWVYLLYPYGDPPKSDIPSNSERNRREVDRYSAEFTHQFDNSLFTALTGFARTHHRSTTPIYEGRTYTQLIGFRPDATWNSLVRERIFNHELRLSSLPEAETFWVAGANLYRSDRDMDRFDSYDTFFLENPAASSANRDFSSRAHALFAEATFPVAPATKLTLGGRYTWEKKRYDAHWWANPENPSPIREARDAQSLSDSYATGRVALSHALTPQLNLYGVYARGYKSGGFDEEGIGFTSGGQDAPYKPGSVNSYETGLKFESEDRRLTFNLAMFLNQVKNDHLLMFDPQTMATRKSNRNVTSQGLEADWSWMINSHWSVSGGLAYTRAKIRGGGDASGADGVASGNDVPEVPRWEGVLSIAYQKPLGSMFGLSSPHLHARLTNRYVGSRAATPQNNFDLASYNKLDFRVGIRNGGTELYVWADNLLDKQYDLYGYHIPAYMPGGADARIGAPGRERTLGVGMTIQF

SEQ ID NO: 2888 - protein, 800 aa, Oceanicaulis alexandrii HTCC2633
MFKPWPLALAIALATAPTAVVQAQGSAQQQRQRFDLPAASLAQTLNTIARQGGQVMSLDPALVVGKQAPAIQGEMSALQAVQQALVGSGLQLIVTGSGTFSVVPTVDAKGALELGATNINSVGLGETTEGSGSYTTGAVTIGKTPQSLRRTPQSVTVVTRKLMDDKNLVSLDQVMVQTTGITRANRGYGNHHFSSRGFDITDDSYMVDGVAGQAYAYTGWMIPDMAVFDRVEVLRGASGLLVGAGNPGGAVNLVRKRPTSEPRFSVTTRAGSWDNYRLDLDASGRLNPQGSLRGRVVASYEDRGYFTDVSKSKRPLLYGIVEGDLSDATTVALGLRRQTSRIDGYSVLGLPNNPDGSNPHLKRSTFLGQDWATLQTRTDEVFADLNHRFTDNWSGKLALSHSESSYNRSAIEWSAEDTLEYGSPTGPMINDTSFHKFDVTANAVDGHLDGEFEAFGLSHQLSLGANWSRRKMNDKDATVKLDSPIPLNVFDPDHSIVPEPSRQGWDYKEDTFDTRYGTYLNARLHMTEDLSLVLGGRLSWYKTEAWSGGLKSTNEQKHEFTPFVGAIYDLNNNWSLYASYADIFMPQASYRSAGGKMLDPAIGSNYETGIKGELFDKRLNLSFALFYIEQEDVAARDYANDGNCPTDVAGRCYVNSDGISRSKGFEAEASGELLPGLQVAAGYTFNTTQSETGGPISAQTPKHLLRVNTNYTLPGEWNRLSVGGGVSAQSHYYDAYNGVSNSGRAVFDARAAYKLDQHWTVGVDVENLLDRKYFDSTGYWTRGTTYGAPRSYMLTLRGDF

SEQ ID NO: 2889 - protein, 369 aa, Oceanicaulis alexandrii HTCC2633
MRSTLEMTKKTFLALAACTLPAAAFAQSSVTMFGLMDTGISYVSNQGGHGAAKFDDNIFFPNLLGFEGKEDLGAGTRAIFRLVNQYSLGNGSIIGGGLFARTAYVGLQNDRYGTLTLGNQYEFMVDALAASGNEIAQDLVGLYGFRNGPFDRLGLPNNPTGAFDWDRVAGSNRVANSVKYTSPSLSGLTFGALYGFGNVAGSIGANNTVSVGASYDHGPFGAGAAYTNQKYGAADGLPPTSVRNWGAGVHYTVGTVTGKALVTTVHNARNGAGAWSAEAGAAWRPSPVWVIGASYTYMKGNDTLDDAHAHQLLAAVQYWLSKRTMVYVAGVHQRASHGSNAQINGVMDANGASSGALQSIARVGFSTRF

SEQ ID NO: 2890 - protein, 797 aa, Oceanicaulis alexandrii HTCC2633
MFKLENSSFRRSTLSIAVMSLLSSGAIAQDTQQADDDDFEQIIVTATKRAESIEDIPFSINAQTQRDFERSGAGNLEDVARNVASVSIQNLGPGQSQVSMRGVSAGQIVRDQPGVKEQVGVYLDESVISLSLFTPDLDLFDLNRIETLRGPQGTLFGSGSIGGTLRYITNQPELDTFEGKFEANLNTVTDGGVGGHVKGMVNLPISDTIAMRAVVYRTDYAGFIDAYGENGAFKEDVNDGDRTGGRVAFVIAPNDKLTITPRLIFQELEMNGFNRQEVYNLFGNPYTTSRPAVEFDEREQYLLLDEGFSDDTFIADVTAEYQADIADFTFVYSYTDRDILVSRDASALSGSVSIDLGFPDEAVLLPSNLLDRTEVEQDTFELRAASNDDGALDWLVGAFYSSTERVYDQSLPTPGYDAFTDATLGEGTSAAVANGFEANSPYNAYLPYDLKQLAVFGEVNYQVNDDFKMTVGSRFYDYEEERQFISGGLFANGDNQTDATESDGFTSRVIGQYSLNDNVNFNAQVSQGFRLGGVNDPLNRSLCTDQDEAIFGSFQDYDDEKLTNYEIGMKSSGRGWTANISAFYNDIEDLQVTLDAGSCSSRVSFNVPEAHTQGIEFELTRQFTDQLFFSLTGSIIEAEFDSTVVDGDGAVLGGVEKGNRLASVPEESFAIAFTYDLAQPLFSSNATYFQGSYQYVGDRITQPSDQVAGAGTFTSGLAFGGATGTETTELDLLLDDYGTLNMSFGLTYDDYEILVYANNLFDENALLSFDRERGGRARLGFTTNQPRTVGATFRYFF

SEQ ID NO: 2891 - protein, 768 aa, Oceanicaulis alexandrii HTCC2633
MLLTSFSAYCQQNIGTISGTVKTKKGNNLHYVSLLLEGTNLGSTTNSLGVFTIDNVPTGTYKLTASRIGYQTIVQKVTVTAGATSEVNLNLSEKNTRLNEIQVRGKREWVSESLNKIDVPLKYLPVTAHTVSKQLMVQRGVDDLGEAVKSTPGVRPINRYGGFQTFHIRGFNNFVLLTDGVRDERHNISTSAPSTNLANVERIEVLKGPASVLFGHSALGGVINIVRNQPSPVFNANFSATYGSFNTRRLQAGAGGPINSKWSYRVDFGLSESDGFRNYGTNTNNFYAAIQYRPRDGEILDIRMGLNKDSYDTDTGLPVLENGSLVPGMNLHNRYNDPQDFLNHTRYDFQIRYVKQLSKSTKISNQLSYYWDDIDYFSTEELTFNATQDSLTRSFPFYFNHRTKPLQNQLELTHDFSIGNIEQKLLVGYSISLMDRKTYRGDIFGEGKFTTVAVQNPILNQGYIDHQDTRYQAKLENVQGIYVQDWLSIGNHLKALIGLRYDIFNGTYFDNEVDASRNVTSEGEKTNIPSQALTYRAGLVYQPIEQFSIFSGYSTYFKPSRRITGDGQVFDPETGFQAEIGGRYYLSTYLTMTFSGFYLRKNNIVENLGGGVFRQVGSADSKGVEVEVNASPLEGFTLNAGYAYTDISIRKFGGDVTNPLAGNRIAFAPDHLANFWANYEIPKGLLRGFGISAGLYHTGKNFTAANNTYALPAYTILDGSIFYNFGKGEIRLNVNNITDKVYFRDAIYGNQFFPGLTRNYLLTLRYRL

SEQ ID NO: 2892 - protein, 856 aa, Oceanicaulis alexandrii HTCC2633
MAGFARTSGLVSKHFNLLPATSTEPTMTLRDTRPSSPCARPLCQAIRAALLCSSIGLGTVAPQVLAAASAVDAPRHSYSVAPGNLGDALNQFARQAGITLSTTPALTQGRQSPGLQGDYSIPQGLNQLLRGSGLEAVSQDGGSYVLRPLPQGSALTLPATEVKGFALGNALGSMEGYNATHSQIATKTSTALLETSQSVSVVTREQIDDQGAQTVAQTMRYTPGVLTNPYGATHRYDYVAMRGFNDGSVDNIYLDGLKSMGDSGTYSSMQVDPYFLERVDILKGPSSVLYGRSSPGGLVALTSKKPLYEPYHQIQATVGTQGKQGLGFDFSGPLDDDKHIAYRLIGLTDKSDTQFDHAKEKRFALSPTLSIDFSEDTSLTLQAYLQNDPDGGYHGGMPANGTLNQRNGQRISEHFFEGEPGVDGYKRDQQSFGYQFEHRFNDTFTARQNFRYLDSKVKLDQVYAYGWTNATSNDLNRYYSGGGEKLHSFIVDNMLQAEFLTGDVKHTLLLGADYQRRKTVVDWDQGTLQPINAFNPVYGNSTINYYSHTSYLRRLEQTGVYLQDLIELDKWRFSLGLRQDWVETSDENRLAEAQRPLGTEISDKRTKLTGRAGALYLFDNGLAPYVSYSESFNPNSYADSAGNPLPPTDGTQWEVGLKYQPPGTDNLFTASLFRIDQENLASKLPQENFYRAVGAVRSQGLELEAHMQLTDNLKLLGSYTFTDIQYSKSMTSTLSSATNLIENKGNSPTQAPRQMASLWADYKFDSATLDGLRLGGGVRYVGYSWADAENTMKVPAYTLFDASIGYDLGKLGLKGVDVRLNANNLTNESYVASCASLSYCYLGEERNVAATVSYQF

SEQ ID NO: 2893 - protein, 724 aa, Oceanicaulis alexandrii HTCC2633
MIIVPGTIAPSGALDVYTRRTFDPAFVQPYNHLNSVLLSGTSIASAPNPGTPFLRIRPMPATGTLGAMRVNLVNVEIGENRSIELTKASGLSQIQDVFIVSTQPRTYQTFSISNPNNVSIGSYNLNGQTFLRPTQLTLRQSSITNAGLLGVEKGSTLKLDSTTIETGIVGLYGTLAGNGTVRGPAGVGSNVNFRTGTGAVFSPGLSIGTLNIGGNLSLQGATSLISEIDPNAAQNADLLSVSGTVTGADKLTVTLEKDNGYTATGAGEVADFTGSTYTVLTAASIDSNSIALVEGGSLNAHLSARLIGQPSNTGQIVVGFTDNSAVPGHVPSKLPASTPWSTLVSAIAATHNNTVVNGSSGGGTAPGATGTSNGGQQQLSNGQTVSTAWLGLTNAQVSQLDQVHAEPYSSNLTVGLEQLEHVASSVMARMTSQDHDHDNGKGHALWMDASYSRGHVQGRDSLGSFGYSLSNLLVGTDLIERERFSAGVFGGYGYTSMHEHDKVTQDFSGQSAIAGAYATAQIERFTFATVVGYAHGWHKSTRINRDVGLFSGGVASSSYTSDNMLASAHLGYQTLIGEGMQLEPFVAAAYSRIWQNSLTETGGGDFNYSIAAANAEALTGGLGVKFTQDLPNTAQERKLRLTGVLRYDHDFEAARTKAHQITATSHLFGTFTQTGQNRGAHTVTGSLGLSGALSRTVSVRAGVTGSLSQHGHEFGARGHLRVAF

SEQ ID NO: 2894 - protein, 190 aa, Oceanicaulis alexandrii HTCC2633
MRKFNLAVVIPLSIMSCSAVASYSDSSLELGVSAGQFNLKDSTGSYSGPSVGFNFIRNFNDWFSFEGNYLSSFNMDNANYDIQASTFSLAPVFTYHINDTFSIYGKGGASSMRITSSERNGLDFSYNTIGWFYGFGLNTSINNRINVRLGYETVTGDTGIEILGVTADGFSIQSSHTKISVISLGATYRF

SEQ ID NO: 2895 - protein, 1015 aa, Oceanicaulis alexandrii HTCC2633
MKQSNLLNAQFARRLFRTAFSSWQLLAVMLIVCMNVAVGSKLYAQSNTIAVKGKVMADGEPVIGATVLVKGVSTGTATDMDGNFSLNVASKAVLVVSSIGYETQEVPVNGRQFINVVLKSDVVALKDVVVVGYGVQKKVNLTGAVSSVSTDELEGKPISNVLEAMQGTTPGLVIQQGSSTPGSVPSINIRGLNTMNNNDPLVIIDGIEGSLANLNPADIEQISILKDASSTAIYGSRASNGVVLVTTKKGKAGKVEISYDFMYGVQQPTSLPKIADSWVYAELYNEAAVNSGRAAKFTPEQIAQYRNGGPNVNWVKELYNRNSPQSSHNVSMTGGNDQLSYMASLGYLDQSSMFKGPDYGYKRYNARLNVSHKVTNNFTLNLTSQFARNDIKEHAYWTEWIIEQANRMPPIYPIKNEDGSYNYPAGSNSNGLQRLEEGGYRQNVNDELLGTIQAEWEVYKGLKLIGSAGGRVWNNKLHENRKAFEGTGDTENKLTEQFYRSKNITTNLMVTYNTKIGKHSIGGLLGYAYEGFSEKQFSTSRLTEDSKYDIFVGDLSGDKVSNTGSGSDWAIYSGFARATYNYDEKYLLEFNIRNDYSSYFAKGNRSGVFPSFSAGWRISEEKFWSVLKPYVPSLKIRGSWGLVGNNRIGAYQYMQTVSVTNGISFGDKLAQTATFASTNPDLKWETTRMANIGFELGLLNNDLNITFDCFNNRTKDILVNLPVPGLFGNGAPIQNAGKVETRGWELSVSYRLKTGPVVHNFSGNISDSFNEVIDTRGTEIIGGSDVQTIIKEGYPLYSYYAYRSDGFFQNEEECQKGPHLEGITPKPGDIRYLDKNGDGVIKPDDDRFIVGNDFPRYTFGFTYGLEYKGFDFSMMWQGVGRRNKWMRGESVEAFHNNNEGPVMDFHQDRWTPNNPDATYPRLTMGAESANNAAKSDFWIQDAKYLRLKNAQIGYTFPQQWMKKLYVKNLRIFASVQNPLTFTNMKGGWDPEYTGDGSGRAYPVARVYSFGLNVKF

SEQ ID NO: 2896 - protein, 325 aa, Oceanicaulis alexandrii HTCC2633
MHMKKIIFAFIILFVFLLPMIIFYQPWVNALPSTPRHASPEQLEKTVRYLTQTVHPRSADNIDNLNRSAEYIKEVFVSSGARVTSQDVPITGGPYKNIVADYGPADGPLIIIGAHYDSASSYENDQLTYTPGADDNASGVAGLLELARLLHQQVPKTGVQLVAYASEEPPFFRSDEMGSAVHAASLERPVKLMIALEMIGYYDSAPGSQNYPYPAMSWLYPDRGDFIAVVGRIQDINAVRQVKAALLSSQDLSVYSMNTPGFIPGIDFSDHLNYWQHDIPAIMITDTAFYRNKQYHLPGDTADRLNYQKMAQVVDGVITLLYNSK

SEQ ID NO: 2897 - protein, 485 aa, Oceanicaulis alexandrii HTCC2633
MAASDPPTAEVRMRRAIPRPWPTVLSLGLLVGGEACLADDSLGHRDNISTGLNQRQKAEMKVPPGFVEGSTLNGFLRNYYFARDNHDTPSRRDQREWAQGLMLSFRSGYTDTPIGVGLDAHAFYGLRLDGGGGSGGAGVLPLDSAGRPADSFSAAGAALKLRGLDSLLKIGDQLLENPVIASGVSRMVPQSYRGVTLKNYHFRALELDAGFVEATRLRNQSGHSHLTSGYGNGTKGGIAADRESPHIAWLGASYSAPGGSQATLYSGRLADIWNQHYLGLSQPWRLSSQLTLTPWLHYYKTRDQGRSQLGRIDNDLYNAGLTLAGGGQSLSLSLQKVDGDTPFDFIAQNDRTFLYESNAMQYADFNGPGERSWKIQYQASLAFLAAPDWQFGAAYGRGQADLTRVDPDSAGYGYLYNPNGKNAQHWERDLSLRYAFPAGPAKGLSVTLRWATHRPGEGYTAPGNTRGNSSSDEYRVVVDYPIRLL

SEQ ID NO: 2898 - protein, 720 aa, Oceanicaulis alexandrii HTCC2633
MMSSYCKILLATASLAAVTVAAPAMAQETVGQGAVQNDDGLTDIVVTATKRGAAQNVQNVPIAITAFGVNELDSIHARSIASVSYAVPNASFESPGTTPGYANFTIRGLGINSSIPSIDPTVGVFVDGVYLGVSAGVLFDTFDLEGVEILRGPQGLLFGRNVTGGAVLLRTTTPSNRFRMDARASLATGLEKRASISVSGPLAGDVLSGKIAVYYNDDNGWFKNDFDGKKIGGSETLIVRPALRYQPNDGVDLVLRYEHGRMRGDGAVSSNHGLYPRDSFGVNQNYVGFIKADWDQGVSELNVDTGFGDGKITNIAAVRAIDNDAGTDIDASPATALHARNKIKQWQFSNELRYAGTFGDVDVTTGLFYFYQDLQYAEQRLLSGGALTVSGGGRQKQHTGGVFANLDWHVSDMLTLSAGARYSAEEKAVRVRSIGVAGCDLDALRCSFNFTDKHSWRGFTPRLGVQFKPNDDTMLYASFAQGFRSGGYNFRNLNPNVNPGPFNQERQNAYEVGLKQEFGRIARVNIAGFYNKIKGAQREFQAPFPPFGNFQIITNAADVSIRGIEGELLFKPARGLTVSGQFGYSKGKYDNIRFDLNADGAINKADYALKLPRLSPWSYGGSITYATAVGDGFDAEARVGANHRDASFFNDQNTGLLPAATMVDANLSITHGRAKVSFYGNNLLNEVTFAIESPLPFFPGSTFSPLNKGRTYGIELSYKI

SEQ ID NO: 2899 - protein, 705 aa, Oceanicaulis alexandrii HTCC2633
MNPKKILPCAISAITLLWPQLSNAQEAATLPAVKVEGQVQAEPSPSAPVDGYKASSTFSATKTGTPVVETQQSISVITRDRIEDQGALTLQDTLGYTAGVSAGSYGFDNRGDWAFIRGTSFVQYQDGLKQLFGFYNNVRPDPFTLERVEVVKGPSSVLYGQGGFGGLVNMVSKRPQKEQAGEVGVQLGEYGRKQLALDLTGPLNDEGTLLYRLIALTRDSDTQVNFVPDDRDLFAPSITWRPSADTSLTAYLNVQRDVSGSSVGFFPIIGTRFEGPNGRIPTDTFISEPGFDLYLAKQTSYGLEFDHRLNDVFTFSQKVKQSDSAVSYNSIYSAFTPRINADGRTINRVAISQYNVADSLTSDSQLTAKWNFGEFENTSIVGFDYQRVALGGARGAGGSAAAIDYLNPVYGNFTAPVLADIAGTLQTQTGIYAQHQVKYAKRWLSTVGIRRDWAKSETDNAPASSLDTSTNTYKASLGYITDFGAMPYYSYSESFLPIGGLDFFGNPFKPQQAEQQEMGVKYETPDGKSLFTAAVYEIKENNRRVADPAVANNQIQVGEAESKGVELEANHRLSPTVDILAAYAYTSAKVTRHSTPNSQGKRLATVPKQTLSLWGRQKFSMLGLPGWQWGAGLRFIDESWDGVDNVRTPSVTLLDAMLSYETGDWRYAVNATNLANREYVSTCLSRGDCFYGVERNVVFSANYRF

SEQ ID NO: 2900 - protein, 1057 aa, Oceanicaulis alexandrii HTCC2633
MTKSHLLLGAAAFAVAISVSQPVLAQESEDSVEAADETENPERAIVVTGSRIARPNLESSVPLTAVPVGDLTDRGDIQLGDALNELPSLRATFSQANSTRFIGTAGINLLDLRGLGTERTLVLVNGRRHVTSSPGSYDVDTNTIPVDLLERVDVITGGNSAIYGSDAVAGVVNFITKRDFDGIKLRGQGGVSTYGDRGSYFVSGIAGKNFMDGRANVAVAVEYARANPVFFADRSYLGAETGVGPAGFEVVEPAFRLVNGVPTPVPNRNNNGVPNTRFLPAGFTFNTVSLGGMVLTSCPAATGTNAARVAAVCTGELSPTSGGRFSYNYAFQPDGTLLRNGPENGLVDNRGAGGSALFGLGASGLEDAMLLPGIERIAVNLLSHVEISPAFEPFIEAKYVRINATQQSTQPTFIASALNPIFSINNPFLTDQARQTLQTILAPGATTFQMQRFNNDLGTRAEDHRRETYRIVAGVRGDLGTSSNLTYEVAFNYGRTETYYETGGNVDVAKFNRATNAVRNSAGQIVCAVNADANPANDDPACAPLNPFGFGAPSQAAKDYVLYTSSREQWAEQINAVAFLSGSTEGFFSLPGGPVGFAIGGEYRREDAYSAFDPFTRSGATFLNAIAVFEPPSVEIKEVFGELRIPMLRDVPLAHELTLEGAARYSDYGGSVGGVWAYNFGGIYAPIPDIRFRAGYARSVRAPNLGNLFATRSETFANGLIDPCSQTVINDNPNRVRNCAAAGIPTTMVVDGNTIPWVNTPASGVSGFNQGNPNLIPEVGKSLTIGGVFQPRFVPGLAITVDYYRIKVTNVIQGLTGQAIINRCYDDPVGLDNPFCAAVFRRRDPNPLIDFTFDGQANRVPAPGQPTLNFPVLGPAFLNQPFNFAARKAEGVDFDVSYRRTFDNGVMLNLRGVATYNLNREDFSFITDPSRSTRIHGTLGDPIWAANFNANVDFGTIDVGYSARYVGKQAVDAWEVQHSHQGRPPTNPDAFPFRKYPDRLYHAFRVGFEPDDKYRFYFGVDNVFDTRPPFDLTGTGAGSGIFPVQGRFFYAGIQASL

SEQ ID NO: 2901 - protein, 1531 aa, Oceanicaulis alexandrii HTCC2633
MPKRSDRQQAKRQCVGLSVWKPYRRRGRKRRNLESSIFNRFRKRSRKTRITRRFDARRAVRNLAATHRRISCMSSPGGATSCHLQGPLNRSLTDRKTTMNHMFRIIWSKALGTWVVASELTTRRSKSGADSGRCQALVVSVGIGALAIGCWSSPATAQVWHGTTSSDWTVGSNWSTGAAPSGTATVTINTNSPNPTVLGVSGAVNSTIGNLQMGTATGTSALTIQNGSTLSSSVTTGTNQIGQSSGATNATITVTGTGSSWSMASSTIFGAALGSTGTLNVANGATASLASNLAVGQTSGGRGVLNVTNGSTLTTGGATIAASNSNSTGSISGAGSQWNVGGALTVGLGRGNGAGVGTLNIANGAAVTATGNITIGGLTLSTSGAGAITVDGAGSRLSTGGALNIGLYSTGSTLTVSDGAVVTANTVTVTALPAAKGTLNLSSSGTLATQALTGGPGTAQVNFDGATLRATASNTAFISGFTATGLNIAAGGLTLDTGAFNVTAASPFSGTGALTKVGTGTATFTGDNTYTGGTTISAGTLQLGNGGTSGSIVGDVTNNGTLAFNRSDTATFGGAVSGSGALAQIGTGTTVLTGNNTYAGGTTISAGTLQLGNGGASGSITGNVTNNGTLAFNRSDTVSFGGTISGSGALAQLGTGTTVLGGNNTYLGGTTVNGGTLQVAGDANLGDASGSLSFGGGTLRNTADFASARAITLNAGGGTFQTTGNLTLTGPIGGSGALTKTDGGTLLLTANDTYTGGTTISAGTLQLGNGGTSGAIVGDVTNNGTLAFDRSDTATFGGAVSGSGALTQIGTGTTVLTGNNSYTGGTTISAGTLQLGNGGTSGSIVGDVTNNGTLAFNRSDTVSFGGTISGSGALAQLGTGTTVLGGNNTYTGGTTISAGTLQLGNGGTSGGIVGNVLNNGKLAFARADTVTYGGTISGSGAVTQSGTGTTILTGNNSYAGGTTVAAGALAIGDALHPLATSGSGDISVASGASLGGYGHIAGSVQNGGTLAPANALTALSAGPTGTLQIGGSLANSGTLQLAAANGRPGNVLDVGGNYAGGGRLVLNTVLNEGGAASQTDRLVVHGQASGQTAIAVRASGVGAKTVGDGILVVEVGPQASASSVQQATAAADRVVQRQVYQGVQSTSGSFQLAGPVQGGAYQYLLYQGGAQSAQDWYLRSTIVDAGIPGSGTPGSGAPGSVAPVQGAEPVPLYRPAVAGYALMPALNVDYGFSVLGRLHERVGDVAALEGAQGTHRDAVWGRVGGNGLDASAGRFSADSRTYFAQFGKDWTLRSNAASGSTHAGVTATIGSMSASFDDRLRSIVGLSTQTGTAEMHAQSLGAYLTRYFAGSGYVDAVAQVTHYRTEYGDAYRGKGVQNGYGAGMSVEAGQPFAVAGLFAIEPQMQLMYQYTHLNHFDDAVSSVSGNTTHALRGRAGIRLFKANMADASATSAATPYLTADVLHDFTPMGTTVIAGSAVPGEFARTWYELGAGVSAQLGKSMQLTTQVKYAHHIGGDARRNLAVQAGLRYGW

SEQ ID NO: 2902 - protein, 4391 aa, Oceanicaulis alexandrii HTCC2633
MLRLCMNAIFKVIWNISLNVWVAVGEFAKGKQKSKTTCAIPPSQHTSAVINKFSFPRLGFLAIAIIGVLGGQNAYAIDAQGCTDLGSSCVTVSTDAELRSALTSGTATTILMLNDITLASNISVNQGTSNRKDLVIDGGGFKLNTGGAQFIFTNQTNVSWGGAAGSFTLSNLAELNSATGNDNTVFSMDGGNSAINIIVNNIGTMTNSMLAVLGGMGSGGAPNLNSQLVLGNFTDPLSLTFGTNHQLAQASNIKFTGHFDLTATTGAYPAVFWTNAADANSRMYFSSTANVSITTPLFASGPGAYGNYQYTLEDGAQFALNSDQNVFGSVNGGLLIGTYSAGVFGSGAVLQLANTAGTAYSTGNAITNGGNINAMGNGVTQSGDVIYNLAAGSKLAVSGANSIGILATKTGPTNSGGIYISSGAAINAAGIGISASHGGSAPIVLENKNSGVITATTGISATNTGSGSTDVTNHGVITAATGMSVTNTGTGTANVINDGTINSTSAGIAIASGVGTSTVDNTRGSINASAGTAINIANGTLLNLLGGNITTTNAATGLNFIGSSGSHTLTDLIFNLNGTGSAFAKAAGVNLELRHVIFNTANGTVLNDLSGLTFASSTEGRNTINVSGTGTGIAATNTALSALDAEALDINVSGAGVGINATGGGALDFTDSNLTITVTGTEGTALQIADGSGETTIGADTQIDATAATAINFLGSSSKTLNNKGTIKGSVIFAGVADHIINNNGTLDGTLTTGAGNDTLVLDSSSQSNDVINLGDGNNSVTIQNGATVSSIITGNGNDTFTINGMSVGSRTYLGSLDAGTGLNTLNFNASTDELAAATSLQGFTNINLVDSHITLVSDDNIGSGMVNIDSSSELLFGSTFDGILHATLGTGTGSAIVNNSANVSLEQASMFAGTWQVNQGGALTASNSNQLGSAKIGVDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDIDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLNIASGASANINGYRQTVGAVTNTGTVTLGSGGVLTSGLLTNGGGLDLTGGTLNLTAGGASTVAGGLTGAGTLNINGGNLSVSATNSGLSGQTHIADVASVTLTDTGTLGTSTVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVSNAVTIDIADATLNLDDIALFNHALTGNGLLNVAKNDASTAFDFGSTVGGAFSGIVNLTNTTFALSADNAAALARATLKLSDDSVTTVGTTDRTLHGLDLNGGTLIFDGSPPQSQANGVVTVTDLALNSGTVSITGVGNWENESPVTSPNVSILEQDRAGTTLELINATNVTGDVDALGLMINGTAITADSQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLNIASGASANINGYRQTVGAVTNTGTVTLGSGGVLTSGLLTNGGGLDLTGGTLNLTAGGASTVAGGLTGAGTLNINGGNLSVSATNSGLSGQTHIADVASVTLTDTGTLGTSTVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVSNAVTIDIADATLNLDDIALFNHALTGNGLLNVAKNDASTAFDFGSTVGGAFSGIVNLTNTTFALSADNAAALARATLKLSDDSVTTVGTTDRTLHGLDLNGGTLIFDGSPPQSQANGVVTVTDLALNSGTVSITGVGNWENESPVTSPNVSILEQDRAGTTLELINATNVTGDVDALGLMINGTAITADSQGVQSAIQQGGSTVANAIHNYGLASSNSNGDSGLYVNYTLSALELLADGADALLLATESGLTANRVLNAELFGVGGLVVDAQNGALTLANGNNRYEGTTTVTAGELILGANGAFGQTSLLDIASGASANINGYRQTVGAVTNTGTVTLGSGGVLTSGLLTNGGGLDLTGGTLNLTAGGSSTVAGGLTGAGTLNINGGNLAVSAANSGLSGQTHIADVASVTLTGTGTLGTSAVEVLGTLNLNGANAAMTNVLSGGGVINTNAAVTLSGNNSFSGAHQIGTDGALTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNAVTIDIADATLNLNDIALFDHVLTGNGTLNVAKNLASTAFDFGSTVGGAFSGIVNLTNTTFALSADNAAALARATLKLSDDSVTTVGTTDRTLHGLDLNGGTLIFDGSPPQSQANGVVTVTDLALNSGTVSITGAGNWENESPVTPPNVSLLEQDRGDILLQLIDAANVTGNANDLDLVVDGTAITSGTQGVQSAIQQGGSTVANAIHNYGLASSNSNGDSGLYVNYTLSALELLADGANALLLATESGLTANRVLNAELFGVGGLVVDAQNGALTLANGNNRYEGTTTVNLGELILGADGAFGQTSLLDIANGASANINGYRQTVGAVTNSGAVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSNFLGQYALAGNSKLTVASTNNLGASSSVALAGTGDTLSLSGFNGTFGNSVTGSGVLQVTDDAEVTLTSSNGVSNAVTIDIADATLNLDDIALFNHALTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTATLANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGSGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALRVSFASNMANLTSNVLITANGSLGGYGQVTGNVENHGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGDWYLRTQADDRRPEPASYTANLAAANNMFVTSLSDRMGETLYTDVFTGEQKTTSLWLRNEGSHNRSRDDSGELHTQDNRYVMQLGGDVAQWSRNAQDLWRVGVMAGYANSSSSTVAKVAGYRSTGSVDGYSVGIYGSWLADNADDTGAYVDSWVQYSWFDNNVSGQDLAAEKYDSKGFTASVEGGYAFKVGESVNQSYFIQPKAQMVWMGVKADDHTETNGTVISGDGNGNIQTRLGAKAFINPSDKAKASGPAFKPFVEANWIHNTKDFGTTLDGVTVKQAGTANIAELKLGVDGQINNQLNLWGNIGQQVGNKGYSETSVVLGVKYNF

SEQ ID NO: 2903 - protein, 898 aa, Oceanicaulis alexandrii HTCC2633
MKQALATISKKYHVKIAYDSRLVKGIKVNQRINKKNLQETLTQLLQQHPIRFSIVRGNKVVLFKKVTDPDNHPKKPPETINITGKIKDATTGELLPFANIRVLDTRRGTVTNVDGIFALANMPITPATIEVSYIGYETKNYALKAGQTKYIIKLTPIISQLKEVVVEYQAKMVQPSGDVGQISINPAKFSSLPNLGENDIFRTLQWLPGINATNETTAGLSVRGSTPDQNLIYFDGFSVYHTDHFLGIFSAFNANAIKDIQVYKGGFPAKFGGRVSSVIDITGKAGDQYKTKVGVGMNMVSSNLFVEVPLKHNASLLIAGRRSYRDIFASPVSDSLANYASSQPRIRFLFDPKEDREQAPSTKVNFYDLNVKYTIRPTKKDILALSVYNGKDDVYISSEFEGRAKLPPPQKKPKPGGGGGPGNPPSGEDKAPKKREVDVEMLVNDQLEWGNTGVGFRWGRLWSQKFYSNVKLGYSRYYGIYAGESIQKQDEGDGVILKEEDSSKQNNDLDDITFRWDNDWTIDHSHTLSFGLMSTYNNIKYKQLVDNEYLFESRSTTGTQYTLYVQDAFRPAKRLQVNAGLRFTYYNLNQTPYVAPRLSFQYDATKKLKFKGAAGKYYQFISQIITSDLRESGFDFWTLPDGENIPILESNHLIAGFTLQTNLFTIDVEGYYKTLNGLVFYDFDARQVRRGEIIDNDERYNPGNGVSQGVDILLQKKKGKYTGWLSYSFNDLTYQFRAIDKNQPFTPSASTPHEFKSVNMLSLGRFDFSATFVYGTGRGYRLPKGFARRIQDGELLLEDKNVRQTDLHALARGKTLRLPDYSRLDIAATFNFRFGRRGKGQISASVFNLYGQKNIRSVTFEELEIDPKGKGGKKVSELVRFDVTQLGFTPNLALNIIF

SEQ ID NO: 2904 - protein, 697 aa, Oceanicaulis alexandrii HTCC2633
MSLKFSTLSLAVVAALQSPLALADDASHGDMERIEVRGRSFNEYKVGAANGAMRGDMSLLETPQSVNVIPDFVTDEQLATNLAEVLVNDSSITAGTQRWNRQVFSLRGFELDSGSGYLANGHQLFAHYVLPIEILSQVEVLKGPSSMLYGQSGPGGLVNMVTKKPTFDRLFELGFDTDEEGSTRFQLDAGGALTDSLRYRAVAVKQDTEYWRSYSPLAGESAEQQERDRWLGFIALDYDISDNVLLSVRYDRTEDKAGIDVGGWLDKDGHLIGSREQIWDMPWAFTDNSITNLGADLAWQLSDNWKLKVGYNDQQFNRQRFDSAPRYNTDAMSTGYQISPFDRFDDWSHKTAYVDLNGEFELAGMEHKLLIGANKLDYGYAQLRTSGARQNVMPGVALPRPDISYKDDTSWSTSGYEFYGVYLQDLISINDRWKVLAGVRFDEQKEDSGNDNAVSPKFGLIWQPQQDLSLYANYSRSFVPQGKINDENDLSNDMELDPEFGTQYELGAKWELMNGGLLLTGALFDIEIDNRIVVHTLDVPVGDITKVTRQDGIQHHKGMELGAQGQVSDSLFLTASMMYLDAEYKTADSLNGKTPIDAPEWSANIWSRYEVTDNFAVNLGAVYVGERFADTPNSISKDGYVRFDMGAAYTFDIGGSEIGIRANVRNLFDTEYLDGGNYQMVTLGQGRHFSLALNAKF

SEQ ID NO: 2905 - protein, 729 aa, Oceanicaulis alexandrii HTCC2633
MVRTGTARRARAIAAGSALVAAATGGAHAQASGAAATPPAGAAAAVLPTIDVTGKADGASSGLVGLRTTAGTKTDTPVAEIPQTINLVTAQQIEMTGAADLNQALRYVPGFATFGADSRTDWYAALRGFTPTLYVDGVAAPNTAVIANWRVDPYTIDSIAVLRGPTSVLYGAGEPGAIVDAHTKLADGERVREAGVQIGNDARKQFMVDVGDTLDPDGRYAYRFVGVARDGNAVTGPNGDRRVALAPSFRWRPNADTSLTLSATFLQDSGDISSNFLPASGTVLPNPNGRLSQDIYMGAPGFNDYRKKQWSLGYALEHRVNAIWSLHQDVRWSHLSLDDATVFGIGLVPRSTTNMMRFAGLFQLNYSRLDIDNHAQARFGTGPLEHTLLLGVQYDRQTTTNSVWLALAPSLNLYHPVYRPVTDAIFSGPTSLGHVDQYTAMNAFGVYAQDQIRWKRWTLTLGGREDFVNARFDDRTAGTQAQQDVSAFSGRVGLTYQGDAGLSPYLSYSTSFDPVIGVRMFGGGLPKPTRGKQTEAGLRWQPPGKNLMLSAAVYQIDQTNVVTPTPVNLDPTGTTSVQTGKVRSRGIELSAVGKVTRELSVVASYVYQDVKNVQANDASLNNWPVSVPLPRQMASMWADWTWRTGALSGLGIGGGVRYQSASAGAPDNSLTVPSVTLVDLALHYEMPHWRFALNVANLFDRSYVSGCQSYAVCVFGNERTVLATAKYNW

SEQ ID NO: 2906 - protein, 146 aa, Oceanicaulis alexandrii HTCC2633
TDHGINKYEIAVNFNTPIQYGNPDGWLFRLQAEANMGYWDARSGTNRQNLMEFGLTPILRVEKRGGYFVPFLEAGVGLRLLTHTSTSDQHNFSTAFQFGDMVGLGVGFGKNAATEVGMRFQHISNAGIKEPNPGTNLYTGYVRYRF

SEQ ID NO: 2907 - protein, 767 aa, Oceanicaulis alexandrii HTCC2633
MAGFKDNTGRRKTPSRAAFLMTTTCAAALCLPGAALAQDAPSAPRQIETITVTAQKREESLQDVALSVQVLDNTFLDQQQVTDFEEYAQLLPSVSFNSVGPGSAQIYIRGISDGGDGNASGSQPSVGLYLDDQPVTAIGRNLDVHIYDVSRIEVLGGPQGTLYGANSQAGTLRIITNAPDASGFEAGYDLTTETVNEGGVGYTAEGFVNLPLGDRAALRLVGWHDQSAGYIDNVAATKTFSRSGITVDNAPYVEEDFNEETTSGARAALQIDLDDNWTLTARALHQTQETEGVWDHDPEDVGDLEVERFFNDRSEDTFTQLGATVEGRIAGMDVTYSGSFLDREVEYDNDYSEYAEYSSYIDYYTCYYAYDSAAGAYDFYACEDPRIQYQDRSQYTRDSHEFRLATPQENRLRLIAGVFYQRAEHDFDFDWNIPTIKPGMAVDGEQAYFTTNQVREDTEAALFGELSYDLTDTLTATVGARVFDTDSSIEGFVGTVFSGSPDVDVEQSESGSLYKVNLTWQPSSDRLFYATVSEGFRPGGVNRASTSNIPGTYDSDLITNYEFGWKTTLADGVLRFNGAAFLMEWEDVQFTRFDPSESPLGLTQNAGAAQVLGLEADISWLATDNLTLTGAMTVLQAELSEDFSQNINATTPDAPDGTELPYIPSVKGYLNARYEFAWRDFDAFWNVRGSYVGKSYNDLFIANRSEQEAYALLGASAGLGRDNWTVTAYVRNLTDERAELYRNATDFDSRITTNQPRTFGVSLSQRF

SEQ ID NO: 2908 - protein, 1507 aa, Vibrio splendidus 12B01
MAITTSTFTASGNRQPADRLRSPSLNRFLLAASATAIISALPGVIVPGAAAQNLPAQCVSDGPIGTIAAPGDNVTCLSDAVIDALFIDVDNVAVTAGNAELPAIFFSTETTVQLDSSGPLGQSFDLVNAGSQILGEDIAVVLSNSGEGGIDFVSEGEISGDTAGLVIGQNGAGAINASVADVRALAEDNDISAVVITASEGGGAVNFVSTGTISTNGIDAESAAIEIDTNVDATSDISLIVEDVVADNSNAEAISAQLLGVGDFTAIVNGEVTSVGDAFDVDHEGTGSIIITTNGAVTSTSGDGFDIDHNGVGDVVVTTNDIVRTLLEGGNEGIEVDHDGTGNIVVITNALVDAAQDGIETSHDGTGDIVLTANADVIAADNDGVEGSHNGDGSVLITTTGLVSAADNAIEANINSISSSGDIVIAAQGDLVGDSDGSNIGSGIEAEHAGLGDISIAADGAISGDIGIDATHEGQGDTTITATGPITASDVGILAQSFESGSLSISAESILAVNVGILADQSGEGDLSVQTLGRVASEGIALDVNHFGTGDTFIDAQGELSGTIGVLAAANGSLTISTADIDAEQTAISANLFGQGDLSITTSGDITSAESRGIDAEVFDDGNVRIVTDGLVSGLGDAIFVKNNGAGDTTIITNGDVIGGDEGIQAFGNDNGDILIIANGNVTGGTEIGQHGINADHDEIGNISVEAHGIVTAGDRGIEAEHSGVGDISVTTTGSVRGDFVGVFANHEGEGQVTLDISGDIEGGVEAIFVENVNRQVVVVDPEAEAPAPANTDVSITMSGSAIGDAGEGIFARQGTDGDLSIVATGDVIGAAEGNTDNVDAITAINDGTGSTFVDVAGLVDGRTSWGIDVTTVAGSEVFVRNGAVVTGPAGSVIDRSVDASMALTLEAGGTLDGRVFFLGGDDVFNDQGGSFTTAFGGDGNDTVNFSGAARTLVNSGGVDDSLQQFEVFTFNGEGITLEGVHQGLTQVSFNAGANVLDGTLEAALVEVAAGTSFTARDGSLIVGDFVNDGLLNVGNSPGTLTVDGDVTFGSNSVFVVEIDNTGFDQIISAGDVVLDGQLQTDISGSLNFGANDVRIIDANGVISGSFVDVDFENGLLISNDLILDEANADLILRTFLAAASDIDGLAENAANAGDALITTLTLDEVNDDLLTLITAIGAIDDAAVLNDALTQLTPEALDISARTVLAAQDSLLAAVRQNNRDAVSGEHNLWGAAERFSLDKDEDPEFQGFSGDADRLAFGVSGYQAGPVRLGAAVGYTSFDGEQDSSLADHVDGELFQLAASMEAPVTMLGTSGNLNVLVGVATGEQNLTMVTAEPISDRLTQQAASSDVSSVDAQAALSVALYKQGNLSIDPFVGVGVSSMEIDGFEIGEGQATALSVEDASFTRGEIAIGTTVSYAVADTLNAHARLAGVHYFGDTQHTFVSRFSEPTAFDGPFETNGEEVSSQFEFEGGLTTEIRPGGRLSVNSSAQLGTVSSVGLGLSFTQRF

SEQ ID NO: 2909 - protein, 537 aa, Vibrio splendidus 12B01
MPYPPRRFSPKQRLGARFRPLLLASAIGCVLAEIPSVQAQQETTAEQQRNWNIPAQSLSAALVSWSQISGVQLFADTGLTRNLVSTAVSGRYDAAEALTLLLSGTGLSAHFLAPDRVTLVKSVEQQGAMALDAMRIEDNSLGTITEQTKSYTPGTIASATRLVLTPRETPQTVTVVTRQHMDDFNLTDIDKVIEHTPGVTLQRLSNFRSLYYARGYQISNFQYDGIPTFDDNVNSMGQTSSDMIQYDRVEVIKGASGLTTGAGSPGATLNMVRKKPTHEFSGHATAEMGRWDNYRTEWDIGGPLNTSGSVRGRVAAAFQDKQSFQDHAKEQTRAAYGILEVDLSPQTLWTLGGNYDKRTPNGDMWGGIRLMDSHNNETNVPRSYNPGASWSYNEEFSHAFFTQLDHEFDNGWNSRLYFTFQRNAYIGKLGSLSDTPDADDGSTTLQTGYYRYKTRTHALEGYARGPFELFGRTHELAVGVSGYRNHLKGKGHRYLILPVDNFWEWDGDIQRPDWGGSTQEERRTLTSVPIMLALASP

SEQ ID NO: 2910 - protein, 372 aa, Vibrio splendidus 12B01
MNIRKVLLGSAASLVAISGAQAADAIVAPEPEAVEYVRVCDAYGAGYFYIPGTETCLRIHGYVRYDASGGDNNYARTPAQLERDTWNKLARVSLRFSTASETELGTLKTYSELRYDWNGDGNGKANNYNGGSTSTSLRYAYIQLGGLRIGLDESAFVTFTGYLGNVISDDVILAGGYRTNLISYTFKGGNGFSAIVSFEEGGNTDSNVDVTIKDYMPHVVGGLKYEQSWGKIAGVVAYDARNEEWAGKVRGDVNITDQFSVWLQGAYKSNDDHYGTSGGYRVRIIDSFYGTWGGDWAVWGGAAYKATSKATFNVQAAYDDSETFAATANVAYQIVPGFTITPEVSYTKWQDKNTSMDGKDAWQGKIRFQRSF

SEQ ID NO: 2911 - protein, 330 aa, Vibrio splendidus 12B01
MKKAVLASAVVAALVSGSSLAATVYSSDGTELKIGGRAEFRGDFIGSGGAEVEGTMEDKTRFRLNLGGKTELTDTVTAFGFYEAEQSTGDSEFDNRYMYAGVDFDGQAVSVGRQDMASVIVSDFTDITEFSGVQQVIDAASDKEDSVFAYRGGFDALQLEATYQANSEKDSDGYGISGVYSLPIGLDLGLAYSGQDLGAGNGSANQILAGLAYSLDNLYLAATYSTGDLNDKAVGPIAESFTAMEFAAQYKITKQVSAAAVYTYQENEAANGSTADSVDGIELVGYYKLNSNFRTYLSYYINSLDEVKDATTGLTTEGEDTLRLGVRYDF

SEQ ID NO: 2912 - protein, 691 aa, Vibrio splendidus 12B01
MKLSPLFIALLASTTASVYANATDIEHIEVKGSYFNDYKVDNANGAMRTSASLLDTAQSVTVITDTIVNEQLATTLGEVLTNDASLTPGSKQRNREVFNLRGFELSSSTGYLRDGHQHWSHYQQPIEILQQVEVIKGPSSILYGQSGPGGLVNMVTKKPTSQTLFKASADVDQHGSTRFMLDAGGALTESEDLRARGILVKQDVDYWREYQNGENRERDRFLGALIVDYDISDNALVRVHYDRTDDEAGLDTGAWIDSNANVIGDDKTIRDMSWAFTDITVENLGVDLEVFLTENWQVKLGYNEQTFERQRFESAPRKPSNFIEGDSYASRPYDRFDDWQFKTAFVDFIGEFETFGIQHQFLIGANSLDYYYGQLKTNAESFDFSAGQNEPFRPAISYKTDDTVSSSAYDYYGIYMQDLISFSPEWQLSLGGRYDKQSKENSNNESFVPKVGVLYHPNASATIYASYSEGFEPQNETLVNTNDVNNGMKLDAITSEQKEIGIKWQLFDDRLMLSGALFDISKTGTLVSEDLVNPVDNITSITTQAGEQRHKGFELAAQGAATDRLFVMASTMYLDANYERDATLQGKRPTDAPKWSASLWTRYELNDVIALNAGAFYEGERFADNANTVTKDAYTRVDVGATYKINLNNTDVNLRLNIENLFDTNYLAGGGLNNVTIGEGASVRLAAQFSF

SEQ ID NO: 2913 - protein, 711 aa, Vibrio splendidus 12B01
MKISSRKFPLNAILAAMIVSGVSASAVAETESSNTATNTDEKMVVVASRTPKSISEIPGTVWYVGTEEIEEQYRAGKSLDEILAATVPSLDVNSGGRTHSGQNLRGRSIMVMIDGVSLQSVRSISRQLDSIDPFNIERIEVLSGATSVYGAGSSGGVINIVTKKAQSNDLQFESFVGGTSGFNSSEDGDYKLAQSVSGGNDKVRGRASVAYNKTQAYYDANGKMVTPDITQGSTQFNETVDLLGNMQISLTDTQDLNLLAQYYNSQQDSPYGLYFEKDNSGVYKFVDVRKGYEADRQQGTERYMLSAQYTNQSFLNHLLIAELSYRKEDHTFSPYTQDGGTSLKLSSSNQNTDIFALKTALSKSFDKLQLTYGVDGFIDRFSSDQALYNQTITENTGGLVNKIDSIQGRYPGIDTYALAGFVQAEYALTTDWTLQGGYRYQYMNTKVDDFKKNASTALVPGGETDYSANLFNLGTIYHLDQTSQVWANFSQGFDLANPAKYYGKDPSVNVNDTKLDGIRTNSYEVGYRSDWDKVSLQTAAYYSYSDGSVEYSADQSIKGISNPIRIYGAEAQLTYWATNNLQLGATGHYVVSEEKADSGWEAYKAMEASVPKASAWLGWYEDNYNVKLQSLSTFDYKDADDRKLEGYTVVDLMGSYKLPVGSLGFGIKNLFNADYQTTWSQRATYWYSGTPALYDYKGRGRTFTLNYQVKY

SEQ ID NO: 2914 - protein, 906 aa, Vibrio splendidus 12B01
MLKSRIAFTAALLSGVCVTPLTVASAQEAVDASQAEDVVVVRYQYVPDDKRVTSEVSSFLSADDFVLTGDSSVADALGRVSGITISDGRFPVVRGLNERYSNTLLNGSPLASPEPLLRAAPLDLFPTSVVSNVLVQKTFSPQFPGEFGGGLISIETSALPAEGFFEIGTSLSADTETNFNTGLLHDGGSNDRWGFGDNTREISDEFKPLFETSRVGADNRIWDDETLARFGRSLENSKLWVIQEGDIEPNWGVDASGGQRFEFDNFALGVLGSVGFDNDWQSKDGRRGDITAGSSVVSGETITQNTDYRFMETTNDISLNALGSIGVEFGEHEIQFLTLVLRSTEKETRSEFGNLLPTEEDDFRDDSTAFYERQVYTYQLSGDHMFESLGELEASWRAAFSDASRNAPNQRRARYEFETVNGVEQLVLRPDTRGNNISFSRVDEEVTDYGIDFTLPVEALGLSWEWKAGYASNTRERSAFSRDMAFSGSSSNLFRSARVDYIFADPNIGVPAEGGTWQIRERGASGAADAYAGELDVQGAYIATDVEITPFLRAALGVRWEDGELSTRTFNFDNAGQSTQVTTQEDYLLPAATLTWTFADNLQARFGYSETITRPQFRELGFALFTDTELDQRFVGNPYLVDTEITNYDARLEWYFGRDQFLTAGVFYKELENPIVEYLFNAAEEPVNSYLNAPEATLYGFEIEFEKTFDMADTFGDDGFWSDAEVFVNTNYTYSQSEISVNQTDTVIAAGVPAGGSTDVVVPNEVAAFSRILDGQRLNGQSDHIVNLQIGWEAKSTGTRTALLLNWNSDRVRTIQFNVSVDNPTTPNVESSAFFPEVIEEPPLTLDLVHNRTLSVPRAGDVDLRFAIRNILGEDYSAYQEAFGEERNFESYDLGTTFSISLKKSF

SEQ ID NO: 2915 - protein, 675 aa, Vibrio splendidus 12B01
MSERSLFIRKPLSIAVAVICTSLSPNLLTQEEVKDTDEQMVVTATRTEMALKQAPASMSVITAQDIEDSPGITLADIVADSTSVESDFDSTRAGRQMISIRGMDSDYTLIMVNGRRLSSASAIIRGNDFDLSTIPVESIERVEIIRGPMSALYGSDGMGGTINIITKAPVNEWSSTLSMDTSSPMDGNGGQEQSVGLTTSGALIEDELFARFSINQTSRDAWQPYSGIHSSGHDREDVTALEGRDTLSLLGTLTWHATDNQTIDLDIGYSDDQRDGLAEYATGANPIDSKVVRNSQAITHSGFWSWGDTQVRYSRENVTDSDAADLGNNYSSDVEELTQIVEASATTYLGDSHTVTFGMDYQLSELTNKENLVNGTSEAYQGALFIQDQWLMTEQLTATIGGRLDKHELYGEEFSPRVYLVHQTTNDLIIKGGVGKAFKAPSLTQNQADYTVNSCKGVCDLHGNEDLKPETSLNYEIAAIYSQPRWNVEGALFRNEINDLIDRDDTYCENGGVFEAGKGCADSSSSTGYVNGKRTYTNVSEAVVQGAELTGQFQFTDEWGISGNYTFLDTEDKSTGEELLERYKHSGLVKLSWNPTYDLNTFISARYRGERNIETDLTQDTYTTLNIGTVYNVNDSVRLRAGITNLTDEAVSQELENMGYVEEPRTYYVGMTADF

SEQ ID NO: 2916 - protein, 345 aa, Vibrio splendidus 12B01
MNKKFLAAAIAAATFGTQAVAVELYNNDGTTFSIGGHVSVNLNGSEQGDTEVGTNSPRINFTATQDLGNGFTADARGEWALNYLDGGDETFTTRLGYLGLTHDVYGRAVGGTQWAPYYDVAGVADMPIAFANDFIYDDHGNLGTGRADKMLSYRNAIELGEAGAINFGLGWQGAKEDGAEYDDRMQVALSYAIMGAKIGYTYNGGDYLDTNKYTGKASAESHLVSAAYGSYGQGLYVAAVFASNENMNTFKRNNDNVKLAESNAYEALIAYAFPSSLNLSLNYEMVEGKELKSFAEETYREEMAVQAEYNFTSKFVGYAGYQFDLNDANDRKTDDKWALGARYYL

SEQ ID NO: 2917 - protein, 897 aa, Vibrio splendidus 12B01
MSKPLTLARLLLFSTALVAPVAMAQTDTSSSSAGDAGLSTTPSIADEAAAQSGDVDVSIPGSDIVVTGRRTSNISQAAPQVVNVLSAADIKRTGEGDIAGSLQRVTGLSVVSGGYVYVRGLGDRYSLALLNGSPLPSPEPLKRVVPLDIFPTSVIASTLVQKSFSANFPGEFGGGVINLTTKAIPTESYLEIGVGSSANTETSGQLGYTYYGSKSDWTGFDDSSRDVPPLLKDAFGAGVPFANIDRSDQQAIAMQFLNSKTSVLQRTNSLPFNFSGSINGGTAFDVGSDARVGIIATAGYSNKWRTRDNLQQASLTVEEGAGKSYNQVVTDNQVTVNGLLGVGVEWGEQKLRWTNLYIRDTLKRASLAIGQNDGQIQGADYLTQQTAWYERQLIDTQFVGEFKFDDALSLDVRGGYANSQREAPYEREFVYVRSNRDLDIDPVGDRFINALNRQRGDASVTFSDLNEDLWSGGADLSYKIAPSFTVTAGYAYTDTKRTSSRYELHFDAVNLPVPVQQLRPDYLLSDATIQLYDLGLLDFSGPYPVYDAALRVHAGYGQVKAELFPGLSIDAGVRYENGRQSVTGVDVYSTGETPFNQVKNDYWLPAVTLTYDVGGGLQFRASGSKTIARPQFRELIAQPFIDTESNRFYRGNPFLQDSELWNADIRAEWYMGRDERLTASAFYKKIDNPIETFTTITDTYAVTTSFANAPEATLYGFEVEAQKYIPLDGMDSNFFQTRRVVLIGNYTYTQSELKVSDGDTTIPYTYTTGDLPAASDYFVDGAPLTGQSDHLVNVQIGLEDTDKLSQQTLLLTYASPRVTSRGPNLQPDIKEKPGLTLDFVARQGVTLPGGINSEFKFEARNITGRKYQEFQEAGGTKIFYNRYKIGTTIAASLTVAF

SEQ ID NO: 2918 - protein, 1001 aa, Vibrio splendidus 12B01
MNKISKLFSLRNIARFSALSLLVSAFSTTDLAAMGANETNVLPVVNVAQQSKSVSGVVADKSGEPIIGANVVVKGANVGSITDFDGAFKIENVPSAAILQISYIGFKTQEIPVGSKSSFNITLEEDSETLDEVVVVGYGSSVKKDLTTAVTSVKSKDFLAGAVNDAMQMIDGKVAGVSVNSAAAADPNSSSSIQVRGASSLKAGNSPLVVIDGMPGGDLRNIAQADIESITVLKDGSAAAIYGSRGANGVILVTTKQGKAGKTTITYDGYVEHDFVASRPDILDADEYLEKVTGAKDYGYRTNWYDEVLNKDNFGHNHNISLSGGSESTIFRVSANYRQKGGLDIASNRKEYGLRGSFKQTTLEGLLEVGGNFSYRVADEDYTDYGSFKQAVQLNPTYSVDEMDAFKGNSYSYNPVKNLTERDRGALQEYSIIDLNAKLNILDNLSTELKLGRQGHSKKEQDYKFKTFRECIDGGYNGWAKITQENWTDWTLEWLGNYNFKINEVHDFKIMAGYSYQEFNYEKLMANNRNFPSDAFMTNYLQGGDYEKVSGRLGMESQKTQEKTIAFLGRINYNWNDIFLFTGSLRHEGNSKFGVDHKWGTFPAASAAWRMSKLPVFENSGMVDDLKLRFSYGVTGRSGFDRYISLAKYSGYGEYYSDQFGWLQGYGPGNNPNYDLAWEKQISYNLGIDYTLFESRLSGSLDFFIRDGKDVIGDYKVPLPPYLHESIVANVGTTTSKGFEFQANWDAVRTEDFSYSTNVMLSYTTSKLKSFSNEKYQLGFIEGEGFPSPGNPGSAQRLQDDTPIGSFYGFRYAGVDDAGNILIWKGGEIGGDTKLGSDGDEKDKVYLDGTGVPKWELSWGNTFTYKNFDLSLFFRGRFGYKVMNQYEMYYGLQVVAGDNKLSSAYEENAHIKGPKVICDYFLQNGNYLRLDNITVGWTPKLNTKWISSLRVYGTLKNVFTLTKYSGVDPTTVTTTGLWPGIGGMDVYPTARNLTFGVQITY

SEQ ID NO: 2919 - protein, 683 aa, Vibrio splendidus 12B01
MKKHYHYSLLAAGVCAAIASFSATAEENSDKMIVTASGYSQQLRDAPASVTVITAEQLQNKPVRDLADAVKDVEGVSVVGSANKQDINIRGLSGEYTLILVDGRRQNSRESRPNGSGGFEAGFMPPVEAIERIEVIRGPMSSLYGSDAMGGVINIITKKVTNEWHGSVTTGAIIQENSESGDSMDGNFYLSGPLIKDKLGLQLYGGGDYRKEDKIPDGHDKKDNKSLTAKLTFTPMENQTFLFEAGRTTQERYAEPGKSLAEYSMFNGVKRDNTKSETHNNRNHMALTYKGDWDVIQTEVSVYQEQTKRKTKAETKDAKTGLYNYAYEARVPEITNTVVDGKVVAFLPDNILTAGTQYQHAKLKDTSATGAKTTENVSLTADQYALFLEDEFTATENLILTGGIRLDHHEFYGDHWNPRGYAIYHLTDEITIKGGVSQAFRAPTLREISPNYKTSTEKGKGIIYGNDNLKPEKSFNQEIGIAYDHESGFNASVMFFNTDFKNKLTSYYTGDKDPVTGLNLYTYDNVGEANIKGVEVAAGIPFAEDWNLSLNYTYTDSERKSNDEKLTSGESLKGYPLDKTPKHLANAKLDWQYSPDLNLYTRAHYEGEQVWAAQRNGSSVPRYRKGYTTMDVGATYQLLKNTKLNFAVLNIANEKGSKIDAENGGNWDVEDGRRYWANVNVTF

SEQ ID NO: 2920 - protein, 337 aa, Vibrio splendidus 12B01
MKTEGNTMKKVLFATTALIATASVAAADVRISGYGRFGLDYNDANDRAVNGVSKTTITSRLRLQFDMSAETDAGVAFDARFRAQAESRDNTPGGATFNGARFGVSYQGFRVNVGNIIGAVENMPGTYLETRTAGIGIDGASFYSHVGNVNNEFFNWDAYSSAGTGVNGIEAIYSTGGFTGHLSYSTRNGAVASDRIGVMLSYNFGDWTVAAAHQSSDAMWEDKTLVSVAWDGGQFGARVAYADNDGISKFGIYGNMDIGASSNILLFYTDEEAVSASDVLAGRGDNRDAVAGSNMNEGGSYGIHYSYDLGGGASFEAGYRRASNDNDTFQAGVYFSF

SEQ ID NO: 2921 - protein, 368 aa, Vibrio splendidus 12B01
MNKSILAVLVSGLLVSGAVQAAAQDNTWYAGGKAGWSKFFDVDQKQVVSDTLGALQNTSTSKDTLGLGAFAGYQLNPNLGFEFGYDWFGKYTSSGELSGVRVEGEAKSQMIQTTMKIGFPVNDALDLYGRIGGGYAWTNSELSAQTATDFIKDTGNKHGAVFVGALGAEYAIDRDWAARLEYQYTTPLGDTSLDRSGIEMDNGMLAFAMIYRFGQQGGEVAAPAPAPAAAPAPAVVVVPKTFSLSSDVLFEFNKATLKPAASQALDNLFSQIVAANPKDGVATVIGHTDRIGSDAYNQALSEQRARSVADYLIAKGLFADKVRVEGRGKSSPITGNNCSSGSKPALIACLAPDRRVEVRLEGVSQPVQ

SEQ ID NO: 2922 - protein, 666 aa, Vibrio splendidus 12B01
MKKLIIILFCLLFSIHGISQEKKKEEKKDTTKLEEVVIKSRRKLSSYRQEKTLSSIDDYLEKANNVIMIKRGNYAWEPTINNMASDRLVVTIDGMQIFGACTDKMDPITSYVDVSNLEKVIVGSGQEGTENGHCLGGGIDLQLPTSKFNESGLKTSADLGYETNGNFIATGLEIEYAGKEFFISADGIYRKSENYKAGNDLEVLYSQFQKCNISLQSGYKFSEVHIVDVNVIYDRATDVGYPALPMDVSLAEALITSLTHNYKPEDKSLKSLETKLYFNTITHIMDDTKRPVVPIRMDMPGWSDTFGFYSKADILKGKHHFIFNLNGFYNKSLAEMTMFSNNPNEPDMFMYTWPDIRTLYSGLFVKDNWHIGDGKSIASSLRLGYHTNRIAKDVGVESLQIFHPNIDDQQNRFLMSMASSYTIKKEYSNITFGLGYGERAPSVSEGYGFFLFNSFDNYDYIGNPNLKNEKAFEANFSFKQKFNDFEIGVQSSYFHIMDYIIGDIAPNVSSMTIGANGVRVYTALDNASIFDVYLNGSYKISDSFSINGTIGYNNGKGSHREHLPLIRPFSYFTEVSYNKPKFNVALQLDGNGNQSNYSSFYGENKTASYAVLNLNLGNAFYGEKGRAILKYGIENILDAKYSTYADWNNIPRQGRNFYINLSFVMH

SEQ ID NO: 2923 - protein, 240 aa, Vibrio splendidus 12B01
MNSTYKKMLAAGAVMALTGAAHAQSAGSNIVSMGWFRVMPNSSADPLTVDSIGGRPVGMTRPNTGAEIESADTLGLAFTHFFTDNISGEIVAGIPPKHDVKGTGNYAQYGKLGSVKQWSPALVVKYHFFDAKTRFRPYVGIGVNYTWFTDETITNQNFVNREFAPGARMTASAKPSWNPVFNIGANYAINDHWFVGLSVSYVPLSTRASFTTQAGPVTIQSHTKIKIDPVVTYLNVGYRF

SEQ ID NO: 2924 - protein, 398 aa, Vibrio splendidus 12B01
MNKTIVATALAALFLAPTVSAIEIYKDDKNAVEIGGFIDARVINTQGETEVVNGASRINFGFSRELSDGWNAFAKLEWGVNPVGNSDIVYSNRFESVQDEFFYNRLGYAGLSHDKYGTLTIGKQWGAWYDVVYGTNYGFVWDGNTAGVYTFNKDDGAVNGVGRGDKTVQYRNTFGDVSIAAQVQLKNSSFYTCDSVPDQDDCKKLWETGDRSAQQVDYDETYGFAVTYKATDKLTLTAGVNRGEFDVSFGNGESTTAVDLIYGAGIMWGGFDANGWYAAANINKQENHDTDNLGRLIKEAVGAETLLSYKFDNGLRYFVSYNILDAGKDYVIQPNLPIYANDVFKRQFVVAGVHYLMDANTVIYLEGRKDFSDFTGVDEAAMALSEDDGIAIGIRYTL

SEQ ID NO: 2925 - protein, 164 aa, Vibrio splendidus 12B01
MKKTLLALALLGASSTAMADSWLYGGVMGGQNSFAGEDENAVGIHVGTGILPLIGVEAGYWDLGSFDNVSYGNRDKQGVDVSTAYLAIKPSIDFGPLHVYAKGGLHSYEVKGDSFKQDDVDIMYAVGAEYFIFGPLSVGASYQNFKMKDDDAGVFSLNATIHLL

SEQ ID NO: 2926 - protein, 995 aa, Vibrio splendidus 12B01
MKNKLIKHFSIVSFILMILCVQNIMAQKRTVSGIVTDSKNEPLIGVNVTIKNASTTGTITDIDGKYSLEIPSGNSVLVFSYIGYSTQEVKVSNRSVVDIVLKDDMQALEEVVVVGYGTMKKSDLTGSVSSITSDNFKLGTDLTPQQLMQGAFSGVNISQNSGKPGGSNTIRVRGGTSITASNDPLYVIDGVPISTSAGVNQSNIGSSTTDFFDQEPINPLSNINPNDIESINILKDASATAIYGSRGANGVIMITTKKGKAGMRQLDYSFNLGVSTVAKKLDVLTGDEYRKTVSELGLTLDDKGQNTDWQDVIFRTAISQNHYVSFMSGSENTSYRASAGYSNQNGVMEGSGMKSANARMNINHKALNDKLKLNMNISYGETNSDQAPVSNTVGSEMGSSMLYEAYVFNPTYPIYNEEGDYYDVPPYRVNPASFSKELLDERATSQFLGNLTADWNFYKPFTLQVNAGYNKNTINRNSYISKSNLLGNGNNGYVTVQKLSDYSKLLETILKYNQSFGKHNIDAMVGYSWQYFYSEGQTTKAYGFLSDNFKWYSLAAAQTVESVSSYAESNTLISMYGRINYNYADKYLLTATVRRDGSSRFGSGNKWGIFPSVAASWRISQEDFFQNDIMSDLKLRASFGITGSQEIGNYNSLSTLGASTNGYLVGGEKITIVLPQQYTNPDLKWEQTAQTDIGIDFGFLNGKIRGSIDYYYKKTTDLLLSVAVPSPSLITTQIANVGTVTNQGIELDLSFDLMRTKNFAWDANLNLSHNKNEVVSLSNGQWTGDNMQVAPCQGQGLSGTYAQLIMPGQPIGTFYGKRFIGVVDGVEQFANDGEPEVIGCAQPDLTFGLGTNLQYKNWTLSLNFRGSIGNDVYNCTANNLAYLSNLPGRNVLKEAVTSGVNRDQAKVYSSRFIEDGSFVRLDNLSLGYNFSLPKLYISNARVFVSAQNLFVITGYSGADPEVNSEISRTGVAPLGVDYLSYPKARTFSMGINLSF

SEQ ID NO: 2927 - protein, 345 aa, Vibrio splendidus 12B01
MNKKLLALAIITASSNAVAVELYNEDGTTFDIGGHVSVALEGSDEGDTGLTAVSPRINFNATHDLGNGFVADAKGEWALNYLDGGENAFTTRLGYIGVTHNDFGRMVAGTQWAPYYSVAGVADMPIAFANDFIYEDHGNLGTGRAEEMLSYGKMFELGDAGKLGLAAGWQGRKSDTIDGTVAVTNEYGNRGQVALNYRIAGFSANYAYNTGDVNYGLGSQTVTSESHVISGTYGTYGSGLYVAGVYAMNENMNSDASPIKSLIEDSSAYEALIAYALDNSLNLSLNYESVVDNDASKTVYSTSAIQAEYNFTKKFVGFTGYQVDLGNDYNNKEDNKWMLGARYYL

SEQ ID NO: 2928 - protein, 223 aa, Vibrio splendidus 12B01
MKMNKSLLSAVLLLSSFTIHTASASVSDTGFYLGGAIGSSDIDDDGLVSKSNSVKTATFEAKDHTYRVIAGYKFNRIVSIEAQYTDYGEIEAHNPYMNFAREYNFSWKPKVTSIGANLGYTFANGLRPFGIIGLSNVDLNLKTRKPSLSELKADADTGVRVGLGLEFTPPKAPAFSMRLGYEADVFDAEIHERRFKGWSVETNKTYKKTVILDSFYLGAMYTF

SEQ ID NO: 2929 - protein, 422 aa, Vibrio splendidus 12B01
MTTNNTRLFKKSLLAVTITLASSQAMAAGFQLNAQSATGIGRAFAGDAVIADNASVMARNPAAMALFDKTELSLGFESITSMIEVNDVNYVGGQVPVNNTDDVGDTSIAPNIHLIVPVNDKFAWGINAYSNFGTKTEFDDNYPAAEYGGLTDVKSVNFGLAGSYRLDDQWSFGAGLDLIYGQGTMKRTAGAGFGKGNPSKGIPPAGTSLLNVDKADGWAVGFNVGTVYELDENNRFGLAYRYSPEITAKDDKGQEITLPLPDIAEFSGFHKIEDTKFAVHYSVQWIGWGDFDQIEFRNLDLATSPVGGANGSYNKEYKWQDGWHYAIGGTYYLNDTWTLRTGYMYDTSAQDELTSISVPDSDRQWFSAGFTYHIDTASNVDFGFTYLLGDDVKVSETSSGTPLTATTHADAILLGLQYSRSF

SEQ ID NO: 2930 - protein, 668 aa, Vibrio splendidus 12B01
MESPVRSTIKLSALYIAIASTFSSSVMAEESTSHFDEVVVWGTKVSSNTESIIADDMSLKQADHMSDLLREIPGVDVGGTHSINQRITIRGLSETDLDIRLDGASQHANMFHHIGNLTLNPDILKSADIQVGNNSVTQNGLGGSVLFETKDAKDLLRYDETFGARVYGGYATNASQQGSLTVYGLLSDNVDAMLYSHYMSRDNFEDGDGTETFGSEGDVYNILGKIGFEPSDLHRFELSYDMYRDNGDYSPRPDMSGGTNVGLSKNILIPTDYNRDTITASYELRGESHQGNVTLYNTETEIQRDESVMAPRWPANRLSKNTAKNQNFGLNAKFQSDYRLMSFDNIATYGFDYMDKSSSSYYGSSKFMDESAISTALFVEDQFYFTQAFSVTAGLRFDDYQRKAEVGSEDFDDVTWSLATQWDVTQDWTLFASTRSLFKGPELMESFIAYQDVAYLANDLKAETGQNTQGGVRFDKRLDNHFIGANLTVFQTNIDDYIAEKYQRASKSYLIYNLGDVEIKGFEASLSYGYEMFNSKLSYALLETKNKDTGGAVAGGNGRSIDMGDSITLTLDYQSEALETIFGWNSMFVKDEDNVFDGQPKKEGYDVHNLFAQWVPSNLDGLSVTFGIDNVFDEQYTSHASRSGTARGFTLDDYEPGRNYKLSAAYQF

SEQ ID NO: 2931 - protein, 536 aa, Vibrio splendidus 12B01
MNKTEGTSTYSGRIVFSGEKLTEDERKVADNLKSTFKQPIKIVSGSLVLRDGATVEAKKVSQTGGAVVMDCGTSLLATSTAGEDIALTNLVINTASLGGGSFPAQISAGTTDKNVTIQAVNLVDSDGNGYEYPVFSTTQSFSAIEAKASGNGKATIPADQLTNYVPPAHYGYQGNWSINWKPGTTSATQTATLDWKQTGYLPNPERQGPLVPNTLWGSFSDIRAIQNLMDISVKGADYQRGFWVSGLANFLHKSGSATKRKFRHNSAGYVLGVFAHTPSDDIFSAAFCQLFGKDKDYLVAKNNAHIYAGSIYYQHTSFWNAWDRLLQNTLGAQAPLVLNAQLTYSHMSNDMKTNMTTKYAPRNVVYSEIKGDWGNDCFGIELGAVVPIESQYSSLFDIYSPFLKFQLVHAHQEDFKENSSTEGRYFESSNLTNLSMPIGVKFERFSENDRASYNLTLAYAPDIARSNPDCATSLLVSPTTAVWLTKASNLARQAFIVRAGNYLSLSSNLEIFSQFGFELRGSSRTYNVDLGSKIQF

SEQ ID NO: 2932 - protein, 707 aa, Vibrio splendidus 12B01
MTTHTRFKYSSLAVALLTAFSAQALAEDTATAADSNVETVTIMGKAYRNTATKSALEPEETPQGITVIDEEQLEQRGVQSLNQALRYAPGVVTENRGSSVAMFDSYSIRGFATNNVNYYDGLSLQFLNGWNLQPQIDPIAMQQVEIFKGPTSVLYGAMPPGGMVNMIAKAPQTESSTKVGVATGSRNLQEASIDTTGQFGDNDFSYRLIALARKQDSQVDNAEEERYLIAPSVDWQATDNTLINFNLYYQNDPSMGINSAMPLDVLKASDPSVSMGDKNWSKFEREVLMVGYKINHDFNNNWTFLQNARYTDASLYQENTYHVSYDPSTPNQLYRYLYSTDESFKGFVIDNQLSGIVDVGSVEHNLLLGIDYQDLDGNVNYSSYSANGSGFNSFDPLNPNNDLLDRSDVTKTGEYLDDTTSSQLGFYVQDQVRLDALVLIAGARFDHYKSESDYYAHESDHKQFTYRLGGLYQFDNGLAPFASYATSFEPAPGVDKAGNEFDPENAQQAEIGVKYLSDDMSKEATVSLFHIVKQDMLMTDPTNVYGPRIQVGEVVSQGAELSGRWFATESFDIAASYTYVDMEITEDSSNGLEGTTPIYVPEHTANMWANYNVFNGMLAGSRFSAGARYVGEMQMDASNTQGKVPSYTVVDLSVGYDLGAASDTLSGATANLAANNIFNEEYYACYDQSNCWFGAEQSVELSVNYEF

SEQ ID NO: 2933 - protein, 237 aa, Vibrio splendidus 12B01
MKKIIALSALSLAFASSAFAGSSYVTGNIQFHDDGRIHGSDMTSTLEAGHTFDNSLGGLTVYTEFDGIQLGDLEGLTAAETGGDATTGQANAFITVGGEQAFNITDNLWVAAGYQHVFSAGESIQFRPLVKIGYNFDNGISISNRTRAHIDDTSADADTDYRMDNRIAYSVNEDLALSYNNVYMIDAEAMDHELRATWTRQGVQPYFEFRSQANGVDFANGASKTNNAFVFGASYGF

SEQ ID NO: 2934 - protein, 278 aa, Vibrio splendidus 12B01
MRKSLLTLGLLAATSAPVMAADYSDGDIHKNDYKWMQFNLMAAIDELPGESSHDYLEMEFGGRSGIFDLYGYVDVFNLTSDKGSDKSGKDKIFMKFAPRMSLDAVTGKDLSFGPVQELYVATLMEWGGGGATNCTPDQSTCVPSETVNTQKIGLGSDVMVPWLGKIGLNLYGTYDSNMKDWNGFQISTNWFKPFYFFENGSFISYQGYIDYQFGMKDDNKALNTSNGGAMFNGIYWHSDRFAVGYGLKGYKDVYGLKDDGLAGKTSGFGHYVAVTYKF

SEQ ID NO: 2935 - protein, 213 aa, Vibrio splendidus 12B01
MKKTVCGIAVIAALMSTNVLAHKEGDFIIRAGAATVSPNDSSGAVLNDPNTEFSVDSNTQLGLTFGYMFTDNISFEVLAASPFSHNISATGLGEIADTKHLPPTFMVQYYFGQANSDFRPYVGAGINYTVFFDESLNQGAKDLGLSDLSLDDSWGLAANIGMDYMINEDWFLNASVWYADIGTTAKYKFNGQQFSTDVDIDPWVFMIGGGYNF

SEQ ID NO: 2936 - protein, 1091 aa, Vibrio splendidus 12B01
MKTINVNKTCRIAVFSLACCLAAPSWADDLNRGEWGVRYESQAVMQKELVKGCVRDQNGEPLIGVTVRVQGTSQGTITDIDGNYSLALPSKQTKLEFSFIGYNTVVLTPGSRNSLDVTLEEDVKALDEVVVVGYGTMKKRDLVGAVDHINSEALEGRSTPSLTRSLQGQIPNLNISMRDGKPDRGASYNIRGTTSIGAGGEALILIDGVEGDPNSVNPQDIESVSVLKDASSAAVYGARGTFGVVLITTKNAQKGGVKVNYNGSFSFSQRTVEPDLVTNGLQWTDDFVEAFVNNKGTMPTSINNIFPYTPEWHEELRRHDANPDLPKVQINENTGQYEYFGNTDWDKLLYKDVTAGTDHSISITGGNDIANFYVSGRFFSQDGIYRANTDDYQRGNFRAKGSIKIKPWLSIDNNFDMMHKTYHYPLISYDQTLNIQRNMEQQGFPMAVMYNPDGSLTYSAVYCAVGDFYNESSYQDQTTLQYKNTFGVNITPIKDVLKFRGDFTYVNTAYKRNRVLNYVPYSTGPEQFAEKGKSLMMDNKDETRYMAANLNGTWTPKLGENHALSVMGGWNLETSNKDTFYSERDGFLFPDRPNYDLMDGLNYKLEQGDKNWSYVGVFYRLNYGYKGRYLIETSGRYDGSSKFPVNEMWGFFPSASAAWRISEEKFMEGTRSWLDNLKLRFSVGALGNGNVDPYKFLPTMSIDKTGVIVGDGQVNYTSYPGLIPNNLTWEKVTTYDVGVDVDMFKNRLTIGFDWYRRNTTDMYTVGPTLPEVLGTTQPKGNYANLKTKGWELTLSWRDNFKLAGSDFHYGVKFMLWDSQSWITKYNNATGKLSDYYEGYRIGDIWGYNIEGLFTSYDEIANHADQDYIKISDSKIWQPGDLKFADLNGDGKIDKGAQTLSDHGDLVIVGNEEERYHYGFNLNVGWKGIGISAFFQGVGKRDWYPGQETGFFWGKYNRPYGYSLKMHENRWTEENPNPNAYWPRLVGYSSENGGRPMGTPNNRYMQDASYLRLKALTVDYSLPQAWVSKLGLTGLKIYFTGENLFTFSNICENFDPEVIKGGDVDLKDRKGEEQGYSYPMLKTYTVGLNVSF

SEQ ID NO: 2937 - protein, 686 aa, Vibrio splendidus 12B01
MISRLSPLVAFICLTTTSVAFAEEGTSSKLEETFIYGEQGKTDTATKLELSIFETPQTVTAVSRAQLDEFALTSISDVLNYAPGITVEEVETNRTYYTARGFDIVNFQYDGVGIPFISGLNLGQQDTAIYEKVEIVKGSAGLITGLANPSATINYVRKRPTDDLQASAALSLGQWQNKRAEVDIATALSDSVRARAVVAYDNGETHLDRNKNTTQLGYGIFEFDLSDNTMLTAGYSYDRNESKGVLWGALPLLYTDGSRTNYDVSTSNAPDWTFANTTQKQSFAELEHHINQNWTAHLHLTHNQSTYDSNLFYVYGTPERETEVGLFGYASAYERDEEQLNVDLFVSGDFSLFERNHQLVLGYSDSDTNLAEASHYNNTDGFPVLGADWAKGNTPAMDFPDHDPATSSTDIDLSQKAFYVAARLNVLDNLALLLGARNTELEQTGVSYGGESNASANKTVPYFGVTYALIDSLMLYSSYSEVFKQQTWVNSELQPLGATVGASSELGLKKSFNDERSVLTLAAFSSEQSDFGVFVARNESGIAIYRTAELSSSGYELEFSGEVTDGLNIGAGLTVLDIKEDDEDARPFIPTQLLKFSASYVLPSLPDLKIGSSVKWQNETTTSDGSYTQDAFTLLDIAAHYQINAQLSVSLNLENLGNEKYLNSLYWSQAYFGEPRNMSATVRWKL

SEQ ID NO: 2938 - protein, 1017 aa, Vibrio splendidus 12B01
MYKQSFKHKLLAVSIATAVAASANAQEQQTQAEDNQENALEEVIVTGIRASLQRSMDMKRDAKGVVDGISAEDMGKFPDTNLAESLQRITGVAIDRERGEGSKITVRGFGPDFNIVTFNDRQMPTNGGRSFDFANIASEGISAVEVYKSGRANVATGGIGATVNVKTAKPLDKPGFQAVISGKGVHDPSNRDGASVTPEISGIFSNTFADDTFGISLAASYQDREGGSQSATTQDFYSRNLVTQEQIDNGEGDSGAIAVGDPTAIGFPSEVGEGGIYAIPTNIQYNLDEFKRERTNAQLTMQWRPIDTVTATVDYTYAENAISTEHTDLSAWIDPGCQTRESEWVQEGRIWSPTTYRHVGCATDSLQGVGKFAILNENNSIGLNIKWDATEKLSFSLDYHDSSGENSPNSKYGSNSVVAVASNNRITTSGYFSADGMPILDVELGERNDYGQIIRVDEKDPNDVRITGSIFGTAVSRMDVKQLQIQGDFEFDGGHTIDFGVATMEVKNRSQYTDIQRNNWSGVGEPGDIADLLSFESIDGVFDSLNGGGDPRQETLLYSWDFDALIERGEDLLISGDHTTNPSKGGGPCGTGYCPTYNFNSDELTTETSSSVYVQGHYLGEAFNRDYNVYAGLRYEYTEVNSEALSPVVGGVGWDVSSNTFLYGYLKDENGDDLQEFTELTGDYDVLLPSIDFDIELIDDLILRASYSKTITRPTYGALKGQLNIWSIGKEDSTAGSGNPQLLPMESDNLDLSIEWYYGEASYASAGIWSKNVTNFIANGTFEDILLYENVTTPYGGALYQEAIEAITGGDSSVTFDDDDINTYFIENYANGNNPYVIITGEGEDATVQLDGAPGDPAIYFDVSKPVNQRKTSVNGMEFMVQHTFGETGFGLQANYTIVDGDLDYDLNLNEEQWVVPGMSDTANLVGFYDKNGLEIRLAYNWRDQFLVDPGKDPKFVEEYFQLDLNVSYEINDNVSVFVEGINITEENKRVHGRSSYQVREYAVGHARYNLGARYVF

SEQ ID NO: 2939 - protein, 705 aa, Vibrio splendidus 12B01
MFSKSPLALVIGAVLASPAVLAETVKTDEHMVVEGRDYGYKADTNTTAMRMEATQLETPGQVSVIDEQIIDEQRASTLGEVLKNDASVGAGSKSTNRERFTLRGFDLDSSSGYLRDGVQHWSHYRQPVELLERVEVLKGPAGLLYGKSAPGGLVNMVSKKPTYETQVNVSQDIGSDSYTRTTADVSGSLNDDQTLRARLIVSQENQDSYRTRFDGTDVETDRFVGGLFVDYDINEDIMLSVHYDRTIEEGDLDNGSKIDTSTGKAIDPNTVNDQRFAQTDNDVANYGASVTANLNETWSVKTGISRQFYERQRTESNNTVYSDKNGGYGYKVSDRHDEWTFDTAYVDFTGDFDALGVNHRLLVGVNGLHYDYERLYDSGYTCVNATEAEAEAACGNGFDMPSNVSYKNDNEVSHSESQHYGLYVQDLVTLNDQWQVLGGVRFAYDKTTSSSNQEESYNNILPKFGVIYSPASNGSIYAVYSESFEPVGEITDQDDVNFGQSQDAKKGTLYELGSKWELFDERLFVSGALFQITQSNMQVTEDLDPASNNGKETRTTQVGEQVHTGVELAATGYVTEAFSVSASTMFLDAEYQNDPALEGKTPADVPEFTASIWSTYSFNNGTDVNLGVYHVGERYTEDSNTFKKDAYTRVDMGIAHTMKYDENLDFVARFNVENLFDTDYLEGGSTSNVVVGEGRNYMATLQVKY

SEQ ID NO: 2940 - protein, 426 aa, Vibrio splendidus 12B01
MRKFIKVYSIKLVNVLYLSSVFFVSHVFADITHKFSGAFSFEAGAPYYHFEPHSDNVSAYRKNVGLYSEGNVSLSVQDELENISYGGKVVLHTTTKAKGAASLNGSRLFIKSKIGLMEFGSQHSIAKVMQISPKACGAMGTWSRYAKLPENYVFAASSSLPIEAFSTNSVGYSGTESVRKISYYTPEYYGLTFGVSYIPDTSNSTGNVGDDTTTKAIVIKLPGYTNRYVQYRLVATDAWVGGINYKHNFQSGSSIKLGAVIEYGNALPMKVYNNPECKSEHKIDDVINVKDILAYSLGVSLSKENIHCGVSYSTWGDSFFSDEIVTKPKSDSWSIGIAYVEVPIGVSLEWSYNTYGDRNSRHAITFGSDYQLAEGLSAYFDLSYFIAKGSKVLLDTDPKKTQIASYDDQVKPFSGICGILGIKIKF

SEQ ID NO: 2941 - protein, 350 aa, Vibrio splendidus 12B01
MENKFFKTTLLGAAVALASAGVTAKEVGINSDFNVEVYGVAAMSTVNYNTTGNGDGTNGYVLENESRIGFRAHKEMFENVLVTMQIESGYVDSWQGGELGARDTYLGLSGDWGNLRAGRVLTPLYEIIDWPFSNPGLGSVFDWGGVNAHYDRQSNQVRYDSPNFGGLTFALSAGRDGNPSGSATRDSRFFSGNVKYTISTVTLMGAVEGGSDFRGVDDNDNLTYLVGAEVGLPGGFSLAGAYKQESVDKFSGKNAAGVAVSGENVDQGSFSVIGQYWLDSLGFKVGYAANLDADGIKTVGLKEESLDSNTISGQVMYVHNGFVPYLRVAGRTVGDKDTDIVTRVGLEYGF

SEQ ID NO: 2942 - protein, 166 aa, Vibrio splendidus 12B01
MKIALASLAIALTAAPAAFTQGDAELSGAYSNVDVGSADVGALTGRGSYFFTRNLGVEGEASIGVKDDDIGAGTVELDHSLGAFGVVRAPVSDKFHMFGRAGYATSELSASVPGLGSASGDFDGLAYGVGAKYFITERFGLRGDFTKYDGDDSEADVISVGAVVRF

SEQ ID NO: 2943 - protein, 959 aa, Vibrio splendidus 12B01
MKRLSGSRRSCLAVQLSLCLIPSLAWAQQPEPAPSTRTLDSVQVTGTRIKTAELQGQVPIQTLNRADIERTGLTSIGEVLQELTASGSALNAKFNSSGNFGFPPDGSGVGAGSAQVDLRHLGSKRVLVLVDGIRWVNESSASGVGSSTDLNTIPLAIVERIEVLEDGASSLYGSDAIAGVVNIITRRTFDGAQVTLNYGQYGKGDGTNQGMDLAWGTSGEDFSLFLGASYVKQDPIYARDRAQARFPIPGTGLTFASSATPDGRFQFVDPNTGVRQNLTPNAGVGTPQYDGSGGCTRSDDYHCFGTADRYNFAEQNLLLTPSERKGVFAQFRYYFNDDVQWYVKALGNRRESTNQAAPEPIFLGPDAGTGNPLADNIVISALNPFNPFGFDLNSATNLIQIGRRPVEGGPRRYEQQVDTQYFGTGLVGTFEGASRTWFWDVNGMYSKNKAEQTNYGSYNLFNINLGLGDPAACAAVAGCVPLDIFSGAGSITPEMLRWIQPVVRDRSQNELSLFTANLSSELFQLPGGAVSFATGYEYRKYEGSYQPDPLTVAGRYNGVPSLPTSGSYDVNEAYLELNIPIFANSTLGDKLDLNIAGRYSDYSTFGGEFTPKYGLRWQVSDEFVLRTSYAEGFRAPTIGELFGSAARADLQLSDPCSIGLGGTAPRGSAANCATLGVPVNYQQANQQISVTTGGNEQLEPERSRSFSAGFVFSPGFGSNASWSDRLDLEVTFYRHHVDGAIQAINAQTQLDLCVDTLDALYCDGIGRASTGGINAFNNRLTNLGSIKTDGWDVDLFWTLPESALGRFKLSWQNTFVGRYEALGAAGQRQPQGPGIEVVDSAIPEWTSNAVLDWSLGNWTASWTARHISKLTEQCGDAVEFAVCSTPAEGTNQLDAITYHDAQVGYRFDWLKGLQLTAGLNNVFDKDPPICLSCSLNGYDASTYDIPGGRSWYVRADLKF

SEQ ID NO: 2944 - protein, 586 aa, Vibrio splendidus 12B01
MNKSLLAVAVASLLSPISNLHAQEASADETMVVTANRFEQSTQSTTLPVVVVTRAEIEAIQANDIYEVLRRLPGIQVASNGGYGQKQSVFVRGTNSDHILVLIDGVKTASATSGGANFAAIPLVGVQRIEFVRGPRAAIYGADAIGGVINIITDTSSSEAKVSVGFGSDSYKKGSVAVSGNITDSTSGSVAVKRAETDGFSVQNSAGDQDADGHEVTELALAITHKLNDEFKLKFNSTYSDGETEYDPKNATKDQTLYSAIGRLSYTGETLSSNFSLSKAQDSSKDYYYKSTYQTDHQAVAFTNLFTVNNEVSIGAGLDWSKDDVSESSKDYAEKSRTNNSLYVSGFYDNQAVQAELALRGDDNQRYGKNTTWQAGLGYWLAANYRVTANAGTAFKAPTFNQLYWPGSGVPTLKPEESKNYEVAFEAHQSLVDWRVSAYKNDIKNMIVGWPSKNIGVAEIKGLELSGEFDTGSFSHQVSLDFMDPTDKSDGSQLLRRAKQNAKWNVTYFADNWQADLSYLYQGKRMDSGNAELDEYSLVDIAASYFVTDHFTMRGRIANLFDKDYTLAKGYETQERSFFINADYQF

SEQ ID NO: 2945 - protein, 679 aa, Vibrio splendidus 12B01
MKLKALSVAVTVALTSFTALAADEQETVVVIGSALDQLVQTEINSDTLEKKQASDIKDVLNTMPSVTVDGNARYSRKVYVRGMEDKFAVVTIDGARQEGQLFHHSGDQAIDPAMLKRAEIELGGNSALSGSGAINGSFSYETKDPSDLLKPGESIGARVKTSYQTAYERFATNVAVYAKVNDKLQFMGIANYSEDGDLHIPDQEAVTSKQGELKSGIAKVVFIPNDANEFKLTFNRYNDGGKRQLSGEKAGALYADDEHNYHSLNRDTVTLQHEYDAGSDLVHLKTNIYYNRQYMDRDALTEDYGDWNQVNGSWEFTKDGELSIPHREYNVTTIGGDIRNISWVGEHELTYGLDGYKAEQWIDAGDGVYQSGSKQGETKKYGMDGGTVTAYGLYLQDMYEFSDFRLTTGLRYDVHKLGGVYDGDFDQLSPKFKGEYQTTDNLKLRVGYGRLFKGASLPEALTMKAASDVNQSDTKAMTGNNYEAGFDYELTRLLAADYAILGFTAYTYNLDNQMHPTKNNSTLANQYDVEVWGVETVLSYALDSLSVYANHSYSDGDQKDLESGKTSHMSKTGIHNFKAGFNYSLNSEFVFGWDSRFVPGNDYTDEKDEQVKRAGFATHNIWAAYTPTFAKDLEMNIGIDNILDKKYAEHTGFGISWGLDKYTSYEAGRNFKASIAYNF

SEQ ID NO: 2946 - protein, 354 aa, Vibrio splendidus 12B01
MNKTMIAALVLGATSLPAAAQTTGGVTLYGLIDTTIRYSTHENAAGNSNLQMMDGVLTGSRWGLRGTEDLGGGTKAMFILESGFFPDTGGSQQGGRLFGRTAVVGLEGDYGKLYLGRQYTLAHEVLSSYEAMAFANNSIVGYQGGNYTGLRYDNTVKYIKSFGGLQLAGAWTFGEAAGSFSKSSAGAGSVVYSMGSAEVGAVYQVTRDVSSAFFGAVPAALASKQTVWGFGGKLDTSIATWYLGYTNSRLDVADYKNQAAYVGAKVPISGALSFIGTVQYDWMKHLDSSGKRLTTAGMLDYAFSKRTDVYAEVDYTHLQGSWVALDSAAAFNNSGNLYGNNSRLGVMLGVRHKF

SEQ ID NO: 2947 - protein, 247 aa, Vibrio splendidus 12B01
AAQAASENSSRSPYYVQADLAYAAERITHDYPKPTGTDKDKISTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSLGLGVIAGVGFDITPKLTLDTGYRYHNWGRLENTRFKTHEVSLGVRYRF

SEQ ID NO: 2948 - protein, 355 aa, Loktanella vestfoldensis SKA53
MKSILLFMIFVVCQLEGKKFSQDNFKVDYNYYLRKQDLHIIKTQNDLSNSWYLPPQKAPKEHSWVDFAKKYLNMMDYLGTYFLPFYHSFTPIFQWYHPNINPYQRNEFKFQISFRVPVFRHILWTKGTLYLAYTQTDWFQIYNDPQSAPMRMMNFMPELIYVYPINFKPFGGKIGNFSEIWIGWQHISNGVGGAQCYQPFNKEGNPENQFPGQPVIVKDYNGQKDVRWGGCRSVSAGQRPVFRLVWEKGGLKIMVAYWPYVPYDQSNPNLIDYMGYGNAKIDYRRGRHHFELQLYDIFTQYWRYDRWHGAFRLGYTYRINPFVGIYAQWFNGYGDGLYEYDVFSNRIGVGIRLNP

SEQ ID NO: 2949 - protein, 430 aa, Loktanella vestfoldensis SKA53
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 2950 - protein, 983 aa, Loktanella vestfoldensis SKA53
PVSGVTVNFAAPGSGASAALSASSDVTDGSGLASVTATANATAGAYNVTASATGVSDVSFGLTNTAGAAATLAVSSGAGQSTTISTGFGTALVALVTDAGGNPVSGVTVNFAAPGSGASAGLSASSDVTDGSGLASVTATANATAGAYIVTASATGVSDVSFGLTNTAGAAATLAVSSGAGQSTAISTGFGTALVALVTDAGGNPVSGVTVNFAAPGSGASAGLSASSDVTDGSGLASVTATANATAGGYNVTASATGLSDVSFGLTNTAGAAATLAVSSGAGQSTAISSAFGTALVALVTDAGGNPVSGVTVNFAAPGSGASAALSASSDVTDGSGLASVTATANATAGAYNVTASATGVSDVSFGLTNTAGAAATLAVSSGAGQSTTISTGFGTALVALVTDAGGNPVSGVTVNFAAPGSGASAGLSASSDVTDGSGLASVTATANATAGGYNVTASATGLSDVSFGLTNTAGAAATLAVSSGAGQSTAISSAFGTALVALVTDAGGNPVSGVTVNFAAPGSGASAALSASSDVTDGSGLASVTATANATAGAYNVTASATGLSDVSFGLTNTDAVAPTVTLTTSTTEVAPGETFEVTATFSEPVTGFTMSDVAVNHGSVVALTGSGALYTITLRSSGSGNIGVSIVAGVAQDVSGNGNEASGGISVRNTAIEETSQIIGRFMDTRATQLINNQPDLTGFLSGNGSFQGQGQFNLAVTRGRGTFDISTKPGSRVWTRLQGAVSREGTSDSAYVFGAIGSHFAVNKNLLLGAMLQFDYLDQEDGLANIKGKGWLIGPYFVTKFPNHDVFVEGRLLYGQSSNDVSPFGTYTDKVETERLLALLKVSGSMLYGKTTLIPKAQFTYTSDDQEAYRDGLGNLIPSQGVAWGQLEVGLDFETQLETRRGNGELLLFGGFSAIGSYKENSGGVIGTSSVVEGGRARAELGMSYQFSEQGVFLVETFYDGIGRSGYESYGLQVGLDLKF

SEQ ID NO: 2951 - protein, 623 aa, Loktanella vestfoldensis SKA53
MTLRLTTLALALAATAPLFPLPTFAADNAALDEVVVTATRQQRRAEDSLASVEVLERADIERAGHSSLIEVLRAMPGVQVTANGGAGANANVYIRGAEARHTLLLIDGVRVGSATSGAATFETIPLAMIERIEVLRGPASALYGSEAIGGVIQVFTRRGEAGFHPEVYVGYGTDDTFKGSATLAGGVNRLRYSLTAGKERTDGFNSKRDPAYWRSGARTSYWADDDGYRNDMLSGALSLGFRERDEVGLSFTQSDARNRYDASALRYFDSYLDKKARSVGVYMRNQLASGWTSTLRLGQSEDKSLNKASSAAPSFFNTLQDQLMWQHDVDLPLGRLLLAYEYVETRLDSSTAYREDSRRVNSALLGWTADLDAHHLQLNARHDDNSQFGGKTTGMLAYGYDLAAGLRLRGSIATAFNAPTFNQLYWPMTSLTSYHGNPDLKPEEALNRELGLRWSQGSHMVELTYFDNKVKNLIASNPTPALRGQQINIGEARLKGVELGYLLALGDFKLGAGVDFLSAKDEDTGLRLPRRAQRTGYLRLSQTLERFEWGVDIDGAGRRYDDAANTTVLHGYGTVNAYAHYRVAPDWKVELRANNLLDKDYELARGYRTPGASAFIAVRYAPR

SEQ ID NO: 2952 - protein, 835 aa, Rhodobacterales bacterium HTCC2654
MKTLYTSYNDDPQSKLLAQVNRELIAIKAERRHWPNGTRRSLNHCLAISHLWTGLCLSQSVLAQQASSTQATPSGAQLQVEDVQVIGSNQVDQNQNVPIPITTISASQIQATHVFNLRQIAAQVPSLQIQGFNPRNATLTIRGLGSNTGIVNSGLEQGVGIYIDGVYYARPAITVFDLWDLSGVEVLRGPQGTAFGKNATAGAINISTELPTFARTMKADFSVGNWGYTQFRGAVSSRIADSDFAFRLAGYVTNRNGNIYNSTHHEYWNDLHSGGVKAQILFEPSEDLRVRVIGDYNAQKEESGFSIIKQALPTTLANGSSVVGYYEKAARFPDYNAVIANPSDRVTPIDSDHTLVMNTGGISVQADAKIFDAHRLTSITAFRWWGWNSSLDGDSLGLPIQTAANLPTFQRQVSQEIRLASPEGGALDGHLDYTLGFFYFWQHNREHQYNAWGQAASTWYLGANAPISALNGLTSLGDISSTTNSYSGFGQATFHILPDFDLTAGLRYNDDVKNGTYNAWQGNNAVPIAQLPAAYQASAASLRNNLAPTTAYSAFAESGNFSGTAKLSYRFNDQLFGYASYAHGFIGPGLNLTPVTGTSGISPVVAPETVDSYEVGVKTDWLDHRLSLNANLFLQLADNYQASTYAYIGSRYVSYIGNVGRIRTRGFEIDSHAQITDDLTATFSATYNDATFLSYPKAQCPFAYSYLSTCDLSGQPLTGVSRFALFLGAEYKHSIGHYADQDIIGYIGGDLTYRSSFFSTLNDDPFGLVPAYSVIGLHAGFRTQDGNYDVAFWVKNLANTTYYAQISVGSSSAVPVATAILGDPRQVGMTISAKF

SEQ ID NO: 2953 - protein, 722 aa, Rhodobacterales bacterium HTCC2654
MKKILKTSFFVFSFLALFYSNAFAFIEFKQSKDISSDTVAVRGINFNPDGTIMYITNRKTDTDGGDGEKGEVTQYSLSVPFDISTATKSFTTQLVGDGGSVPQMKLPHAIEFKSDGTKIFVTTNKDPTSVYQYKLTTPWDTSTLEYEIRYSVDIAGGTDYTQQVRALAFKPDGTRMFIGEKNSDRIREYILTIPFDLTSGVSLGSRSAALTSADNNMRNIQFNSDGTIMYIAGNQNNNMNKYTLSTAWDITTISSTPTSYDLGSRFSNMRGFIFAANFTKLFVTDDTSSTNTIFEYSPACAGTITCADASANDDVKAIIEANVELSKRIIKNNTLPIFHRIEWLRRHKNKDNLSNLNAEIDFTNEKISKLVSALKSSKKEVDRSYESEDWFQWSEGRVSLGKNKSINSSSRDFHSYGISVGADKIKDDDRDAMHGYVFQYANDNVDIGYKGSKLETDAYSFALYDTKLRDDHVFTDALIGVSLLDIDQKRVIYGNILEGNREGQQIYGSFNFGKRIVDEDLNLNPGIKLDLGYTKLKAFRERTVVGDSLADALLYKEQNIKSALITLGVLLDKTDTDKEEDEIINHHGRLEYIADLSPSSDAEFYYLNSQSTVYNYNVENKSKHNLRIGYGFDVTSITGWSFVGNFERLQSNGKGYSNDIYLSVGYVPIDAMKFVFDLNNFENTSFSYTNNINGFDLKMSSNYNFISDVPDYGTNIEISNKF

SEQ ID NO: 2954 - protein, 284 aa, Parvularcula bermudensis HTCC2503
MKSFTKALFAGVAASVALMAAAPVALAADILEPVPEVPEVVVAPPAVGGWYLRGDIGYSKAKFKDADYATIDNCATCGGGSPTFGSNTLYGDLKGSFLVGGGVGYQVTDYFRTDLTVDYMTRAKFDGHTYGSACNGDINCASDERGRFSALSILANAYVDLGNFAGFTPYVGAGIGGTRVKWGDLDDVRYGGTQEGAANWRFTYALMAGASVDLTQNLKLDAGYRYRHINGGKMFEGNQWIGDGYDNGMNVHDVRVGLRYMFGGAGPAYAPQQVSTIVDGPVYK

SEQ ID NO: 2955 - protein, 961 aa, Parvularcula bermudensis HTCC2503
MRSKSLKTCLMASTLISGMAFAAPAVAQDDDVVVVTGSRIQRTDTVAPSPITNVSAEQLAVVNTVNTEDFINTLPQVVPAFDSTSNNPGNGTATVSLRGLGTTRTLVLVDGMRFVGSGPAQVVDLNSIPSALVESIDIVTGGASAVYGSDAVAGVVNFMMKDDFEGVEINASHETTLGDLDGEITTLSITMGGNFDDGRGNAVISMGYTDRQAVFQGDRDFSSLSNWDPGPGNAANGFISGGSSNIPGTRFRGATSSNFGAYGAGLVAADPSCASNICSGFFNTGSSINPMRFGSPNDTYNYAPSNYLQLPQERYNIAAFATYDVNEHLELYGRGIYANNVVDSQLAPTPAGVTLNVNLDNPTLPADLLALFTNDPASNNGDGTATIRTSRRYQEIGTRNSLRDTSSFQLVFGARGDINENWSYDVFANFSRSSISQIQTGNISVSALQAGVLCDGGPTAIASGCSAPYVDIFNGPNSMSAAGAESISRTGAQIDNVEMFQTVATVSGELPAFQLPTAEYAPALVMGVEYREASAESIPDSVLGPDVRGFNSSLPVSGVVDVYEFFAEAEIPLITGKAMVESLSANLAFRTSEYNTVGNTETFAVGLGWQINDQIRLRGNFNRAVRAPNVNDLFAPFTNGFPGAGDPCSGGANGSYSAATIDATCLAAGVPAGQLGAPFQGNAQMEALFGGNTGLGAETADTYTIGAVFEPAMIEGLTIQLDYYNIEIQDAISTVPLQTLLNECHLTGIQASCDTLYPAGAATPSRNPATGEMGANGFLPNLSPINVATLTAVGVDLRVDYGFSADIIGLPGDMAITYYGGFVSEADFTTSASSPVIECAGLYGLDCGEPTPEYKHSMQTSWYTGPFTTSLRWRHIGALDADPTTAATVSDLSDDITAKNYFDITFNYDVNEAFTATIGVTNFTDTAVPELGSTASEQANTWPATYDTLGRRLFVGGRLRF

SEQ ID NO: 2956 - protein, 498 aa, Parvularcula bermudensis HTCC2503
MIVTGGGSGDRGTDIVIRGMPSSYTLIMVDGKPVSTRESRPNGSAGFEQSWLPPLQSIERIEVVRGPMSTLYGSDAMGGVVNIITRKVETEWGGSVQLDAIIQDDSRSGDSQQGNFSLSGPLKDDLLGLQVYGGFYNRQEDLFVDGYEQKDLRNLTAKLTLTPTENHDFSVETTRTEDSRQSLIGRSADSDDSFTDHTREAFSLTHTGRWAVGTSDTYIQREKAENESREMTITNTHAKTALVMPVGNHMVTVGADFTEEKLDDKTSNRISDRTNIESSKYALFVEDEWMLTDTFSVTAGARMDDDENFGTHVSPRLYGVWGFSPRWTVKGGVSTGFRSPSLRELTPDWGQVSRGGNIYGNPDLEPETSLNQELGLYFNAGRTLLANVTVFHNDFKDKITRITCPVSICPDGPNQFGSDPTYRVNVDEAQTQGVEAALSTTLARVVSINLSYTYTDSEQKSGEYKGEPLTQLPKHLASLNLDWQATDTVSPWDRSLSG

SEQ ID NO: 2957 - protein, 528 aa, Parvularcula bermudensis HTCC2503
MKLKKRKVAAALLKRFTLPLLFTTGSLGAVTYEVHGDFINFAKVGFNHSPINPVKGIYPTETFVNLTGKLEGSVHLGRGWTVNLGGVLGGQAYDGTKYDRWAKDFTPPSYWDKTSCGTDSMSLCMNATKMWQQSGPGGVINPRGIGWEYMGEWNGLFPNYYPANAYLPGGSRRYQVYKANLTYDSDRVHMVMGRFDITEQEQMDWIYQLFQGFYGTFKLTKNMKFLLFSGWGRGIADGQWLFPIYREKPWGVHKAGIIYRPTKNLMIHPYVYLIPMVGTLPGAKIEYDTNPEFSGRGIRNRTTFYALYDYRWNNAEYGRYAPARYNTWDPFLDNGKWRGLQGPGGATLLLRHHIDINNYFVVGGAYLNIGNPNMNLGTWGNPVAVDGIEQWVGSIYSLGFAGIDNITDADAFTEYVKGGGKHGKFSWSVYQRFTTAPRALEYGIGMYLDYQFSKHVKAGLKLVWLEFQIRAGYNPGTGFLGPNGQPLNLNTGLFESSAFAQGPQNMGGIAKSITQDRSHLMTHISYSF

SEQ ID NO: 2958 - protein, 688 aa, Parvularcula bermudensis HTCC2503
MIFRRQTLTGCVAVALLAPTAVLADSANESGTQENVHELKQVDVSALPLGSNSPSTPYSVMDQQTLTQKSQNTLGETLKDQPGVHSDTFGGGASRPVIRGLGGPRVGVLNDGSQVLDASSISPDHAVTVDPLLARQIEVLRGPSTLLYGSGASGGVVNVLDTRIPTQRPREEVEGFVAARANTVADENATAAGLTFSATDNLVFRVEGSRRDADDYEVNGFEELTVPGTYAESDNGSIGASWIGDQGYFGMAYSYRRDNYGLPGHSHEFEECGANGSSLDCPTGGHNHDHGEIVPYVDLASRRVDARGEYRDPFAGVTAIRFRGNHTDYRHHEIEEGTIGSTFTNRGGDARLEVEHKPLGNWRGVVGLQYTSFDFSSLGGEAFVPKTETESFAVFAVEEYVFSEQWSFELGARQEHLTQTPDDRNGQALAKVTADNASFSGAANWRFVPGYELVLSVGHSGRAPSAQELYAEGVHLATNTYECGLLSDCGGGQRDLDDEVSLNANLNLRKTQGDWLFDLGIFENRINNYIYARTLDQIEDFRLIKYSQRDATFTGAEASLSYYGIDPVGITVFGDTVRATFDDGGYLPRIPAKRLGTRLNSYLGNFDGELEFYRSFAQDQIAGFEETTPSYDMVNATLSYRLRGDQRYTFYVRGNNLLGEEVFNHSSFLASTVPEPGRNVTVGTRIEF

SEQ ID NO: 2959 - protein, 251 aa, Parvularcula bermudensis HTCC2503
MRSKGHTKGTIIGYSTLKDSGIYGVYAGYEDTKMGSTYFDINNRTYYAGLKYFNTLFTTEKDQEVYIKAQGKAALIKNDLTKKIGNNEAKAEPNSYAYGVNTALGMNFISNKDIFSPEIGLAYEGGYTEAFSMKDTIGQATVKGGERTYANYLNLFSTKTSLTWFRDWLPNLKTSVELGAKFNINPKVEAEARFGNIKVSDEFDLPRVQKFVSTSFIVPVNEAFYFSLNYNGMFDKDGNTHTGFAQFNYLW

SEQ ID NO: 2960 - protein, 772 aa, Parvularcula bermudensis HTCC2503
MIARFLLLASVASASIILPAAHAQDTAPQEADAAIVGGAIVVTARRRAEELQDVPLSVSVLNADAIEQTGSYNIQRLTQLQPTLQFYSTNPRNSSINIRGIGAPLGLTNDGIEQGVGIYIDQVYYNRVAAATLDFVDIEQVEVLRGPQGTLYGKNTTAGAINITTRAPSFSYEGKAEISVGNLGFKQAKATVSGPITDRLAVRIGASVTDRNGTIYNVATDQRVNSQDFLGLKGSLLWKATDTLSLTLSGDYNLQNPVCCAQIYAGYGPTQRAANRQYPALTAALGYQVPSTNPYDRLTDLDAALRARNEMGGASLRAEWDLGAGTLTSVSAYRYWDWQPSNDRDFTGLDITAKSQNPTQQKQWTQELRYAQEGQTIDFVVGAFAFHQTIHTTGSQVQGADASAWLLNPSSPLSQIPAVLEGLTADNDIRLKNSSAALFGQLTWHLTDRLSLQPGLRLNYDRKTGSYESAVTGTASDGTRQTVTFASTDPWIVAQRGVLAPQSFDARFSDWNLSWDLTASYEVSDDVMAYATWSRAFKSGGINLNGVPLDANGNPQLDVATVKPEKVNHYEVGLKTQFWDKRATLNLSGFWTEIRDYQAIVNNGQNSVLRGYLANADKVRVRGIEADFSVRPTGSAPMPAAPIPTPNICASPMPPARPNCQADRPARPPATYPASCCPASPNIRYPTAWNSTCLQPCWAATDNFISAGTAAIARPSRRTRPAPSIWISRDTASTICVWASATAMGSTFMAGCATSLTAIIWRCWQPRRAIPA

SEQ ID NO: 2961 - protein, 160 aa, Parvularcula bermudensis HTCC2503
MMKKTLLVVALLSASSAAMADSWIYGGASVGQSDYKGKTDTSYSVHVGTGILPILGVEAGVTQHGKFKVAGKETKLTSYYAALKPSIDFGPLQLYAKGGFHQWDKKVSGGKNDDDFDLMYGVGAEYAIFGPVSIGASYMNYNTDKDDVGTFSLNASLNFL

SEQ ID NO: 2962 - protein, 187 aa, Parvularcula bermudensis HTCC2503
MSKFVKTAIAAAMVMGAFTSTATIAAGNNGTARFYGTIEDSVCSIVPDDHKLEVDMGDIGAEKLKNNGTTTPKNFQIRLQDCVFDTQETMTTTFTGTVSSANSGNYYTIFNTDTGAAFNNVSLAIGDSLGTSYKSGMGIDQKIVKDTATNKGKAKQTLNFKAWLVGAADAPDLGNFEANTTFQITYL

SEQ ID NO: 2963 - protein, 726 aa, Parvularcula bermudensis HTCC2503
MSTLSLPVLRLTPIAFGIALACTFPAAAGAKQATSAANAAPDATVLPSINVTGAAEPLPGDLAPTYAGGQVARGADFGVLGRQKASDVPFSMTTYTSKLIEDQQARTLADVLDNDPAVRSASGYGNFSQVFVIRGFALAGDDVSLNGLYGVTPRQLVQTDAVERVDVFKGANAFLNGASPNGSAVGGGVNLQLKHADDKPLTRVTVDGATSGSLGTHVDLGRRFGSEGQFGVRVNQSISGGDTAVDDERRRSNVTAVSLDWRGDTLRLSGDFLYQRQRIDNGRPIVLVSGSPLPAVPSATHNYAQPWSFSELEDTVGIVRAEYDFLPAWTAYVSAGARHTNEHGDYYTPTYSSSGTTGSRLSVPHKEDAQSAEAGVRGRFTTGPVSHFVTAGASFIRIDSQSAYTMSNAFPTTLYDPAPVASPPTAYAGGDMNDPGTVTKTWLRSIAVSDTLGFLDDRVLFTIGARRQSISVDNFDYTGAVTNTYSNAITTPVFGLVVKPWRNVSIFANRSEALAQGEIAPNTARNAGQALSPYRSKQYEAGVRYDTDQYGASLALFQIEKPMAYTDPATNLFGADGTQRHRGIETAVYGEPWKGVRLIAGATYLDATLQNTAGGTNDGHRPIGVPSFLLNAGAEYDVPMLRGLTLTARWIHTGPQYLDVANTMSIQAWDRFDLGARYATDVFGKKTTFRATVRSVANKSYWSSTIGGYLTQGDPRSVWLSMTTDF

SEQ ID NO: 2964 - protein, 1083 aa, Parvularcula bermudensis HTCC2503
MKHSDYHGKLLRLAMFFVALFLCGTMAYAQTDRMISGIVVDENGDPLPAAHIRQVSQTKGEELAAVITDMNGHFRLTLLRTAKEIEISYLGYESKKVRLTSANSYRIVLEPASELLDEVVVTGYQTISRERATGSFAKVDSKKLETQRLSSVSSLMEGRIAGYSDGKIRGVTSMNGLTTPLYVIDGFPVEKTISDGLGNWVENVPDLNIEDIENITVLKDAAATSIYGARAANGVVVITTKKAGKNQLNVSFSATLTVRPYNFYTGHLAGTADMIEMEKEWAAMNPNLQGEGASQYAQNLLDNASMYSCLGVQAILKHHTGAISEAQMEQTLHELASQGFRYYDDVKKYGKRNPFSQQYNLNIGRGTEKNTFNASLSYRNNREEDKYTDSESFGLNLQNTTRLTSWLSLDLGTYLNYGDGTTQSYNLTSPGYNYVPYSSLLNGDGSYYTNTAADRYSKSQQEIISSYGLYSMDITPLDELGRNLSKSKNFSNRTFARLNFKFTDWLRYTASFQYEVGEYKTSQLQDKESYAVRNKVNTFATDASGSGQATYNLPYGNIYTTGTNSIRAYNFRQQLDFNKTFAEKHDVTALFGMEVRENKTEYNNRKYYNYDPALLTYDLIDERVLSNTYTGVLGNYVSFNKNDISNIYELVNRFVSFYGNAAYTYDGKYMVTGSIRWDRTNLFATGSKYQKKPIWSVGAGWNLDKESFFKVSFINMMKLRFSYGIGGNIAKNSAPYMTAYYNNNTHVGGIQGTISNRPNPDLRWEKTTTANIGVDFSMFRNRLNGSIEYYNKSGVDLLANTNGVPTEGFGFSTYTMNNGKMRNRGFELTLSSDVIMGKDWNWNVGGVLGYNKNKVTYVNVKAPAIFLQFDYPAAYPRVGVPYNAIYGYLWAGLDSKGQPQVYDSEGNIHVSSSPQKVEDAVYLGTSVPVYSGAINTNLRYKNWELAAQLLFEGGHKMRNTNIAYPGLGVTSKDVSKRWRQPGDEAYTDVPRYVPSESKDYNSYSSDLYSKASIHVLDADNWRLKNLSVTYHVPASVCQKFYVKNARIMLGMENVFTLAKSRDVKWMLGGYSKPNYLCNVNLNF

SEQ ID NO: 2965 - protein, 160 aa, Parvularcula bermudensis HTCC2503
MTNAEDSWGMQNRAGHWHLGLMFGGTMGGSNMKMRGATGNVMIMPGYNFNKYLGIQYNQMISYSGTFTGIGEATIMIPTGSMIMPYAAAGAGWSNMSGAVQGAWDVGGGINIALSKTLSAVAAYRYIQTMAASPIAGVGMNQPNARAAMSMVSGGLVWYF

SEQ ID NO: 2966 - protein, 817 aa, Parvularcula bermudensis HTCC2503
MEIAMNRKLKIKMGTAFSASAASLVLQLLPAAAIAQEEAKGVFEEVLVTARKRSESAQSVPIPITALSQEQLQTRNMTEIRDIERLSPNTSIQYSSVNGTAAQIFMRGIGQTNWSSTQDPKIGMYVDGVYLSRPQGGLLDFMDIERVEVLRGPQGTLFGRNTTAGLIHIINNKPSQEFEADVQFGIGNENHQSYGFMVNAPITNSLAARFALYDKKTDGNIINSVTGKDRGNENSLSYRGSLLWDQDDFSAQFTFDHFEADERAPLGTCRFTGPDNPFAAQGLPFLATIFGVYGDMKANCESTTKDVSIDNTNNESAKSDVDAYTLRLGYDFDGVELTSITSLRKIDNFNGSWGWVMGNGPNVNFLEILNNKSENEIFSQELRLTGSTDNLNWVVGAYLFKEESEESLDAPLFRGVTIPSPADWPFFYAPNPAGGTVGDGVVGAQLYGSRYQAYDVVNKNKAVFAEATYTFNDRWDLTLGARYTEDDREFTRIQTLFGGDFDPAYFCPGMPTVELAPGVVIPGSDRCFQDVSYDKITPRAIVNYQLNDDVMFYASYSVGYSSGGFNQDVRMRAYEPEVSDNYEFGFKSEFFDSKLRVNASAFINDYQNQQLTVGRVVNGQATADLINAQEAQIKGLELEVLGQLTDALSIAISAGYIEGDYKKFTVDDNAIETNSDTGEITEVIVVRDLSDVEFGNNGDELSFDVSLLHIMDLGNNGDITSSLGYSYKDDQYSTLRNTPSSFEPSYWLLDSRVTWNLPNGKTHISLWGTNLTDEEYVDTQINQSGDLAVGGTDPSLGMTAVYWGAPQRFGLEVRHTF

SEQ ID NO: 2967 - protein, 708 aa, Parvularcula bermudensis HTCC2503
MVALAWGVAGTSQAQTAAPTPPTQSDDEDTNASQVEDIIVTAEHRTANLQSTAISITALTSEALEQMNIATLADLSGAVPGLVIGGSAGNGGNNSIALRGVSGLGQPVGNEQQVAVYLDGVYLARPEAALFDLADVQRLEVLRGPQGTLYGRNATGGAINIVTEAPTHTTRASVDASYGEHNTSQVQAFVSGGITDVLTGSLSLSGSGHDGYFINRITGNDVGDSEGYTGRGKLRYLSPDERLDTVLSIDATNQQFKDYFINAVNADTGVITPITDFVYLRSAYPEKDVHTERDLGGVSLTNTYKVTDDLTFTSLLSSRWYSVDVNYDLAGGVFTRFIAPTHSQTESDTITFENRLSYVSERFKAVVGVDYFHLDEWFEARPGTAAAPTVPALLPAPRYADTLEAYGVYGQVNYNLTPELELVAGGRYSQESRDFLVQYTTFAALTGDQSDSAFLPKFGVNYQMTPDLFLYASVSKGFGGPGFTGAGAGKPINTFNSEFLWAYEAGVKADLLDRRLRINFSVFESDFTDLQVRRIIGVGLVETNNASSATIRGAELEVQAVLGGGFSLRGQASYLDARYDQYADFDGTTPVSRAGNRLNRSPEWSGGANLNYERELQDNMSISANIGVTSQTESFYSAANLPVFGTDGWTVWNSRVTLRLNDSLEIYGFAKNLTDERYVTHVIAALPTLALSAFNDPRTIGAGFRWAY

SEQ ID NO: 2968 - protein, 1185 aa, Parvularcula bermudensis HTCC2503
MTFLRSLALVAASALFCFAQLDRGAITGTVTDSSGAVVPGAKIAIRNLGTNVKYQSATTGTGDYNAPNLPAGAYEVTFEASGLKTLVRSNIVVAVSETVRVDASLPVGASKDTVTVTAEAPPLQTDSPVVGVVLQNRVVNELPLNFGSGGRDVENFAIQLAPGVAGSASGTEILGTPQFSKEVLVDGATSTGYRSGDAYQQSPSPEAIQEFKVETTGMSAEYGRTAGGLFNFVMKSGQNKVHGSALFELRNEDLDANTFLGNFNHTPKSRDRQLDGGGSFGGPVWIPKIYNGKDKTFFYFALERFYTSGGGASTPNEMLPPPSWLQGDMSNMLTSQSVGKDANGNNVVRGAIYDPLTTQTVSGTLVRTMFPGNIIPQNRISKVSQQVIGIMAKDYPATVPGPNGDYLLPNNAFGTYNTWQRFTQLSVKGDHNISARNHLSGSILRTTQPQYQANASGVHVWANLPDGGPFSSAIVKPVDTHLFRIAHDYTVTPTVLNHLSVYFNRVTNSIQNLHEGQPNPLTIPGTSNTSVPVINWSGGDRYSLTNLGQDKASDSVRSITYGYSDTLSWIHGRHSLKFGGEWRVYKLNYIRQPDAGTFGFSANETGLPGLTQFTGNPFASFLLGSVDSASVTITTPTLATYRSLGVFTQDDFRVNSRLTVNLGLRWDYNPTQTEEHNRMFSFSPTAIDPATGLPGALTFAGNCNGCIGSPNFVEQHHHNFGPRLGFAYQLNTKTVIRSAYGVFFADRAPNDYFGDPNCSVACNGWGWGVSNVVNNPGNLAQAFNWDNGYPGVAAFTTPNPSQANNKSGALYWPSNAGRVGYTQSWNFNIQRQLPFKMVMDAGYIGTKGTGLMANGLGVLNQLPPGALVLGSLLTSTVTSQAALPASAVALGARYPFGSTGKSVPVWQTLTPFPQLLNGATVGAWNAPLGFSNYNAMQIQLNKQYSSGISWLANYTLSKTLANVTNTYAGGTGTPMIAYNLALQKAIVSYDQTHVVKIGVNYELPFGKGKPLAPHVHPALDALIGGWKLQYIGNYSSGTPLNFGANSAAPGTNAGGNRALLTNGDAGLGIPFNSSGFNAALLQVANSTNQYLNTQYIKQPAPFTYGTAAANVAQIRGLWGRSENIALQKNWSVKERVRFQLRAEALNAFNRHTFGGISTNPNSTTFGDVTSVSGNRTMQVGTRIDF

SEQ ID NO: 2969 - protein, 725 aa, Parvularcula bermudensis HTCC2503
MSLPLRTLPLPRRSALSLAARAALLPTLLIAIAAHANDAPDGARQLPTVNVRADKTTPTDAYAGGQVARGSRVGLLGELDFMDTPFNTTRYTADFIDNIQAPDLVRVIALTDPSVYNSGSSGGITDYFNIRGFGVASSDIGFGGLYGLIPYYRVTPELAESIEVLKGPSALLNGMPPGGSVGGAVNVVPKRAGDTPLTRFTASYGSDAQWGGHLDVGRRFGADKQFGVRLNAVHRDGDTATDHQQHKTQLASLGLDWRGERSQVSLDLFSSRDHVDGLNRGVSLAPGLAVPRPPKASTLFAPDWTFSTVKDQAAALRWSFDINDYLQAHASYGHGHTDFDSIASATTLITNTAGDFRNNFAHQRFIYSKDTVEAGLSARFRTGAVDHALAISAAWYQHDQKFGFKRNLLARDWVTNIYNPQWGPAIDRSFSDASLPKTAEVRTTSFGIADTLSFIDDRVQLTLGIRHQTVLSDTFDGGTGKRTARYDASANTPAGALLFKASDRLSLYANYIEGLSQGSTAPATAANAGDVFPPFKTRQREAGAKFDFGRLASALSVYEIEKPSSYTDPTTNVFSFGGQQRNRGVEWTVFGQATEQLRLLGGIGWLQPKLTRTQGGINEGRLATATPQWQGKLGVEWDVPTVAGLTLTGNAVSLSKGYITADNSQWVAGRTVFDLGARYATQAAGHPLVLRATVQNVTNKAYWAGSLGSGLGTPRTALLSATVDF

SEQ ID NO: 2970 - protein, 319 aa, Parvularcula bermudensis HTCC2503
MPSLALADGPTVYGKVNVSLENAEFDDGVNPSEDAWELNSNASRLGVKGDFDLDVAGLKAIYQAEFEISVDDGDKSGQTFTQRNIYGGLKGGFGTLKAGKFDTPTKKAQGKIDQFNDIGGDIKNVLSGENRVSNIIQYSTPALGDLVTLNAAFIPAENNDIDGDGDPETGLADTISVSLVAEKDMFYGAISHDADMTDELITDETGTSPAIDITRVALGLKPGNFEVGALFQTAEETEADGEETSYILSGAFKIDRVKLKAQYGMTEGDVSDEEATQVSLGADYKLAKASKVYAYGTQLEFDLADTEETIFGIGMEHKF

SEQ ID NO: 2971 - protein, 227 aa, Parvularcula bermudensis HTCC2503
MQKSCSLTLIAAAILFAQAEPGRAADYDPPMIIEEAPLVPVEVGSGWYLRGDVSYSVNKSVYDVDTLADDIDNNRIGGSVGVGHHFTDLLRADINVAYIAGDDYDDGVIAAERRVWSGMVNGYLDLGTFVGLTPYVGAGAGLLYTSHEISGSDPFFTDAFSSIDRQYEFAYALNAGVSYQMTNNLSVDVGYQYLNSPGTKYVDVDRGTVEEGVDFHQVKMGLRYDLW

SEQ ID NO: 2972 - protein, 1076 aa, Parvularcula bermudensis HTCC2503
MRVAFSTRTSARSVVLSRTAPLRAILAALVMTATPVFAQAPGVPGSAPAPAVDPVTQPLPPSEETQPSQPTDTATQPSGIAAPPAVGDPSTQQPGTESAPTAQQPGVTPAPTAQQPGTEPAPTAQQPGTEAAPTAQQPGVTPAPTAQQPGTEPAPTAQQPAAPADESMEGISDEAMLAESAVPPPGFTGIYGRVTDEANGEGLIEATVKVVAGAQKQVLTDLDGFYRVALPPGKYDLRVFYDVYQGRRITGVVVTKGKATKLDVALGADEGAVQEVVVEARADRRAEGALLQERKKAAAVSDAISAQEIARTPDSSASDAVKRVVSATVVDGRYVLLRGLGGRYSTTLLNGALLPSTEPDEPSVPLDIFPTSLLANLNVVKSYTPDLPGTFAGGTLLIETNSYPSEFELKPRISLAGDSETTFRERNSQAQGGFGENLGFPSGSRQLPNAIPRDSGLGMSGESSDVLEQQYRSFPNIWQARRTTALPNMGLGVSMGDTLRFGNSRLGYLASANYGHRDGVQEGTFARVDRDETGALNARDAARSTQGFETASLSGLGSVGFQLDRDNELTWFGLYTRGTDTRTFTARGSNIVRGESYESTRLQFVSRQLFFNQLRGFHRLGLLGDAELDWQANLSRVDRDEPDTRDTLYSDNLSAPSGTPTFPNQPNSGERFFAELGETSTGGSVNVTVPLSAVRLKVGGLTQVSFRDFGARRFRYLLGTTPVDRTLPPEQLFAPENLGTGIRVRENTRPDDAYDAYLGIFAGYASADVQPTDALRLVGGLRVESSTQQLTLKDPFTGASGTENRSEYMNLLPAFNAIYALTPTVNVRAGYSYTLARPTFRELAPFIYFDFVRRRNVSGNPDLLQTRIHNIDARVEWFAGENEVLAASAFYKRFQDPIERVIRNPESGDLSFENAAGANTYGLELEARASLARLTETLKAVRVGANLTLIQSDVDLGDPNVVGAQTNRNRPLQGQSPYVINLNVGYSRPESGTELTVLYNVYGRRISEVGVQGLPDIYEVPFHRVDISLTQQLGSAQLKLTAANLLNSSVTLRQESVDVQTYKPGVAFSASLGWSL

SEQ ID NO: 2973 - protein, 1842 aa, Parvularcula bermudensis HTCC2503
MKLRLPLKLLSALLSFYAISGFHVFAATEWDGSRYSGNIYTWVGSSSNDFHNGGIVLTNPDGTYGPVNTNWGSVSEEGSIWNLFANETGLSEYNTLRFVASGTEVGDVTVSATNKNPSCSFTPFTMGGLIVEEGASGFSLVPNNNAQRTLILGRAGTEEPVLFTVREDFSLGSSSNAWGPVNVNADWNVLVANGKTLNVYGALNSSGRTITVGGEGFSGTLVLNNAANASMTAEWVITSGSTVRCMNNSALGSGLVTLDGGTLDFNSQTIGSTITLNMSGTGTLQNVTVDGAILSYTSSSGNDGITASNTTWTSGKIDIGRLLQGFSAEGSNTVDLGAELGEGFSVLGLDTGQYRIEGSVLTIEDGAISSVTWVSAGEGGELEETVKNAFTLALGEGSAANVSLGYLNGTLTTSGDKVYQITNTGGTKINLSGVYNSGATLPSGNLNYQGDIWMDINGGAFGIIAGGVTNEWGTNLQTSTLTGDTHVQLSGNATAEHVIGGNNKGASTTLTGNTNVTVKDNAIVAGAIIGGSTSSHNAVTTITGNTSVLVTNIQHSNSATVNLGDFGNVTAQNFITGGSAWTANQTSGTTIQGNTSVTINVGDAELSGTEGHNNFVKNIYGGSYANTKSEGNGAVQKVEGNSSVSISGKEGITFTGDIMGGSFWNWGNGTTLTTNGNTSVSIDGGSTFTGKIVGGSWRGSTWTAEDPTALPVSIGGNITVTLGQGTYLGDIYGAGNCGTVGGEVHVSLTGGSIFGEEGEESGITIGGSAGAAVEGNRTLELKGTFGTGDFQNVTFTRFDEINIAQEETSATIYALTDSPALTKTGAGTLTLGADAAGAETILDGTTEGITISEGSLNLSGAGGSHMKGTWNIASGSRLTGVSGTVTVGEGGLDGLTIALGTENIGQDTQASGAVIINGSGTGSDPNLSIEGEGLTLDLSNDAVVNLLLDHKTDDSSSYLTLTSGTLTVGDLGDIAFTTDLLSNYGIRVTGTDGGSLVLSGAATGLYRVQEEGGNAHEVNSYQTLSGYAGVVIGGGQTLTVNLAGAPGESDGQGAKINNLMGATGSSLVVNNTGDGTAVVILNNKQMTTGEDDIDPAGQDTVMGGSITGGNNVAFIKEGTGTLTVGGTMDVETLALREGNIVLNGASNTLDTLTLEGGGLTINGNAEVGTITGTEAGGSLTIQGTLNLTGTGEINDGSITGTGTLRIQEGAELALGGEARLDGTSVTADGTLALSGTESGAIISLSGSGTLSMNGGSLSISSATTSSGTFSGTLAGSGTLDISGQATQYLQTGNKDYDLAVRDGGVLVLKGTADAPTLNYNSITAGNNGTLRIEATGDAQGSANTTLNVESITFQNGSTTELIYNFNQDAPFGAPMLTADTITVQDGAGFLLSNMEGNAAMNAGSDLHDVILMSATGSISGLEDGQSLAARISGLFAVYYQDATLNRDGNDILLNATLRQENLFASAADTWNSAAGASLLWEARKNLDPDSQLAQFMNGVSTMINDGNLSGATRAMAAAAGSTVNALGTAQRDALRDQMGWIRNRTTLMGVNPAYVNDDLPRFHMWMEGTGSYAKLDTRGDESGYQLTTWGGTVGVDADLSDRLTVGAAFTASYGDLTAGAADSADGHLDSYYASLFGRYQDRRWAHTLILTGGWNDAKLNRTVNYGEGSYGTQGSTSGWGFGAMYELTYDVYLNENRSSVLQPLFNASVVTTRMDGYEETGAGNAGLNVGRQDWTTGTLALGGRWMGLVGSNIFGREALAEIRVNAAQDLGDRRGETNVSLLGNPGFAQSVRGAKVGTTALQLGAGLSVPVGTKGTIYVNGNADIRDGSSALNGSIGYRHDF

SEQ ID NO: 2974 - protein, 784 aa, Parvularcula bermudensis HTCC2503
MSATRSSECPRQFSGAAGTDRQRFGAFFSRCSMQNFLGEQHSLTQSIRGATPLRPHLGWLLAGLAALPLPAAYAAGSGASAQDQEPTLKSVTVTATRREESLQKVPVAVSVVEGEQLERDNRNGVASIVQQVPSLNFRTGASNKDTSLFIRGVGTISTSPGVEPTVATVIDGVVYGRPGQATLDLLDLERIEVLRGPQGTLFGKNASAGVLNVITKAPTAETHGYIDQAYYSGNESRTRFGIGGSLIPDTLKGSLTTLFGSYDGNVDNRHNGQEVNGYNRKGVRGKLEFTPSEDLKFTFAADYMQSHDDAPNGVVSKALTPAFANALNPVRASSDNRDINTDTRTHVDDINKGLSGQLDWSLGDYTLTSITAWRGWNNTQYQDGDRLGTVTAAFPGTADKGDLDYNQYSQELRLASPKGQFLEYVGGLFYMHGKDEETYQRTLTTTTGANRGIADYSTTNDSYAVFGESTLNFTEDFRGIAGLRWTHDDLKYDHRRVSTSATTVSGIQPGTQSSGSVDEDGWSGRLGLQYDLSATVTSYLTYSRGYKGPAYNVFFNMQPRDTQALKPETSNTWEVGIKASSWNNRLTTNLAVFHSEYDNYQANFFDTVAGQVVTRLINAGSVSSEGVELDYALQATQQLKFSGALAYTRARIDEFACPAGAAASCNVNGKPLPFSPDWKSYVRADYSIPLDNGLDIELGTDYSWQSEVQYDISQNLDTRQGAYGIWNASIALADYNDGWRVALLGKNLADKSYSPLLASGGNYIYRAVPRDDERYFGVQLRKDF

SEQ ID NO: 2975 - protein, 482 aa, Parvularcula bermudensis HTCC2503
MVHIVASGTIPALAQTGPERGMASAPGAEPPTLSTVPRLRRLSRPGRPALGRANTPLARPSTAAGANTAPAGSLDTQSAAPQWGVLGNFGGVRDDLFRAGIRMDGSFDYQTSTNIQGGSYQSLRGAGQLAVRSTVDMDRLAGLTGGTFNVTLTYRFGRGLTADQHFGVLQQTEEIFGRGRFPRLTQLSYTQRFGEFVDLKFGRLPVSSDFAGFACEFQNLTFCGNQPGNLVGNYWYNWPVSQYAARLRLGNTDTGYLMAGVYQVNPRDLEDGFNFDPSGAAGALAIVEAAAFPTLPPFAYRGSYTVGAWYQTRGGPDLFLNREGLPLTVAGGVPLADRERSGLYGVAVQELYRPNPANPLASLSAFVRVTMANSSTSFIDRQETIGFVYKGFWAARPLDWIGFGIGQSHASHGLAQSIQRANLLDGGVRPIPGYERVLEVFYSLALSPDVVVRPNIQFINRPGGFSGRTDILVFGVKSGVTF

SEQ ID NO: 2976 - protein, 832 aa, Parvularcula bermudensis HTCC2503
MMGKLTAGAGCMERRRCGWLGSVALGLLLAAGSAGTPARAQAPAPVAYSIPAQDLGAALTTFADKAGLRLLFPSDLVAGRKSPGLSGTYSRDIALARLLQGTGLVYRFISANTVTISAPAAQGSDAGGTILLDTIDVAGKGDDQQLVALATSAGTKTDTPLIDIPQSISVVTRAEMDQRGVQDFNSAVAYTPGVRVVDYPGGQGMPDIYLRGFRAIDQAAFYRDGLRGGFNAYDADVETYGLERLDVVKGPASALYGAGVPGGLVNAVTKRPTTYNVREIELLGGSFDRLQGAFDIGGPATQEGTVLYRLTGLWRDSDTQINYSPDNRIYFAPAVTFQPTGQTSLTLLTSYQKTEKGGSEQSLPMANTVFATPGTPKISPSLYLGAPGLTNWTVENLSAGYEFKHEFDSGWKLTQNARYTHSDVDYVSSWGSDATLAVVDGQYINIGVQQRPKTSDSFLIDTNVSRKFATGPIGHDLLFGVDAGYYNSTETRTNSTNYNALSIFTPNYNFAYAFGLPWSDTQSKITQIGFYAQDQLSLGNWRLTLSGRQDFVRDEEYNFNSRTLLADFGFTDTKSVATDSAFTGRVGLGYRFDAGVTPYVSYSTSFQPVAGTDYNGNAFKPTTGEQYEAGIKYEPTGWRGMFTASVFQITQQNVLTNDPINYGYSVQDGAVRSRGLELEGKASLTDNLDIVASYTYLNARVTQDNPNESGVSKVGTVPAGVPENAASLWAYYTFRDGALNGLGAGAGVRYIGSSYAVMNTTSGTQISVPGYTLLDAALRYDLGKLDPRLKGATLSVTGTNLLDTEYYTPGFYWNSVLYGTRRTVYGTLAYRW

SEQ ID NO: 2977 - protein, 825 aa, Parvularcula bermudensis HTCC2503
MKSLRLSLLALACHSALFAVTASAHTTILASQTSATSEAQTNKARDNKDVERITVYGRQNQVVMNSGLATKSDMSLMETPAAVVIVDEALFDAQGLSNMQDLVRNISGVTQAGNNYGIGDNLVVRGLGANYTYDGMYGGAGLGNTFNPTRSLANVSSVEVLKGPATGLYGMGSAGGVINLIEKKPEFTSQHEFELELGQWDSYSMLADSTGAISDDLAYRVVAKSARSDGYRDMGTDRDEVYGSLKFLINDDQNIMLSAAYIKDAIPVDSIGHPIRIYNAESVNGKTAGEATWQDLVNDPGSKGIQLTDLQRQELANSLSSSDGLTPYTFGHKGLISPMAKANEGEELRLKLTHNIYLSDNLHLNQQLQYRNYDTGFARQTGAYNYVYWEQSEGINVAPRAPLLEDGKLYPFAARRQEYRKASADEKSWQYFADLRYDFELAGIDNELLMNANFEDRSIRSQQYSIWDKDYIIKDKKGQLLYQGSLPYIYDIRNPNWGTGQFEDYDPLRTSNYDKAISAWGLGVQHVGYLGNGFTSRIGVAFNEIKQAYEHLGVDARYSASRAEPTQLADTTDNGMTYNLGLTYMPTDDLSFFINHAKGRTAYSVLGDIKGDQSDREDSESVSKDFGIRAKGFDDQLLASLIFFKTSRTNLQYGNPLYNSDVSGPEVPQYFNNGSEDTEGVELDINATLNQQWTINVNAVYQDARDNQDPSRSDANQRQKGVPYVTAGMWASYAADFGLREPISLSLGGKYVGERSTHSSRFGIPDGHVPSYAVMDSAISYDAQDYKIQLNINNLFNKVYYEKAMFLGGMPGEERNAKLTLTYRL

SEQ ID NO: 2978 - protein, 473 aa, Parvularcula bermudensis HTCC2503
MRILFNRIQKSTLPIFIGLGVFISFPSLWAVASNSRNAINARYEGMAGVNFALGGSPMDVALNPANLYLMKGKKIEFGLGMSHAQIRLKDQFLDSDPSLNYTNSKSRTGAGAAPYMAVKLPVTDTIDYGFAAYVFGVVNGAAEKINRNTPTGETVNQWAGLPGIFGDGKRIQETTENQGIFIKAVNGLSIKFGNLSLGASLELNYGAQNRNIRYYDAFGIREIPGQGFHYESRKNALALSGIIGSNYTVTDWFRIAYVYQSSANFPFDGSYTIGVNDPTYYRSTGVSYNFRSPEKHGLGFAVGPENLKVAIDFLYINYGSYLKNARQNLEDPWYPNPQGRSSETIAHLNYRNQWAVLIGLEHKITKEWTYRFGYSYNSPIVSSNALNGAQGILLTLNHVIAGGFSYSSGPWSFDFGASCFIPGRQIEGGKDTDWAISHGIFGPNNQNNIVGYSYSAQALHSIGINFGVTRSFD

SEQ ID NO: 2979 - protein, 713 aa, Parvularcula bermudensis HTCC2503
MICYIVSFNENGTSFYREGNMRFERHPLSAALALALAWQGAHAQASADGTSEAATLAPITVSASPLAGDLDSMTAPAAVLEGDQLLLRRQGTLGDTLDGLPGVHADTFGGGASRPVIRGQTAPRVKVLSDGSELMDASAISPDHAVTTEPLLADKIEVLRGPATLLYGGGAIGGVVNVLDRKIPTAVPQQGIEAEAELRGATGTKERAGAIGITAGSGNFAVRVEGLKRRSSDYRVPDWPDGKLAGSYSESGQGTVGMSWITPRGYVGVAFTHLESKYGLPGHNHEYEGCHPHGSHLHCGGHDDHGHGHDEHEEGEAEHDHGHEHGAGDVPYVKLRSNRTDLRAEYTDPFAGFEKIRFRGGLTDYRHDEIEGGQLGTRFQNRGYDARLELTHRPLYGWHGVVGVQTSYSDFRATGEEAFLPRSKTRAHGLFLLEEYRWADWRFELGARQDWQRVSPQSGAPASRTAGTSLSAAAIWDFAPQYSLALSVSRSQRLPSAQELYADGVHLATNTYEIGDPGLDRETSRNVDLTLRKHSGDTTFSVSAFHNRVKNYIYANTLDRYEDFRLIEYTQRDAEFTGVEGEVRHRFGKVFSAAVFGDYVRGRLTGGGGNLPRIPAARLGVRADAQWQNWAGGVEYFHVYRQDDIAAYESSTPGYDMVNATIRYRGKLDRTAYEIYLRGNNLLNKLAFNHASFISTVAPLPGRSVLLGVRLTY

SEQ ID NO: 2980 - protein, 726 aa, Parvularcula bermudensis HTCC2503
MGLRTSLSVSASLAVLLSGASLLPAVAQETEADEADRRLGAITVTAQRVEENLQDVPVAVTALDTAMLEDKQVGDLLDLQSVVPNINMATNTGTANAARIFLRGVGEDESRGAVDQAVGIYVDGVYVGRSVGSLFDVVDLASIEVLRGPQGTLYGRNTIGGAVKLTSIKPQFENSGEVRTTVGNNGRFDARGTANVQLGENSAFRLTGLLRERDGFHDVIPNGANASERRDDVGSTHIMALRGSFYTEFSPEWSLLVAADQTIDRSDPIPDSVAPGADADDDIFTIEPIPGTVCTPGSTAIGCFTGYDQRSKSAGVSATIKGDIAGLDFTSISAYRSLEDNLVTRIGSPYSQQTDQSQISQEFTLGSSGDVLDWLIGGFYFNEDLSMDSVFIFPHEIDAETESYALFGQGTYSVTDALSLTGGVRFTTETKDFSGANGVLPFSRTDSADYDNVSYTIGADYRFNDAMLGYAKYSTGFKSGGWSPDAFSATAVFLRVDEETLDSFEVGLKTDLFDDKVRINTAAFFNKYEGLQIGATVPGLGFTRFNVDETEIMGLEVEGIWQVTDNFQLNGNLGLLDAEYTDMTGDQARGLTNNGAGCPAGTVAADNAQVIACALGLSLKNAPEYKATLGALYTMSFYDGELIFSGDVSFEDDSWSLVANNPAHALSEIPTLMNARVKYESAQGWSLAVWGKNLSDEEYYRATTAGSFSTYASEPITYGIDLGWKF

SEQ ID NO: 2981 - protein, 736 aa, Parvularcula bermudensis HTCC2503
MGRYRPDDESEDPFPMSRTLSPHWLTCACLAGVMFVPMTGWAQTEGGETDAVDLSTVTVSGQAATKTQTPIVETPQSVSRVDRDEMDERDTRTLREAAQYTPGVYTNQVGASNRYDYLVMRGFSDGSLSNTYLDGLKVMGDTNGYSSMVIDPYFLESVEIVKGPASVLYGRSSPGGLVALTSKQPQFETHRQLRFSVGNNSQRSAAFDLTGPLDDERRAAYRVVGLASGADTQFDTVEEERYAIAPSVTWDVTDDTTLSFMAYLQKDPEGGYHSGVPYEGAVESHNGRKISNNFFDGEDDYDKFERTQRMFGYSLEHRFNDAWTARQKVRYLNADVDLDQVTQGAEYLYDSAGNLIGQNVWVDGDSNELKRYYYGAQESLEAWTIDNQVEANLDGGFIDHTLLVGVDYQTRQNDIVYTSGVFPNINPFDPQYGADPVGAIATASDERHELTQTGVYLQDQMAFDRWRLTLGGRYDWVNIENTDYLKDSEDKLDDTQFSGRAGVLYMFDNGVAPYMSYNTAFTPTSFVDAEGDVLEPMEGEQWETGLKYQPPETEDRYSLSLFRITQENVATKEQPTDPYRSIGEIESQGLELEARKQLTEGLRLQAAYSYTDIRYTKSEDPDEEGSHAIYAPRHQASLWSHYAFQSEALAGLDAGLGVRYYADIQADRANTEQVPDYTLVDAMLGYDLGQMGMSGMQVQLNVGNLLDKEYVASCNSLQYCYFGAERNVRASLTYDF

SEQ ID NO: 2982 - protein, 737 aa, Parvularcula bermudensis HTCC2503
MAITNYLFAKQRSLHRLQGRIWLSVSLSAALSGTALPGTAQTLDSGFEDSIPGLNAAIPEVLTTTRLRQPKTRVPGSTTVIAGDLIRDLGIRSLYEVFRLVPGMVVNFVGSHQPVVTYHGTVHYEQRRMQVLVDGRTAHRATLSDMDWETMPVPLELIERIEVARGPNSAAYGINAFLGTINIITRDPADSANLETTVTSGSRGYLRTFASTGNADSSYDWRLSFERRKFDGFDYQVDDDERFPFNDGHDINSFIYDSRLTFTPGTNLELQGGVVDGTKYQDKDKSGELNPLDHPDIDVRDYYLQSKLNHSFSSEHFIHLQASVENFDRRQEYAISFPDSTVECLRNNTPLYEYTYTAGGRERRCFISQGGPDAFAVVDADSEDTRIELEAQDTLIVSDSLKLVSGAGFRKDIFRSETYFNGRGNNYQSRLFGNLEYSPWQWVTFNAGGNWERTSTTGDSYFSPRAAANFVVNNNHALRFVFSQAVRTPDGFEQSPDWGYTLRNVRPAIYSDLDGRRVTIEDAAQETGILTLGNDLEEETITSHEISYFGQFPLDQALFSLEVRGFRDELRDMISGVIQLKEWTLENNVAVDQKGFEVEASLDFPGTLLRASYGYLDQETWYTGAPILESDGTVNENEQRYMTELLERMSVRHSGSLAIIQDLPAGFKWSGAFYWADEFNTRFERFDTRLVKQIFQPRYTAEIALSMQHYLNREPELSSDNNIEDHNQFFVEAGIRF

SEQ ID NO: 2983 - protein, 390 aa, Parvularcula bermudensis HTCC2503
MKKTKLALAVWGALAGFNAAAQTSSVTLYGVIDVPIEYVNRVATAQPTVVNGQPVFANTGGSRVSMLPLGGRAPSRWGLRGVEDLGGGNSAIFVLESGFTADSGAMTSGRLFGRQSYVGLQSKTYGKLMFGRQYTSLFEGLSNFTPTRYASTYDPVAWQLGINYREDNTIKYLGTFGPVTVAAHYSFGVGVPLIGATPLAGGGAGETPGAFRDNNGYGAAVTYLNGTFGATLAYDEWHPAVTSGQQGVARKLGTAVSYAAGPFKAMLGYRWAKTDFANGNTLARDDYYWAGINYDITRALELTLAYYYADFKSLRLGPTAPSLAPANPWQTTLILDYRLSKRTDVYLATAYARNAGLNFDSTQTAFLFNYPSMAGQKGMFGVSTGIRHTF

SEQ ID NO: 2984 - protein, 602 aa, Parvularcula bermudensis HTCC2503
MIFGAAPARYWGPGAPTICRAAILSERDYNSGKFRAIFMRSRVLFLGAATMAIATTGTSMANLGREALPPSVWNWSGGYIGGHVGGGYGRTSFTNPFGPPIYGDVVDIPSFVAGGQIGYNWQNNSWVYGLELDASAAVASGSNTCLAASDLIVSANCNAAPNLFATGTGRIGYAFGSLGQTLAYLKAGAAWQNNRGDIVNNFEGGDLPQEKTHFDYGQVGGVIGLGVEQALTPSWSVNVEYDYLHFGGPSVATASTAKLSPSTILPASTTSLSSNYHIGKIGLNYHFGADPEAAPKSDSPLHARSAGSVPPIPYTSGWSFEGGSRLWLSRGRFQWDQSAVPYGWPEDPSILISRLTYHALDGLSGEVFGRVDSPWGVFLKSSLGIGFFNKGKSNDEDWLPHEGYPYLNTRSGESNGRFAYYTADAGYDVLRSTNYKIGGFIGWAYYSQSSDSRGCVPLTNPQDFCRIKPSDDRIVGSQDTQWNAPRIGLSAETMLTERWRLNADIAYLPWTDFKGRDNHLLRKKTTFSEQHGNGGGGVQVEGLLSYFVTNNISLGVGGRYWAMWTKKEADSADCGNGCGSLGFANYSMERWGTFFQASYKLN

SEQ ID NO: 2985 - protein, 971 aa, Parvularcula bermudensis HTCC2503
MRTTTIKFSAITLALLSYCGVILADSHQEATELDTITVSSQQDEMNIKEKKVGETVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELEIYDYKNGRDIQGKEREKADPYTITKESTLVKFSFSPTENHRFTVASDTYLQHSRGHDLSYNLVATTYIQLDEKESRHANDLTKRKNVSFTYENYTVTPFWDTLKLSYSQQRITTRARTEDYCDGNEKCDSYKNPLGLQLKEGKIVDRNGDPVNLQLVDGKHQVVDKAGKPFDVTSGTNYAAFSGKQLGPSYFWLECTVFDCSKPVTTYKYRYSTETPVKEDIQLNKTMEVNGKTFATYDMGRERRYIILPNSQGYLPLDYKERDLNTKTKQINLDLTKAFTLFEIENELSYGGVYAKTTNGVVNKAGYYGRNPTWWAERTLGQSWNGTLRECKTSSSYNGMLCPRHEPLTSFLIPVEATTKSLYFADNIKLHNMLSVDLGYRYDDIKYQPEYIPGVTPKIADDMVKGLFIPLPEGEKVTVGTVVFTKPLTPEQIRKNAEENIAYIAQGKRFKKHSYSLGTTFDPLNFLRVQVKYSKGFRAPTSDELYFTFKHPDFTILPNPVLKPEEAKNQEIALTVHDNWGFVSTSVFQTKYRHFIDLAYLGSRNLSNSVGGQAQARDFQVYQNVNVDNAKVKGLEINARLNLGYFWHVLDGFNTSYKFTYQRGRLDGDRPMNAIQPKASVFGLGYDHKENKFGADLYITRVSEKKAKDTYNMFYKEQGYKDSAIRWRSDDYTLVDAVGYIKPIKNLTLQFGVYNLTERKYLTWESARSIKPFGTSNLINQKTGAGINRFYSPGRNFKFSAEITF

SEQ ID NO: 2986 - protein, 457 aa, Parvularcula bermudensis HTCC2503
MKRLLAAGCALFALAFATTAMAEVKPGSFAITPYVGGYTFDGEQHIKTGPTFGIRGGYNFTKNCGLEGVFGYTPTEQTKRESDVDAITYRLEGLYHFMPEKDLVPFLAVGGGGITIDSEGAGVKSRTDGIVTAGGGLKYFINEALAVRTDGRYILDLSRTLSNWEYTVGLSFLFGGEKKAVAPVAPAAAPAEATPAPEAPPAVMAAEPRPGLMKYCTDLKIEFDIDKADIRPQYKDEVKRVADYMKQYPNTTAVIEGYTDDVGSDDYNMKLSQRRAEAVVNSLVDDFGIDRSRLSAKGYGKTQPLTSNATEAGKQKNRRIQAVIDCTLEDPKVIAKLPDRLCVSLNIQFDTDKYTIKPQYHDEIAKVGEFMKQNPTTTAVIEGHTDRVGSYDYNMKLSLRRAESVVTYLADKFGIERSRLSAKGYGYTRPIGYNSDPKGRAMNRRINAIIDCVLQQK

SEQ ID NO: 2987 - protein, 713 aa, Parvularcula bermudensis HTCC2503
MMITNPLFRASSLALAISFSFTIQADEITRDPVLNVNEVIIVHGDGSEASEMATTHWSINEEEIRASGAQTLDQVLKNVPGVYIRVGGDGTPRVDIRGFKTRHVTLLVNGVPMSSADDGQFDPSVIPTSQIASVEVSVGPTSVLYGPSGAGGVINIITKQGRTAPALSGRLEASKDNTFNGDISAAGAGDDWQGLVSISRQQTDGFPMSNDFDPTQYQDGELRVNSDREVTNVYAQGSYWLSDKTQLIANMALRNGEWGKPARDGTGSGKLKYERTDDYDSHTFQLGLAHQFDNTFTLRGFGYHNQSDTLEAAYADETYQALTQTQDGRSVVQGVNLQFITDFHQAGLLTTSVIAEEQSWKSVVDTYSSNSGSGSGSNSGTGSGSGSGSGTGSGGGTGGGSGTGSGGGTGGGSGTGSGGGAGNGGGNGSGGAENLDDSAWLYTAAAEYQYQSEYHYGVTLGGAFHSLDASDGSDDNYSAMASSYWQVVTDSRLSLSVARKVRFPSMVNLYSQASGNSELEAEESKHIELGLEQDLPASTNFSIYGFYTDAKNYIAKDTAGFYQNMGRYEFKGIDFQINNHAIEHLDLSFSYSFLDSKEMEGDDTLDALQYRPRHQLRWQMSYEFPFETQIHLNVERILEQVYATQVKVNGKNQYQQQSLDNYTLVDINLVQPLISDKLEVYLRATNLLDENYYQSEALPQAGRQFFVGVNWQI

(The sequence listing continues in the following parts.)

What is claimed is:

1. An isolated recombinant OprD polypeptide comprising a plugging module and a pore domain, wherein at least one amino acid residue of the amino acid sequence comprising loop 7 as set forth in SEQ ID NO: 22994 is mutated to generate a matrix metalloproteinase (MMP) cleavage site, wherein cleavage of said MMP cleavage site by an MMP enables opening of the pore of said pore domain.

2. The isolated OprD polypeptide of claim 1, wherein said pore domain comprises a β barrel structure.

3. The isolated OprD polypeptide of claim 1, being a monomer.

4. The isolated OprD polypeptide of claim 1, wherein said MMP is selected from the group consisting of MMP-2, MMP-7, MMP-9 and MMP-14.

5. The isolated OprD polypeptide of claim 1, wherein said MMP is MMP-7.

6. The isolated OprD polypeptide of claim 5, wherein said cleavage site comprises the sequence as set forth in SEQ ID NO: 22856.

7. An isolated polynucleotide encoding the isolated pore-forming polypeptide of claim 1.

8. A drug delivery composition, comprising an encapsulating particle and the isolated OprD polypeptide of claim 1.

9. The composition of matter of claim 8, wherein said encapsulating particle is a liposome.

10. A pharmaceutical composition comprising the composition of matter of claim 8.

11. A method of producing a drug delivery composition, comprising inserting the isolated polypeptide of claim 1 into an encapsulating particle, wherein said encapsulating particle comprises at least one lipid layer, and a compartment surrounded by said lipid layer, and further wherein the isolated polypeptide is positioned such that it is capable of forming a pore through said lipid layer in a presence of said protease.

12. A method of treating a disease associated with an up-regulation and/or secretion and/or release of a protease in a subject in need thereof, the method comprising administering to the subject a therapeutically effective amount of the composition of claim 8 to the subject, thereby treating the disease associated with the up-regulation of the protease.

13. The method of claim 12, wherein the disease associated with an up-regulation of a protease is cancer.

14. The method of claim 13, wherein the cancer is a solid tumor.

* * * * *